United States Patent 9,328,346 (POLYCOMB-ASSOCIATED NON-CODING RNAS) - sequence listing, part 94

SEQ ID NO: 17631 - RNA, 26461 nt, Homo sapiens
cggagaaaaauuuuauaaucauauaccaguuaaagggacuugugccaggcuauaaaaggacucuuacaacucaauaauaaaaagacaaauaacccaauuaaaaaaugagcaagugaucuaaagauagcuguccuaagaagauaugcaaauggccaauaagcucaugaaaagaugcucaauaucauucgccaucagggaaaugcaaaccaaaaucacaaugagaugccacauuaccccuacuaggauggcuaaguuaaaagauagauaauaaaaagcacugagggauguggagucaucagaacccucaugcccuguugaugggauauaaaauugugucaccacauuggaaaacaguuugggagucccucaaggguuaaauagaguuucauaugauccagcaaaucugcucccaggcauauaccaaagagaaaugaaaacauauguccacacaaaaacucauacacaaaaguuccuagcagcauuauguauaauagucaagaaguagaaacgauccaaauguccaccaaucgaugcaugauaaauaaaauguaguacuaccauuccauacaauggaauauuacccgaugaaaaaauaaaguugaacacaugcuacaacauggaugaacuuugcuuauaagaacauugaaaagaaaaugccaaaagaaaaaugaguuuuagcucaaauuuuuuuuuaagaggccuagccugcucaaguuauccuguuaaaaaaaaaaaaaaaaaaaaaacucuucccauaucuaaggugaaaauaaaaaacauuuuuaaaaguuuaauauaaagaaugaaauaauuucaggucaaguuuauuauacagaaauuauauuaaugggugggauaaauacuuuacaggagagggucacacucucagacacuuuggcucccaaagggcuuggagcuuuugugaggcugagcaucuuccaaccaggugcaugcacugguuugccaacauccucaccacgcccaauccagccccuucacacacugacaucgccuaccugggcccuccuuguggccuuaaguuuuaucuaaccaguguacacaacauauuuauaaccaauuaauacgugugagucaugauuuguuuaaaaugucagcuuuugugaacugaaggggaugggcagaaggcaggaugcuguccuuggucaggaaugugacccagauuuuaacacugcuccuaggaaaaaaaaauauuuccuuuuaugaugccacuuccugggacaugaugagcugaagauuaaaaacucuucagagaugugcgagaaaaaacaagcccagggaaaagucugcaggcaugguggaggaagaaauuagggaugaaaucgcaaguggcagagcaagcaugaccaggcugaagucagcagagacaagagggcagcgaggcccagccuccucuucccucucccacagcguuuagggccacguccauggcgccaccccucuccuuucuucccaacugaaaagggugcccucuuuccuucuuuucugcagacgcugaugagaauuaaccagaggaacuuccuccacagcaacuauaacaggacauccucauccaguccuccuaucucauuuccugguggggaaacaggccuggcaaggaaauaggccgaaaucacgauuuaaaaaauguuguguuuaaguacucuggaacccuguguucagaggaaaucgugcaagaauagaucaaucagagcugaucugauggagacggaggauccagccacacagaggcccugcauuaacuguauuuccuguacucuugaugcucugguaucuggggccucgcugaccuggacagacugauccucccaggcuagccaaucccccaaucccuagagauggcaagcaucuggcugaaagcaugccuuuccuauggaaaccaacuaauccggagcgauggcgccagcugccuccuucacauggcucucccagggcugucacaccccaggccaacauucaccuguccugacuaucccggggccagguaucagacaaaaagggcagccccuauccugagagccacugaaauuacucaagccagcuacccuuaaaccugucuccccugcuuacucugccuugcccauuuccuccugaggaaaccagaggaagucucuugcccacacguuccccucccuccuuccgccuucugacccaccguggggcuuuccuauguggccccuccucucagaaccguaaguaacaaacucuccuuuccauggcaguccccuccucauccaauggcuuuaccacaccucgaugagaugguuuacaacaggcccauucuagaaguaaacauuauucccagaaauccuggaauagggauucagaaaauucacauuguggaggugccacgacucgggagagccuggccagcgaggugccacccgaauagcuccugaccaugggcacagaagggaccaaacauggagagaggcacagccuggagucauggaaaaggaccaggcaggacaggaggaagagccuggcaaggaggcaggggcgcaauagugcccaagcagugugggcauuaggaagagggcagaaagaaaacagugcuguggcacaagaccggggcagccccgggccagcucagccauccaguucuuccuugacacugaugugcaaggggcagaugcgcaaaggcucuggaggcccggcgccccgugcaccccccagguagaaguaggggcgaaccuccccaaagcgggcguggaagguguacagguggcaguggcgcuccgcgucauagaaagacagcucgcccuccucacacuccagcuccacacgcaggcggcgugggauggccaggaccaggggcgacguggcuggguccgaggucacgcaguggucccccuccacgcccugcgugcggcagacauaccagaagcccgagcgugugucgugguagcagcugugugaguggcccucagcgcccgaguccuggcgcacacguaccacgcccacccuccagcucugcagccccccaagggccaccucccaggcgugcgagcccugugagaagacacgggagcccagcaggcagggcgccgaggagaagcguuccggguucuccaccugcacgcgguagccaugguuggugacgcuggugaggucgucagacacggagagccagccagcugcgguguuggggucaaagcugaaggguacugcaagcagaggcggaaauggggaaucagcaaaccugaggucccuuaggccacacguggauaucuccagccccacaaaccaaccacugugucacaccuggccccaaguccaugcaaggaguggcccagggcuggagugguggcagggguugggcuguaucccccagaagauaugcggcagucccaaccccugguaccuccgagugugaccuuauuugggaauggggugguuguacacauauuaguuaagaugaagacuggaggaggguccccaauccaauaugaccuguguccuuaaaauaaagaggagacagacacagauacacaggggagaaugcugugugauggcggaggugaggaucaaagugcugagggggagccaauaaggccaagaauggccaggagacaccaggagacggaagaggaaaugaagacucuccucuacagguuucagagggggccugguccuuccaacaucuggauuuuggauuucuacccuccagaacugugagagagucaacuucugucauuuucuaguuugugguccuucguuauggcagccacaggaacucauacaggcagagacucuuaacacucacacgaccaagggauguuaggacagcacggcccauucccugagucagugauauuccuccccguaaaaccaggacacuguggcucaugugggcugcagucgccuuaggagaggcaagcccagaugcaggaggucuuuuaucauacaaaacacaguucugaauaggcaagaaagccaguuucccucucugaagaagggaccaagugucaggacccugagagaaggcauucuaccaggaggguuggagguguugggcagaguggaaaagaccaggguacaggaaccugccugcgagggacuggcagagggaucagcugagagaggaggggagcucugaggaggugggaggugggcccggcagagaccagcccuggugccucuuugcuaacaugaagggcuuccacccaugcuugggacaccugccggcacccccgcucaccagauuccacagaugcaagcaucuucuuccagacgcgguacugcagggagcccagguacuugcagacaucgauaagcaugccgggcuggacuggcucuggcuccauggugcagaagagucuggaaaaguacaauggguauggugggcagggccagagccaugcaaccugggccgaacugggccaacuggaaaccagcaacaggacuuguucccuucccucaggcccaaguuuccuggccaccuucuccaagacaagacuggacugggcuacgaugggagaugggccaaggccaacagggcugccaucucccuucagcauucaauccgagggcucacccugccccaacuaggagaaauacaaacaggagguucuccaacauggcugccauccuugcaggcagaaaucacacuuacacauccggcucaugggaugucugaguuggaagggacccuaaggaugcucuaguccaacaaucccaagguguccuccagccuuugcuugcacacugccagugggaagugagcacagggaacucacucccuccaaaagcacucuauuccaucuuugcacagcucugacugggacacagcucuuccucauucaucccugugaacccaacaaccaucaacacaaaccaccauggccuaaggcucucagagggagggggcugaucaagaaacaagccugacauugacuggccccgagaaaugcaagccacaugcaggauaguguucuccuucccugcacggcagguggggacccuccacacucaggagaacaacacugccccagagccaacuugaacuggaugcugugagagggcucucuccaccuggccauuguccaccucucccucuaaaaccagggccaguagcucaugugugcuggugcacccagcugguuguuaccugcuugccccggggccacuggaguuugcaccccugguauuucugcccacucuuccccuccccuccaccagcuuuggcaacuuaccggcguuuucggcucuuguguuucugaaaaaauaaaaauaaaaaaauaacacagagacacagauguagaggaaauguauauguuucugaccucaaaagaagucaugcauuccauggaucauaagucuuaauauugucaagauguuaacaauaacaucccugcuaugauuugaacauauuauccaaaaguucauguguugaacacugaauccccaaugcgacaguguugggaggaaaggccuaaaaagaggugauugggucaugagggcagagcccucacaaauggauuaauaccguuauugugaagugguuuaguugucaugagacuggguugcuauaaagcaaugagcaacuacucugucuugcacucauuuccuccuucugccaugagaugacccacaccaaaugccagagccaucaugcuccuggacuuccuggccucacccagaacacugagcugaauaaacuuguauuguuuuauaauuuacccagucugugauauucugucauagcaacagaaaacauaagaagagacuccuuaaguugaucuacugauucagugcaaucccuuauccuagcuggcuucuuugcagaaacuaaaaaacugauccuaaaauucacacaaaauuucaaggaacccagaauagccaaaaccaucuugaaaaagaagaacauuggaagacucauaaucuccaauuucaagacuuacuacaaaucaacaguaaucaagauaguaugguacuaauauaaaaacaggcacugagaucaauggaauagaauugaaaguccagaaauaaacccucauauuuaccaucaaucaauuauuuacaauagugccaagaugauuuaauggaggaauagucuuuccaacaaaugguacugggaaaacuguauguugacaugcaaaaaaaaaaaaaaaaaaaaagugaaguuggacuaacccuuacuauaccauauacaaaaaaaaaacucaaaaugcaucaaagaccuacaugaagagcuaaaaccgauaaaaaacuuguaucuagacuauauaaagaacucuuacaacucaacaauaaaaagacaacccacauuaaaaaugggcaaaggaugugaauagacauuuguccaaggaagaucuacuaaugaucaaaaagcccaugaaaagauguuccaagucauuagccaucagggaugugaugacaugcaauacacaaggagauaccacuucacaccuacaaggaugguuauaauuuuuaaaaaacaaauuuuggcaaaaauauggagaaacuggaauccacauacacuccugaugggaauauaaaaugauacaguugcucugaauaauggccuagcaguucuuccaauaguuaaaccuagaguuaccauuugauccagcaaaucuacucccagacauauuuccaagaaaaaugaaaacauguccacauaaaaauugcuaccugaauguuuauagucauauuauucauaauagccaaaauagaaacaacccaaaugaccacugucuuaguucauuuuguguugcuguaacaaaauaccacagacuggguaauuuauaaacaauaguuuauuucacucgugguucugaagcuggaaaguccaagagcauggcaccagcaucugaugagagcccucaugcugugucaucccauggcagaaggaagaagggcaagagacuacacauaagaccaagagcaagagagcaagaggggcccaaacucacuuuuauaacaagcccacucucucaauaacuaacccacucugccaguaacaacauuaacccauucaugagggcucucaugacccaaucacuucuuauuaggcuccaccacccaacacuguugcauuggggauuaaguuuguaacacauaaauuuuggggaacauauuuaaaccacagcaaccaccaauugauaaaucaaucaauaaaauauaauauagccaugugcaacguaacgauguuucagucaacaaggaaccacauauaugacuaugguauggucccaugagauuauaucacuguuuuuuacuguacuuuuucuauguuuagauauacaaauacuuaacagugggcuccaguugccuacaguauucagugcagcaacgugcuguacagguuuguagccuaggagcaaaaggcuauuccauauaaucuaggugugcaguaggcuacaccauguaggcuucuguaagcacacuccaugacacuugcauaaugaagaaacugccuaauaauacauuucucagaacauauccccaucacuaagaagugcaugauuauauaucuaugccauggaauauuauucagccauaaaaaagaaugaaguacugauagaugcuacaacaugaaugauguuucaaaauaugcugacugaaagaaggcagucacaaaagguuacauguuauauaauuccaugcauuugaaaugucuacaacagguaaauccauauagauaguauguagacuagugguugccaggggcugcuaauucuaguaauuaccacucuguuagacucaauuucgguagcaguuuuuaugugggaggaggaacuggggagugacagcuaaagcagggcugcuuuuggaggcaugaaauguucuaaaauugucgugaugguugcacaacucuguauauacuaaaaaucacugagugguacauuuuaaaugggugaauuguuuagcauguaaauuauaucucaauaaaguuguuaauaaaaaauaaaaaagagucacaaaccaaaaucaucccugaaagcacucugaguacugggcagacaauacucccaauucccuaaacagaauccucgagacacacagcuuuuagaucccacaaaaugauuuuucuuuuucuuuuuuuuuuuucuucauuuuucuuuuuagagacagcucugaacacagaaugauuucauaaucagggacauuuuugagacaggagacuucaugguuccaggcuuugagugagguggagaacuccuaaaggacccacccaggagaugacacugccugaacagauaacugucccugucgccucccacuccacucuacagcgacaccccuuccacagcagucagcuguuuuccagguacaagagacaccucaccacccuggccaguuuacagaccagcuuucgagcccagaaauuucccuguaggaaauuuguaaggaccacuggcucauggggaggaaauaaaucaauaaaaggaaaaaaaaaugaauaauacuguuuuuuuaaagagagaauggaaucauccuuuucuuaagaagacagaaagccaaggcauuauauuuaaauaaaaaauuuaaauaauugaaugauuuuaaaagaauucaucuuauuaaaagguagagaccggaaaaaaaaugagaguaagagagagggcaagagaaaggaagaaagaagagacaggagcugggcacaguggugcgccaguaguccaacuaccugggaggccaagguggaagcaucacuugaggccagggauucaagaccagcuugggcaacauagugagaccccccucaccccuaccugacugguaaaaaaugaaaaaaauuaguugggcaugguggcucgugccuguagucccagcuacucaggaggcuaaggagagaggaucacuugagcccaugaguuugagguuacacugagcuauaaucacccacuguacuccagccugggugauacagcaagacccugucucuaaaaaaaagaagagcgaggaagaaauaacaggguuucaaggaacuccgcccugauaagucuuuuuaguuucaugacacaagcagagcagguuacuugugagcuccuccaggccaguacccaggaagcuccaggaagaugacguuggccagggcuggugggcuauggcucccagcugguccuggaacauguggcccugucacugaauccagacgcugagcuccuuaccaugagaaaagaaacgucguccuccuucaucuccaucugcagccgcucgaucucaugugccagcaccuccgucuccucugugagcugcuucaucuucucgucggccagaaguugcuucugccuugucuccucggccauggcauccagaauggccugcuccuccacucucaagaacucgcgaagcuuaucaaacuccugccggauccggccuuccagccaugcagccuccaccuacggaagacagcaggaggagucaggggucagauguggagaggacauccauagcccagcaacuuucccauuuuuagcaaaggaaauuuauguucaaauaaaucauguauagaaccccuacagauaaaauaucaacauaauaguuuauaagcacaaauuucuaaguuccgauuucaaaugggaaaguccaacaaccuaauauuagauuguuuugacaggguuuuuaaaaauaaaaucacagcuuauauagauggcaacuguaguacuauaaccucaucuacauacaauguucaguuccuucuuuagguugcaccauaacaagggaaguccugaaucauagaaaugaauggcugcgaauagcaaugauuuuuuuuuaaguauuuaccuuccaaucuuaggacuuaaaauuugucugauccagaggcuuuaccaaaagagcaguaggaagcauucauuuuaaaacaaucauuaaaauaauauacacacuccaaaucacaaccacaaaaaguuuguuuuuuuuuuucuuuuugagacuaagucucgcucuuucaccuaggcuggagugcaguggugugaucuuggcucacugcaaccucugccuccuggguucaagcaauuuucccugccucagccucccgaguagcugggacuacaggcacacgccaccacgcccagcuaauuuuuguauuuuuuaguagagaugggguuuugccacguuggucaggcuggucucaaacuccugacuuaaggugaucugcccgccucggccucccaaagugcugggauuacaagcgugagccacugugcccagccucacaaaaaguuuuuuaaaagggaagauaaaaccauaaauguaaugaaagaaaaagcaaauaaauauuucucagcuuggaauaagaaagacauuccucggcacaguaugaaacugagaagccuugaagaaagaaugagauaacugaauacacagaaaaauaagagguguguauggcaagagacuaucauaaaguuaaagacaaaaauacaauuccaugacaacuguuggaaaaaccauucaaaaugugugcuguggcaauggcagguuaguaaacucaucuuuggacugaaaguuaaauacagaugcuccucaaguuaugaugggguuacaucccaauaaacccaucauaaguugaaaaauaguuaagucaaagcaaugaauacaccuaaccuacuaaaaacaucauagguuagccuagccuaccuuaaacgugcccaggacacucacauuagccuacacuugggcagaaucauccaacacaaagccuaugucauaauaaagcacugagugucucauguaauuuauugaauacuguacugaaggggaaaaacagaaugguuguauggguacucaaaguacaguuucuacugaaugcauauugcuuucguaccacaguaaagucaaaaaaucauaagccagggacuguguguauguuuacagcucugaaaauauacgaaaaggauucacugaaaaaaugaaaauggccaaaaaaauugagaaugauccacucaaaaagaaaugacaaacuaggaaauauauuugcaacauuuaugacaaauggcuauuauuauuaauguacaaagcacucuuacaaauccacuaagagaaaagacaaauauuccaagggaaaaaaagaaugugaauuagcauucacagaagaagcauaaaugacuauuaugcuugugaaaagauguacaaacuuaccaauaaucaaagaaaugcaaaugaggacaaacagcaugguuaaccuaucaggcugaaaagacugauaaugucugcauuggagagaguagaauccagggugauucucuuuuuuuuuuuuuuuuuuuacauuuaaguuccaggauacaugugcaggacaugcagguuuguuacauagguaaaugugcgccaugguggucugcugcaccugucaacccaucaccuaggcauuaagccccgcaugcauuagcuauuuauccugaugcucucccucuccccaguaauucuuaucacacaaaaacaucaagaacacagcauggcaggaaaaaccagcaagugcaaggucaacuccugcccacucaccgugggcaaugacggccucacuguaaaggaacaaacaccagaacuuucacuuuccucaucgaccugauaacugaauuuaauagaaaaaguacuaaucaggcuggaauucuaggggcuucccaugugaccucauuacccuuagccucagcaaaaagcucaggacuccuacacucccugggaugggcaggcagugccaccacacagacagacagauacucccuaaguauccccaacccaguccuguacaaggcaagccagucauauggcuuuagccacagaaggaaaccaaguaagagaacaaugauaaagcuacaugacuccacgaugacuacuggaaaaacaacucaacaaacuccagcaacagcagguucguaaucgcuauuuggaguuggaauuucaacauguauuuauggcucugacaucggaugacaaaauaaucuacugaacaaagugaaaacucucucccaccaguuuguuggucuauuagacaucagaaauguuaaggacuugucucuguugggcacuuguaugcauuaucuuaucuaaauuuuuuuuuaaaaacccuaguaaaagggaauugcccucuuuuuacagaggaggggauuagcuuggaggggguugagggauuugcuggggaacugggcuuagauuuggaaauaggucugcuuugcgguuacugcccuggcacccagugugucacauaauccuuucuuccacacuguuccaccagcucuguggcucaggguaaacuccacagccaaauguuaaugaggcucuuuccugggacuaauccucaccuauggacacaugguggaggggaccgcaggcuccugaggacagcgcccagcaaccuggaccaggcauggcucagcuguggcuaagaugagucuaacagagugguaauuacuagaagcaaccacuucagaaagccaaagaccagagccaagaucaacagucagaaacaagguugccaauccacacaggaccuggaggaagagagggugccaggcagaacaaccagaauggggacagagggagcccacucauucauuugauuaacaguuauuggucaccuacccacuucacucauucaaucaacaauuuuuauuggucaccuauugugugccaagaacuccucuagauaacuggcaauagugugcccuguuuucauuauauuuugacaggaagggauaaaaagcaaauagaaaacaaaagguaauuacagguaaugaagugucauuaagaaaauaaaccaggaaauuaugccaucgaguaaaagaggaggaugaucaggaaaagcuucuuuaagagaacaucugagcugagauuuuaauggcaaagaugcugggcauguguucuggggagaagacuuaguuugcuuaagggacagaaagaaggugaggcagagaaguaaaugagguugaggauaggcagggucaggagauggccuuggaggccaugguaaggaaucugggugguacugagggugacuggaagccacuggcaguuuuaagcagaggaggggcacggcugguguuuuuuucuaaacgaucaccccaguccauggaaaggagaaugcacaagaaugaaagcaugaggcccuaggcaggaggcccagugagagaugaugaugaccuggaccaaaagguggaggguuuuacagaaauaacauacuuuggagauaggggaauaggauugcugauggaguggaugugggaacugaaagaaaacaagaaaguacaugagucccaggucaucauugaacacacagguggcagugauaugaugcaugugccauagugcagaugguguugguagcuuuuuaagucacuccuguggcugcuggcaugaccacgccugggucuuuagaggggccaaggcagagaagccacagucagcauccaggacguggcugcacaggaccaucagagguaaggcagccgaccucuacccagcggguuaugugagccaaagccacggcugacacaucuucacuccuccccagacugcccugaguggacccaaucuucccacuuggccccaucguucgcucaccugauugugcuuggcgauggccucauaggagcgccgcauggcccagaaggccuuggccuucucccgcagugcaugcuccauguuccugcacuuggccugacaugggaaugagagagagggaggaagacagguuagggcuggaggcugggcagagagggcagacacaucacauuuacaacugggacuccacuucaacacaaguguaacucaacugcauuugccuaaccccauccaugccaagugcucugggcacaaaugguaaguaagguccugauccugaaucagacauccaugggauaaagagcccucagacauccuguagcccagccugguacagacugggagauggggcugagaagaagcaagcugcucucucucauguuggucacagcacaggccagaagagugucccaugugggccaaaagcugguucaugcugggucugaaucccugagcuguguggacaacugcagacaguguggucauagguucccucugcaguuuccuaaacugaaugggucugcaaucucuaaugugaggugacugacaauggggguggagccagucauuucccacgggguucaguuaccucccaugaggccucaccucaacaugcccaacaugccccuccauaccccuccugcauccugacauucuaacacugcuuguaucgcacggaauacuuuaaucagcaggcacaaauacuuuugguuuaguaguuuuuguuucuuaaacuuuaaugauuguuucugauguccuuggacaacuugaagaaccacuagaguguuuuagguuggauuccugccucuuguaucuuaggccuaucauuuuuucucccucauuauccuuuucgaucuacauucucagaaagcuucucaaguuuuuucuuaagaaaaauaauucaaauaauuauaaaugguuaucauuuauucaguacuuacucugugccagggacaacaccaauuacuugagaaauuaugucauuuaaucauuacuucucccuaguagauaaguaauauuauuggccccauuuauagaugagaaagugaggcacagaagggaaaugaccagcccaagggcacacagcuaguauguggaaggacgugaaccuggacagcuauggaggcagcugcugagacagcacccagugaucccucccuccugugagaugagaguguuuuaagcugcuaaaugucggggugacuggauaugcagcaauaaauuauacagaugugucgcccaaagccucauucccaucuggaccugauuuagaugacaaaucuggacuuugggcugaugcuguaaagggaugagauguuuggagagcuugggagagggccagugcauuuugcaugugggagggacaugacuccuuauggggcaaaggacagauucaggcaggcagccucuaaaguggccccagugacccucaccuccugauacucaugcucuugugaaauccccuccucugugggugacuuguuucuaaccaaaagaauguggcaagugauacuaagucaccucugagguuaggcgacaaaggcuguguacacccugccuuccucucucuagcuugcucacugggaugguagccagcugcccaugugguaauuugcccugggagugacugcuggggcaagaaacugagaguggcuucugaccuacagccagugagggacucaggcucucaggcuaacagcccgugaagaccugaauccugccaacaacuacaaaugugaguguaaauaaggauccugcccuagcugagccuucagaugagaccacagcuccauaccuacagccccucaugacagaccuugaggcagaggcacccagagcuaaggcaggcccaauuccugacccacagaaacucaaagauaauaaauguuuguuuuaaggcacuaaguuuugggcaauuugcuaggaaauagagaacuagcccauugguuagaacuagcccacagaacccugacugcagccccucaugagacaccuugaggcagaggcacccagagcuaaggcaggcccaauuccugacccaaagaaacucaaagauaauuaauguuuguuuuaaggcacuaaguuuuggggcaauuugcuaggaaauagagaacuagcccauuugucccacucaguagcccauuccuuuaagucuuucacuacagaaaacaaaaugguuacugauuucauuuucugcaguucuguuuuauuuucaacucauuuugaucuuuuaaucuuaagugacaauauuuaagauuuuuaaacuuuguuuucuguaguauaucaucucuaauuugcaugagugcccccacaaaaccacugaaaugucauuccaauguuuuauuuuauagaaugagauuuuugauacaaaaucauguaauacaguucaaaaggaaaauuuagugauuugccaaauuaguuaagugacaggagugaagcagcuguccauacgcauuacccaaaggugugcaggccccaaaacaacacaguucagccccugcccuucaacccuggcccuuaggaauuuaugggacaauaaggaugggaaggggauagucccuugaucuucucaaacuuuucaaucacuuggagaguucugguuuccuucagaaaagaccaauccuaaaauggcccuucucugagaugucagcugaugagacuaaccaacaauuauauuacuauugcuagcaagcaguuacuauuaagcauguacuagacacaaggcacuaaauuaugcacuuuacaaacauucuauuuaauucaauuauuuaauucgaauucucccuauaagguuaagcacugugagucccauuauacagaggaucaaguuagacccagaggagguaaccuucuuguacaugucuccuggggacacaugggaacucguuucuucauaauauauuccuggggauaaaacugcugggccaccauaugugucuucacuuuacugcguaaugccaaauuguuuuccaaagcagugguaccaauuuuuacagcaagagcaauguuaauagaaaauguuuauugaccacuucaauguuuauuuuuaaguacucaguaaaguauuguccauuuuuccauugcguugccugccauuuuccuaacugguuugugggaauuuauuauauauacacaauguauguccuugauuaguuagagguguaaugaauauuuucuacuucaucauuuaucuuucuuaauugaaauauggccaaauuuauuagucuuuuccuuuaggauuaguauacuaguuuuaagaaacaccucccuacacugagaucacaaaaacaaucguauuauuuccucaaagcuuuauagcuuugcauuauuauuguauagcucuguaguauuuucucaaagcuuuauagcuuuccuuucacauuuaggucugauguggauaccuggaguuuauuuuugcacauggugugaccagguagcucauugucucagcaccauuauuuaaaaagaccauuacugcccacuggucugcagagccaccucugucuuaaaucagacacagaucuguuuuuugguucucuccaucuguuucucuggcccaucuguuuauccuugugccaacaucacacagccauaauuucuauagcuguaaaaaagagaggauuucugauagguuucucuucaagaaugucuuggcaauuuuuggcccuuugagggucauauaaauuuuagaaucugugaaguugcauaaaaauaaucauguugagauuuagauuaguacaauauugucucuauagaucaauuuggggaaaacugaaaggcuuaaauacugacuuuacuaauccacgaacauaauauaucacaccaguuacuuaauguucuuugauagcucucaacgaaguauauuuuucccuaucagaguuuugcguaucuuuuauuaauuucuuccuaguuaucuuauuuuuuauauuauuguaaacauauuuuuaaauuaaaaaaacccaaaacagggucccccucugucacccaggcugcagugcaguaguagcacaaucauagcucacugcagccuccugugcucaagugauccucccaccaccucagccucccaaguagcugggacuacaagcaugcaccaccacaccuggcuaauuuguuuuaacuuuuuguagagacaggcuggacuauguugugcaagcuggucugaaacuccuuggcucaaacgauccuccugccucagccucccaaagugcugggauuacagguguaaaacucccugccuauauuuuauuuucuauuugcuagugauacauagaaauacaacugguuuugcaucuugauuuuggauucagcauucaccuaaacuuauuaauacuuaugauuuaacuguagaaucuuuauuuucuacacauagaaaucucagugcaaaaauaugcaaccauauuaucuacacaugccaguuuugcuucccuucuuuccaaaccuuacaucuuuuauuuauaauuauuggcuuacuucauugacaaggcuaucccacacaaaacugaauagaguuggucauaaugcgcauuccugucuuuuucuugaucucaauaagaaagcuuucaauguuuugccauuaaaugugauauuugcuguaaguuuuuuugcuagauauacuuaaucaaacuaaugaaauuccuuccauuucuaguuuccuguuuuuuuaaacacaaaaagaugguaaauuuuaucaaauguuuucucacugagauaauuauauuaagcaacacagaauuagguuucguuuucuuauccagucagaucaacauuuucauuuaacuggaguauuuaacacauaauuaccgauauguuugcauuuaaaucugccaccuuguucugagcuauuugucuugcuuauucuauuuuucuuuuucuuccuuuccuuuuuuaaaauuuacuacacauuuuuuauuccauuuuccccuucugugcaucuagugguucaccuaggaaauaugacauguaagaagugugaauuugaaugcaucuaaacaauauuauuuuguuugcuuuugguauuaauuuuaacccuaaauaugcuuagauuacaaauagaacuaccacucaaggggccugccuguagcccaaggagcacaugaaugagcagagaugggcaguagcaggggcccacaacagaucuggagcaucccccagcccaagcucaggagagcaaacaagcuucgauguuagcaucacauuauaacauuaagauuuuuuauuuauuuauuuuauauuuuuuacuuuuuugagauagagucucauucuucuuguccaggcuagagugcaguggcgcaaucucggcucacugcaaccucugucucccagauucaagcaauucucuugccucagccucccaaguagcuaggauuacaagugccugccgccaugcccaacuaauuuuuguauuuuuaguagagacaggguuucaccauguuggccaggcuggucuugaacuccugaucucaggugauccgcccgccucggcaucccaaaaugcugggauuacaggcaugagccaccgcguccagccuacguuaaagauuaguuauaaacacacacaaaauagguuuuuauucauacuaaaggauccagaaugugaucauauagacuacaugauuucccaaaaaugacaaguugauuccuuaagcaacaaauuucaauugcauauugaagaucuuaagcacuuuacaaaaucacguuacccacaauuuucauuaacaggacaggugcucugugguauagcuggaagcaggaagguaggggcaagggaaagaaugaauuucauugcacaaggucuucauagccucuuugcaaggacuuaccaaagugcuagaguugcaugugaaaccagcucugucuggccugagccagguuuucugucuugugagacuugauacacacuguugcucugccugguucccaccugcuucccccaacuaacccaacaucaccuugaaaacucggcucuaguaccccucauuuccuccaggaagccccccgaucuugccagcucagguuccauuccagggcaucacagcacccuggccaccucugucucagcacucacuauccaggguaauagcuucucuuuccugagggcaggucuuaaccuccagguccucucuaccuugcauaguggugcucgguacacuucugcagaaggaaugcuugcucugcaaggugagagacuuuguuuuguccccugcauguccaagucccugcacaaaguagauguucaguuaaccaccugcccagucaaugaguacauggaaugccuguguuuuuucugcuauauaccuugccuccuggacugaagguuaggagagcugguuuggagccuugucuuugucacuauccacuggugaguugguaaaaaguuccuucucucuucggcuaucaggcuccucaccuuaaaaaugaaagcagagaagucucuacagucucccaaauuucacgauuuguuuucaggcagauugauguagcagccaagaguucuggcaccuggccgaccagguucaaaucccagcaccucuaccuaguagcaggugaucuugaacauguuccuucacuucucugcaccuccauuuccucaucuggauaagagggauaaaaaauacuaccaagcucaaaggacugcugugaggacuccacaaaucaaucccuauaagaugcuuacaugagaguggcaggcacaugcugugcauucggcauagcucuuaagugccaccuacaugccagguaaccuaacuguccugcuggauaugguccagguuucuuaaaugaacaguaaaaaugcauggagcuuucuuaugcaacuccaaaucagucucccagaucugucuuuccccuuuguguucagaccuccuuccaaagcaagugucugccaugcagcccacugcuggaggccaucacucaggagccucagugugcagggucuagugagacaccccccacucccaauaccacugggcacaggccuggacaagcaagcaagcaacaauguccucuggugcaaccaaagagcugguaaguccucaccuagaagcuggggaucaggaugggggugagugguuaggaaauggggaaaagcauuggaagggggaagaccuggaauguggcuuaagagguaucgagaguacccuuggguuagauccagccagauggacucuaagauguugacgccagaaggggagagagggcuggagcugggacagggagaggcugguggcaaagaauggucaucaugccaguccugcaagauggauaagacaagggucugcacaaggcagcucagcacagggcugcuguagaagaugcaagcuggagagugcuggacugggaggcaggaaaccugaguucugauccuagaacuuuauuuauuuauuuauguaagauacagggucucacacuguugcccaggcuggaugcaguggcccagucauagcucacugcacccucgaaugccuggccucaagcaauccucccaucucagccccucgaguagcugggacuacagguaugugccaccacacccggcuaauuuuuuucuucuuuggugcaggaucuugaacuacuggccucaagcaauccuccugccucagccuccccaagcacugggauuacaggcaugaaacacacuggccuugauccacuucucauuacuuagauguaaccaccuccucacaagauguaaccauuccaucacaauagaaugacgcacggucugugucugaggauguuuucauuuaauggcaaccuaaaccaaaccuaagacaauccuacuccaagccacgacauaaacagcgcugacacaugcuuucaguucacaacuucaucaucagcauucguauuuucuuuuuuucuuucuuuuuuuuuuuuuugagacagugucuugcucugucguacaggcuggagggcaguggcacgaucucggcucacugcaaccuccaucucccggguuuaagcgauucuccugccucagccucccaaguagcugggacuacagguaccugccaccaugccugguuaauuuuugcauuuuuaguagagaugggguuucaccauacuggccaggcuggucucgaacuccugaccucgugaucugccugccucggccucccaaagugcugggauuacaggcaugagccaccacacccggccaccauucauauuuucuuaacagcuuacuugauaucaagacaugacuuucaucgucuuguccugauaaggaaagaagagaaauacacauagcagguaaagaaugugccggacccaaaugaaggccaaucccguaacaagaaagcuccagagcucuucagagaaauuugggcggauuaaguagucacuuggaacagaguaaugggagaaucagaaguaucuuggccaggaguagagauuuuguuccagcaaaauaaaacuuuagaauuaauauuuuaaguggaauguuauugauuauaguuuuguauucagucuguucacuuccuuuuguuuuauugcuuauauguagcaugagcaagugcuauuuauaccagguuugcauuuguaugcauguaaauaauaacauaauuuaacucucacuggcuagacuauuuuuuccuuuaagaagaaugcauacuuguucaaguuugagaaacgccagacuaggauuucugaagguccuuccaagcacuguuccuugcuacagcucugcuguaaacaugaugccaggcucccaaaucucaucaguccuuccaucaugcgccacugcaccuacgauaaaaaucccagcuccuaagcagggcccucuguguccugugggaucuguccugcaguuccucauccccacgugaaccaucucucagucacugcacacccccacgcugugccccgccgccacacccccgccacacacacacacugcucgccgccccucaaucagcuccucucagcgaaaucacuuccuuggagacuccuucccacaccccaccaaacaagagcagccucccccuuacaaucucccaccacauccuguacuguccuucacaggaauguugagcugaaacuauguaauuauuagugagaugauacaaccaugcccacaaaggcaaggucuaggacuguccgguccuguccuggacacaguacuggcacacaaccaguaccuucugccagcccugacaauggucaacagccacuccaaccccuaacacacagucagcugcccgcugaagucugagaugagagaaaccucucucaaaguccaggaccagugugugaacugaacaaggcuccaggugaucuuuagagcuacuugcucugugacuuuggacaaguuucuuacccucucuaugauucuauaauugucuauaaaauggggauaauagcaccuaacuguagcaagcugaauaauuauuuccccgaaaagauguccccauucuaauccccagaaucuuguauggcaaaagggacugugcagaugauuaaauuaaggaucuugcuguggggagguuauccuggauuaccugggugggcccaaugucaucacaggguccuuaugagagggagguaguagaacuggucaaagaagucaaagugacaacagaugcagaacggaaugacacacuucagagcuggaagaaggggccucugcaagcuggagaaggcaaggaaauaaauucucccuggagccuccaaaaggaauguagcccugcagacaccucgauuuuaggacuuccaaccuccagaaccauaagagaacaaacuugugcuauuuuaaaccaccacauuuauuacgcaguaacaggaaacacaggaccugaaaauacguuuuugugagcauuaaauuuguugacgugugaacacugaaaagcaucuagcacacagugagcacugaaauguguuagcugggaugauuuugacuuugcuguuccucacauagauaguuggcaaaguaaucuuucucuaaaacacacaucccaucacaaacuccccuguuuagaaucuuucagagcuccccacagcacaaaacggaaaacccccucagugaggcacacagcuucuuacccagucccuucuuaccaagugguggagggaaucuucccauaccgcucccccacaaccaccuaccuugaaucacacagaacuacaucuugucuauugacugucuaugcccccugcucaaaugagaauuccaugaagcuaagaagaggccacagcacacaacagccaucaguacccauuugucuaguaaaugagugauuugcacccugcaucaggcugaccacaccuggcucucauucuucucagauccauuugggacuagacuacucagccccugacaucauccugaguguccacugacuugacaccaucauucuucugcuaaaacccccagcugcuguucacagcaagggugagccaccggccuccuggauccuccugcacgucccuccucauucuaacuacccuuaaauucccucagugccuagaaagucaggcuuucccacuucuggacccuuccaaaugcugcugccucuaucugaaauacccucuuucaccuggcuaacaccuccucuucccucgggucucugcuggaagcuccuugaggcuggaaauggucuaucuugucuccugcaguaucccugggaccuugcaguaccaggcaucugcuggugcauggcucucugcucuugaauccuggcuuggccccagccugggggcucugccuggguguucucagcccugaccccagcaucuccugaucagcaccucggccagccaaauaggcaucagucaugaccugaaccaugaucccuccuuuaccugggccccagaccccuggcuggccagcacuuauuccagcugucccaaaucaggaucugucacuucugccaguggaaacaggaaaagcauugacauggacccauguuaaacaaaaaagaugacaggaguaacaggguuacucauugagacaugcguacugacagcauccuuacauuccccuucaauuaaacuuugucaaaugcauuuggagcggaacagacuuccguauuuaaaaagguauugcaaaaaaagaaggcagggccacagagggggccagaaaccaggcacaggggacucgggcagcuccuccucuccaguccaugcagcuucgggccagcuacccaguguucucccaauuggggcucugacucaugcauuagcaggugaugaaauaaauucaauguuucacauucuggguaauuuuuaaaaguaacagaggccaggcggaguggcucacgccuguaaucccaguaguuugggaggcagaggagggcagaucacuugaggccaggaguuccagaccagccuggccaacauggugaaacccugccucuacuagaaauuaaaaaaaaaaaaaaauuagccaggcguguugguacaugccuguaaucucagcuacucgggaggcugaggcaccagaaucgcuugaacccaggaggcggagguugcagugagcuaagagcacgccacugcacucuaaccugggcgauagaggucucaaaaaaaaaaaaaaacaaagggaaguaacagaaaauaucagagugccauggacauguucagaaaacuuuuguuucaacugauacauauguucugggucacaagggaaaaugcauugcuuccuaugggcuaagauuaaacguuuuggaaaaugcugaguuaggcuaacccuuaucuucuauucauuuuuccuuccuauaucaaagaauucuccauguuaguuuugcccuguaaguugcuccuggguuuauguauagucacuagaacucuagauauggagaugcugcuuuauaaaccagaauaggccagccagccagggucagagaccucucacucagauaauacaaaccgcgggaucagcuuggcaaguaggugacugguuugggggaaaucuuaagacuccacaccccuggccaggucuguggcuccuccuccacuucuaaauugagugugccaagcuacagggcucgugggcugcacccacauccgugccgcuuaaagggaccugggccacacccggcuggcacaaggggugcauggccugggcccuucagaagcaagugucgcugucuugggaacaucauguaaccucaucugucacuuuccguucgcauucucuucucccagcacgggccccugggccgaccuugaagaagcagccagcccugagaaccugggucggagaggugggguccugcaugcugggagcgagacgcgggcacacugggcucuggcaggcaggaggggcgggagccgcagagccaagggauuccggguuccagacccggcucggccgccucgugcaaaucgcugcucuuacccgaaagucgugggcaguguccuucaccggcugcacgcggugccccuggugucgggggucggccuggcaggagcagcacagcagcuccuuguccucgaggcagaagaggcugagcuguccgcggugcaggcggcagacacgcgagaagcgguagcugguccagcgcgcgcccucggccuccucgcgcagcagcuucuccaccagguuguugagggugugguuggugcgcaggucggcgggugacgcgcggucuuugcacacugggcaggugggcgacaccugcaccucccagcagcggcucacgcacccgcggcagaaguuguggccgcagcgcagagugacugcgucgcggaaggggucguagcagacggcgcagagcaacuccuccuugaaggagcgggaaggcccgggggacacgucgggacuccgcuccauggcacgagcagccggcucgggcgcccggaacuuuugcuccggccccucccacccgcccggcugccaacgcccgcgacccgagugcugggaaucgcccagucccuuccccuggaacgcugagagacagcggcgcuggccaaucgugcgggggggauggcgagggggagg

SEQ ID NO: 17632 - RNA, 81306 nt, Homo sapiens
cuuuuauugcuguaguuuauuuccacccccuucccuccuguuucucucucuccuucucucucucucucucucucucucuuuuuuuuccgcccuagcuggggcuguguuggaggagaggaagaaagagagacagaggauugcauucauccguuacguucuugaaauuuccuaauagcaagaccagcgaagcgguugcacccuuuucaaucuugcaaaggaaaaaaacaaaacaaaacaaaaaaaacccaaguccccuucccggcaguuuuugccuuaaagcugcccucuugaaauuaauuuuuucccaggagagagaugucuuaucaggggaagaaaaauauuccacgcaucacggugaguuugguacuugggaaaucugcggucggccagccaccuuuuguagcacagaaggucuaaggaauuuuuaaaaaggaggggaaaggagagggaccgaacuuuuuuuuuccuuucuguugcuaacggaggcgauggugauggugguggugguugugggagaugcagugauccaggauuagaagucgcaucguuugcaaggcauuaaacaggagcgcgagugcacgaagguagccuuagguaacgcgccagacccggucuaucuuuuauugucagugagagaugcugcagcgucggcccgcggggugcaagcaaauggaugccagauugaauaugcaugccuggagcucggauauuguucucugggcugcgugcugcgaggcuggacuccuccagcagcgauggggagauggggacuuggauccuccccgggucuuccgcccccacccaaaaagggcuuucuggagccuucuccggguccuuggaaaaaggagcggguuugagcccuaaggcguaaugacagcagagggaugcugaaaagggcaggguguaccggaaugguguggaaacgggaaggaaaaacagggacgaggugaugagcagaggaggaaggcggggggcaaggcgggggcuucuuguuggccaggaaccgguuuugggugccccccccccgguuuucucgcccuguaguucggggcuggggcccuggcggggauucgggcucuuuuucacgucucuuuuccgccccuucugccgcucaggaggcguccguguuggugcauacaaagcggacugcagggugggcgcggggaccgcggcgagcggccgggcgcuaauggcgcugcgcgacgcgggagcagauggcccggccccggccagacaaugaucgcggcggccggagggcucggcgcagugcuggggccuggacuuguugguuugcaaaccacggggaaaacgucugugccgugaauuagcgaugccucagagaucagcaccagucuugcucccaccucuccccugcucccucccucuccccaucuuuuccuggaaaaauucguucguccuauucuuuccauccccagugaaaucccagggaggggggaacaccagggaaauucauuguuauauaaggaugugcaauugcaaccggccagcugauucccggguagaaccuaggacugaggcagagaucgaaagagccuuuuaaagcagucaggauguguuuuuagggcuggauauaaggacgcucuuugguucugguuuucccuuuagccaugggcaccccggcuuccucuccgugcacaagggcacacccauccgcgggagagagaaggggagcaaaugcauaggggagggggcgugugcucggaggauuuucuaggaugaucugaagaagggcgcuagcuucuucuugaaggcaaaagacccaagaucccaaagggccgggcacggggcacccacccuuguguguucacugugcaggaggaaggaguggugacucuggggagggaggauggaaagcagauuugcagcaagccucaaauaauuugcugucuucgugaaugaacaaggcagcuucauuuugacaguguggggagaaaaaaaaauuaaaagcaaacgaucaacaagacuuuuuuuuuuuuuuuuuuuuuuaaagagcgcccccccccccacacccuuuaaaaaaucugguugcauuaucauaggaccuauagcaugguauuccucccucccucaccacuggcagccucuuauguaagagccuucuggaaggcacuagagugaacgggggugugguguuucacuuuuuuucauggcaucauguuggcucgggauauucgcggugauggcuggggcagguaccacagugacuguggaggcaggaggugaagggggaggccucuccuugccuuccaggugauauuuauuccauggaagcuuagagaucugggagagaaguggaggucauuguagacagaggacaagugcacugauuugagugaccugggcaaguggccuaaccucucugagccucaguuuccuuaugugucaugggaauagaaccuggccucaucuaccucacagauuucuuucgaggcucugaugucaugaugugcacggcuuuguaaaggucuuuacacuuaccuuauacaggugcaggaauuauuguuggcuauucuccuuugacuuuccaaagucuacgugaggaucagggacccugcaguguacaaaauuaaaaugaucuuauugguuuucaguauguuagagagacaauaaauacuuucugaaccaagguguguguauuuauguguaaaauuaucuuuuuuccuugcucucuaguagcuuaucucuuuuuuaaagauuuucuaugauuuccuuuucuugguagcugcuaaagagagguagcacuugcugagaauauuguuuuguaacugaauuuugaguuaacuauugccaaaagaaugucauucuuugaaauguguugcauauuaaaagggcaauguaugguucagcuugccagguuuaagcccauucuguauaauacaggugcauauuuacugaacacucgaugccagcauuccuuccaucagcagcauuugcaauaacgaugagucauaauguagcauuucugucacauucucagacuuuaucugcugcuuguccuuuauuuuuuagcauaaauaucaccgguuaaaauauaagugcaucagcaaucuguagugcauugcaucuuagaauuugcuaucucagauacuuauucgugggaguuuaccuuuuucuuaacagccuaguuaaaauggcaucaauggcguauuuuuuguagucuuuuugcuauacuugcugugauuuaccucaaagauaaaugcaaauauaaaggacauauugaauggaaaccuugcuaugguugaacccaguguauuugugugguauaucccgugacagcagacuuuuuggucaauugugcuugcuugacacagucuuuccaagacauggcuuuccuauauguaggugguuuuuuuuguuguuguuuguuuguuuuuaaauugagguuuagccaaaagccauuuuaaaaaguacuaucuucuuuuuuuuuuuuugaguuggagucuugcuguguaacccaggcuggggugcagugacgugaucucgguucacuacaaccuccgccugcugcuucaagcaauucuccugccucagccucccgaguagcugggauuacaggcgcccaccaccaugcccagcccauuuuuuguauuuuuuauagagaugggguuucaccauguuggccaggcuggucucaaacuccugaccucaggugauccgcccaucuuggccucccaaagugcugggauuacaggcaugagccaccgugcccggcccuaucuucuuuauaugaaauaauuuucacugcuuuuuuuuuuucuuuggaguccaaggucuaauugaaagagaugguucguuuaucuaggauaagcugucccuguguguucugacucaucaggugaugaauagguugccacauacaggcuuaccuuugucacugaaccuuuccaaaaugggcuuauuuugaacaucacuuuugaacagugaaaauguauccuuagcucacauaucuuagcaccuguuucucauaggucaguuacgcguugugaccuuacugccucuuuguuucagagcgaucgucuucugaucaaaggagguaaaauuguuaaugaugaccagucguucuaugcagacauauacauggaagauggguugaucaaguaaguguaacucaugauauacagauguauuugaacacuuuccagacuucccaaguauuagauaccauucgcauccaaaguaucaaacuucaggaacaucagagagugaccaacuuaguaucuguuuuaaacugguuuugauuggugguaauuagugaauuugaaaacucaaauuuagggaauucaaagcaacaauuaauguacacccguugcauuagguauuauguaauuuacuauuuuuaacugaggugauaugauaucuuucuguugccagcucaaauacuugguuugugauauguugaauauauuaaaguuuugccuagaaugucauuguuuggguuggauugcccaaaggacgcaaacgugaaagacagucuccucuauugagacagcacaucugcuuucuucaucaagaauccaaguuggaggggccaaagaaagauaccaaguuaauuacuaaguaauacagacaaauuacugccuaaauccugagggaauuuuagguuuuauucuaaguggcaacuagugcaaauaagacugcccuuguguuuauuguguuaauguuacaaaggagaagcaacagggcaguuccugaguuuggguauuuuuggacgccagaggguuaaggaagcugaguucaucccaguaucugccugcccuuucuacugggguagcucccggggcucuggagaaauagcacaucuguuugaagacaaacacugcagccagugacagcuuuuaaauaagcagcauucaucaagggauagcuguaaaccgguccagaggaguggaaaacuggaguggcugugacuguugccugggagcucacacccagauuuaugaaccuaaaauagauuuuaacauuuccacguuuaauguuuucuccauguguguuugcugugacagucucagcuccaggcucucaaaugccaugacuuugauguuccauuuucccccaauuauaagauggcacgaucuggucugguagaaugacacuggcccagaagugugcaggccugugugcuguuuuuacucaucacugauuuguucuagaacuuuaucaacuucuccuagauuaauauuccuuuuaaaaaauugguagaaagauauaaaaauauuuuuuaaaaguuggaaaugaaucaugucucccaacauaaugaauauucauuuuucugccuuuuaaaauuauauuucagcuguuagcuuuuucauuaucugaauaacuaaacacacgcuuccaaaauuuuaaaucauugcaaucauaguguucacuuuuuuuuuuuuuuugcuuugauuuguucuaccucacccuuccaccccuauuuuccuucuggugaaaaggauaugauaaaaauaaauguuuggaaaguacggccaggucuggagaaaauugcuauaggauaauuagcucaauugcaagugcuguaaagaaaguuuaaugacaguucuuagaaauaucuuggggccuuguuaucauuugaucuuaggggguuucuugggaacaaaacgucuuugaguggggccucuggugccuuauuuaacuuuugcuuucuaguauacucugcauugccucuugcugggggguaggaguauauaguguuuuauuaugaaucguaacaaugaucugaaaagcccacggcacagagcggaggauaguuuauagguuagugaaaguagcugucagaucccauuugaguccacauuucauuuacaacccuuaucaccaacccuguuuauuuaggcaaauaggagaaaaucugauugugccaggaggagugaagaccaucgaggcccacucccggauggugauccccggaggaauugacguccacacucguuuccagaugccugaucagggaaugacgucugcugaugauuucuuccaaggaaccaaggcggcccuggcugggggaaccacuaugaucaguaagaagcuuaaaaaucaucauuguagugcuuaggaagugugagaguuugcaaauaagucuauuguuugauucucuccuucuaaaacuugcuguccugagccacaguucaaucuaccaaauaagggggugaggauguguuaaccauuugucuuauuuauuuaugcucauuuucugucaaauuuuaaguucucccauugaacuagagaauaugguucuaaggaguuugguaagaugaaugacuucuugcuuucucuccauguggacuuuugucuuccuugacccuagaaugugauuugguuuugaaaacacggcauuugaagucaucuucaaugccaccaacuuuaagccauugagcauaaguauuugauugagauuuucagaaaaauuccuaagagugcuucuuuuuagaaugaggaugggcugcaacaaaugaaaugcugaagcaggaacuccuguuccucugauaugaaaaucaaauggagacgauacucucuaggcugaguuuaacauaaaaggaauugggcagcccugucuggagggggacccacagguaauugucuuuuagauaugaaaauugcugacacccacagcugggugccccuuacguauugcuccaagggcuuugugcuuuuuuuuuuuuuuuuuuuuuuugagacagaguuucucucuuguugcccaggcuggagugcaauggugcaaucugggcucacugcaaccucugccuccccgguucaagugauucuccuggcucagccacccgaguagccgggacuacaggcaugcacccccacgcuuggcuaauuuuguauuuuuaguagagacgggggucuuccauguuagucaggcuggucucgaacuccccaccucaggugaucugccugccucggccucccaaagugcugggauuacaggcaugagccaccgugccuggccgcuuugugcuuuuuguuuaacuaaaucugaacuguauucacagcacugugacacagcacacauaauauuaagaguuugcuugugaacugcuagauuccagcaugcccacugauuguccuuuugaaaaaugucauuuuguuuuugaggaggugggcaagcugcauaguggcccgucagauacauauuuuaaaaaacagauugcauccaagagugacagucaacguggagucugucauauaugaaaagauagcaguucaguucagaagagggucuaaguagaaagaacuuagcuguuucugcuauagaaaaaccuuucuuacugguuauuuuuccgagugguggucuuuuugcuuguggcuuuggggucuaucuggaagcuucuuuucuaucuugccugagcuagaggaauguugcccugccauccccuccuagucugaguugccccgcauuuuaaaucacaacucauccucuggcguucucucuguccuggcccucagggucugaagcaucaggaacagcucucuccuguuucagcuuucuuggcaccacugagaaaagccuccaaguguaagccuugcgacuugugucuugcuguacauguugcccuuuaaccuagugggugccauuuuccagggaugucggggggagauuucaugcacaccuagggagagcagagccugcaccuugucauuugcuggggaaucacuggcaccugugggcguuucugccucuccuccagggcggacuguggagaaacacuugaacuuggagaagcuuagacuauucgggugucagccgggaaggccaagucagggugaucaucugccucaguuuggaguucacagggagacccugcaggccccuggauuggucacagacagucaauaagccauuaaaaacaauauuucucuggcugggcaccaugguucaugccuguaauuccagcacuuugggagccugagguggguggaucacuugaggucaggaauuugagacuagccuggccaauauggcgaaucuacuacaaauacaaaaauuagcuaggcaugguggcaugcuccuggagucccagcuacuugggaggcugaggcaggagaaucuuugaaccugggaggcggagguugcagggagcugagauugcaccacugcacucuauccugagcaauagagugagacuccgucucaaaaaaaaacaaacaaaaaaauucucgagugaauggucagugucaucuaucauuggagagggaaaugcccccagccaggaguuaggagucuggagugcuggcccccuucugacacugacuugccgugugaccuugagucacuacccuacucuguguucuagcugugugucuccagugagggauuugugcuacaugacccuggaaguccuuuccagcccccuacauuuggccauucacugaaacucauucacugaaacucagagagauuuugccucucaucaaguacauguugcucagcagauacagaaagucccuguuuucucucacacuugcuggaaagaaucccucagcccaccaucuccuguccugcauuccugggucugccucuucccuccacacgcucgccccgugcuuaggcccccacucuuguucuuguuuuugacucuuuccugccuucccuuccccaccacaggagcaucaccuucuugccaccaccccgaauuucucuuucgucuucccccucagaggcuguggccuuuuuuccauucauccagauggguuccuucuguuuagggacgagggacaucccccucugagugcagcaccuggcccagggagcucagaagagucagcagauggccuuaugggcaggugguccggaaaggggagugaggagucugaccgccugcucugcuuccuuggccagaaugcuauggcauuugcacggaggcugugugaugcgaucuggcuauagaguggggcauccaaugagcgaaccucaaggaauaaaagucaucagagggggcaguguaugguuagcauugugacccccaaaugccauugcuuuuauagccugagaaaaguacuaacuacuuuugcaaauaaccaccuauguuuacugaccucuguagaauuucuacuagccugccuuuccccgggggagggaaugguaauaauacaggugaggaacugaggaauuuuuauccuuuuucuguuugcugaccagacguucugcauugcuuuaagugagugaguggcugggauuugcuuuacagagaaggaggccuugcaaagagaaauagcuuaaugccacuucauuggcaccuaagaccugcuacuuucuuugacuuaauauauugaguccagaaagaaaugccuggggcacuuugaaaacuucacaggcccacugcugcuugcugaaauaaaaaauugaagugaauugguacaaaaaucucccucuuccucccaacuccccgccaccccgccccugggcacuccacccuccuggcuuucuggccuucuccagaccaugucaccaugucaccugcccucacggguaaauccucgccugccucccugcuggcucugcguuucccaggucacaggcccuggagacuccuuucugucugaaauggcgccgcauguagaggaaaacacagccaaauauucucgguuuaaaaaaggagauggcaugucagcagcagaagauaauauuauugccauuaaacagagccugcuauugagaaucacacaaugagaucuuuaugaggcggacucaguguggagcagggggaacgcccuuugcccuuuccacccaguggugggugggcagagacugcagacauacccugcaggcggcauccagaccggcugagggguugcgggggcggccgcauugcugcuuggggaaaacccuacggacuucccagggccuucauggucauuugaguucaggaucucagaguuucuaggaagcagcugggaacaguuaccucuauuuuauagaggggaagacugaggccggaaggacagacacgacuugccaacacuuacccugugcgucggugcagguggccagguguggaacauacaccuguagcucuggccucaccgcuugcccuggggccaccuuugcucucagccucaguggccucaucugcaaaauggggcaaguuuugacaaagguggacugugguggcaucacaacagcaucugcccaguagugagcacucccaugugguagcuauugucauuccauccuugcuggguacugacacccucccaucucuuguacacugagcucuacucucccccgcauggccggagaaacaggcugagcugccguagggcuugaccugaguauucacugagagcaggcgcugucuaggcguggcuggcggacugugugcuuuguguguugcuucugggggcggcaucuugaaacauuacacuuccugggucccaccuuaccugguuaaaguagcaaaucugcugguggggucugugacucuguauucgaaucuggugcuuggggagcuuuuugaaagcaugacuuucaggggugcaugccggaucugcacacucuggaucuccagggcuugggaaccacugcucugaaugucauuucugcucaccugaacuccaggcucucucuagaggaggugcacccucaggcacaacauacccagcaggcuuccuggucccuggguagcaccgcacagcagagauggggacuggacucuagcagggaggaggaggggaggugcugcugccgcagggcuggaaggggcccucccuccugaguaccagccuugucacuucuccccuggcuguggcucccuggaugugcaucaggcaccuccauccaacuguccccaguuggacucccugucugcuccuugcugcuuuuccggugcccaguccuggagagggcucgcuggagguugugcuggcgguaucugcagagucauccuagcaucuucauguccucgugcugccuugaguugcuuucaucucuguguuaccucuugcacucauucccuuacccacacagauuugacuuuugucaccucuuccuggauuuuggcccuguccucugaggagucuuacugucugucccccaccuccugccucucgccaggcuguuuuucuggugcagcuuucauugugccgccuucuuccucugaagccuucagugacucccucuugcucagagaaucagcccaagugucagaacccuccacgacgcggccuauuccugcugccccagcccagacuugcauugucaucucagccagggaugcccucccuuucuuucccugcuucuagaagcuucaucacccuugguggcccagccugggugcuucccauucacugaucuccugugaucuguggcugcuguguggccucuucgcaaacguugggcuuuuaucccacagcccagguggcauucagccuugcgugugguucaaucaaggccccucugucucuuacauuuuccuauuuccugccgccugggcagccucacuccucagaggcacucuguuaaugcccaugggugaaugaaugagugagugaaugaaugaaugacugaauacacugacgauacuugauauccugcuuccucugagugaugccaagagacuuagugucacaaggagggaggaggguuuagguauccgacguggacuguguucacccugauggaagcugucgcuugcucagcaguggcucccucugcagccccagcucccugagucccuguggucagaucuggucauggugggggaggguggcagaaagaggaagccgagagcccaggcauggccugugguuguggaugggacagcucccucugucugggcuguucuucagaagagggugggaacagcagcucucucauugguccucuugcgagaaagccugcucuccaaguacagagggucacaacauggagaaaucacauggucccagcaccacaguggacccagcagucauucccccagugccuugggcuugucccggcucuuccuacugagccuccccauggaggcaggagggcugggaggaaggugagguggcuuccugaagggacguggcuccugaaugucacugcgguacauccacggcuugucauuuguucauccauguggcauguggguugcucccuccuuauggcgaguacacacgugugaacgcaugcacacacuguaauauggaugugucuguaauugauacuuugauuauucccuuugcagcacucauuugacucggguuagaaaguguuuacaaaaacgcccgaccacaucagacccaaguuucaaaguccaggaccaaaguuguugccacaaaaucugccuguggccuggcgauuagaaagccacguuauccaaugggccauuggugugggcugguucucugugcuccuccccuuguccccucagucuccacaugguugaggucacacauuucuccuaaggacacgggugcccucugcaagcagaugccgggagccuggguccacucaggugucacugcgugaaucucggccuugaacggcuggacuggaagaauccauccacccucaggugucacugcgugaaucucggccuugaacggcuggacuggaagaauccauccacccucaggugucacugcgugaaucucggccuugaacggcuggacuggaagaauccauccacccucaggugucacugcgugaaucucggccuugaacggcuggacuggaagaauccauccacccucaggugucacugcgugaaucucggccuugaacggcuggacuggaagaauccauccacccccuuggcauaguuugggccgaucuaaugccuggcacugagcagagcggagggaucuccuaaugccuggugcgguacaggggaaggauggcggagcauccucagagacagcacagcucuucccaaagguccagcacgcacacuuuaccgaaugcuuuucuugugaagggagucauuggguugggcuagccagguaggcuggguaggccuguggggguuaggaacuucuaggcccuuccagaagcaagggcauccccaagugggugucuagacucuguuucguggacauuguggcaguuaucauacugucccaggguuucuugcccccaccuggcccugggagcuggcaguuacagugcuggaaaugagccugacucacugggguggugaucuuccaccccuucaggugcccucaucccaguuccuacucugccuauggguguuuuacauggagagucacagcacuggggguuucccagagccuagacucugacuugcccuaaagcugggucacacagacuauugggaacuuccugucgauccugcuggccugauugacagcuggaaccgggaguggagguggggcccaugggaaugcuaggcuccagcaaguucugccugaccuuuggaugugagggucaggcauucaguggucgggucucaggguuccuuauugcuagaugaaagcuuccacgacacacaugugucuaagugugcccuuguccuauguccuggcugagugaguugggcagagacuucugaggacagcgaucguggccucuccauuuuccuaaggccccugcaugccuggagcuggcugugggggcagccagagaagcugcccaaugagucugaugggagccagacccguuacuccuucuacucaugauagcuuuagcauuguugucccggggcaacccuuucucaugugaaaccuugcguggaacccccuccaccugagauaugagacugaugaaugcagaacugcucugguuggaaugguggguggcaggugggcugugggggaguccagauccucuccgcuuucucuuugucauccccccauggcagccccucugccucuggagaaucccagagcuuggggaagcacaggauggaaaccaacccauccuggcacugccucccccucugcccaccuccccugcaaagcuugcaaugcgauugguccugguguagccuccguguugaguuguaggggaaaggguguuuaguaagcaggcauauacccacggagucgcuuaagaaaacaccuaaccacacuguaaguuuuuaguaguuucguuuaauaucccucucucuguucaagacaggaaccaggguagagcaccuguuucauuuucccugccuagguuuggguugguuuucuuagcuuuuuaugacagcccauaauaggugagcauucugcccuuuuuaaaaaaauuaauggugcagagaguuuuauuuauuuauuuuuuagaaacggugucucacucuaucacccaggcuguagugcaguguugcgaucauagcucacugcggcuuugaacuucuagguugaaacaauccucuugucccaguaguugggacuguaggugugcaccacuacacccggcuaauuuuuuacuuguuaguagagauggggucuugcuauguugcccaggcuggucaugaacucuuggccuccguugauccuccugccuuggccucccaaagugcugggauuacaggcgugagccacugugccuguuugguacauuaguuuuuuuuuuuuuguuuuuuuuuuuuuauuaagacggaguuuugcucuuguugcccaggcuagagugcaauggcgcagucuuggcucacugcaaccuccaccucccagguacaagccauucuccugucucagccucucaaguagcuuggauuacaggcaugcaccaacaugcccagcuaauuuuuuuuguauuuaguagagaugggguuucaccauguuagucaggcuggucacgaacuccugaccucaggugauccacccgccucggccucccaaagugcugggauuacaggcaugucccacugugcccggccgguacauuaguuuuaaagggaagauugacuguggguggccaagggauuuguguuuucugacuuaaccauccauggcucugaccccaagucacccauuaagggcuguuucucccuuuuuuuuuccucuuccuccccaagcugaccuuucucucuucuuaagaagugauuacugauuucuuuagguuuugaggguucugucuuugacucuccgugauuguugggugaagccauuugcuuaaauuccuugcuuuuagagcgucuuaacugccaugguaaugauaaaggggagugacagugaguagaaauuagaguucuuucugguuaacccauuugggagguagcuuucuuugaauaugacuaaguguucccccuaaugacagagaggauguugcuggggguugggucgcgguggcugaggcugcuguccaguuaagagaauuuugcaaugaacuagggcagugguuuaaaaaccuugacugcacauuagaauccccuggggaguuguaacaaaaugcagagaccagaccuucugacuuaauuguucuaggugggccuggcauuggucguuuugaaagccucaaggugauagcugggauuaagaaucauggaucccagugcuuguucugauaguuggacuucuguugaaaccgaaugaaugucugccaagauuuuccgaaacccagagcugcccucugcucccugcuuuguccuguccucuucacgaagggagugggaucacacuguugcuaucuggccaggguggagucuacagccagaugcuccccagaagcuuaaccauggaggggcugagcuaauugucaccagaaagagccuccuccuucaguugcuguccuugguguucgggaagguuuuacuuggcuaauucccuaaaagggcacugguuaggacuuggaguaaguggugaugagcaagagcagggcuggcuggugggacagggugggugccgggggcagaggggaacuggaauguggacugcuguccccagccuguggccaccugcugugcugguuucccugagaaaacccuacugucuuuagguugaaucuguaguguuuaugaccuaaucacucucuaaugauaggucaggacuggaaucuuuccuuguggggagccugugagacaaaaaucaaaagggccugauaauaacauagaaucauggacucuuaaggcagccauucaccuccuucccagccccgcucccacagcugggcacgguuuauuggaccaggcuucagaggaugggauuguaaguaacucaacaggacaggaugggagcgcuccaagaaucagaucuaaguuuaacuucccuuucuagugcuuucugucugagcgugaucauccuaauguguuucuagauggcuauuuccacauguguaaaguggagacaaucaauucuuaugucuuacgacuauggaaaaagugaguuuuuuugugccauacuauuugaaaguaaucauugugacaccuuuggaacaagugugaaaagaucucccucucucucucucucacaccugucuguauccaucuuuaucuuuuuaucaucuaucucuaucuaucuauuaauauauauuuaucuaucuagcaugaccugggauaggugaauucuauagccagguggccuccagaagcuuacgaaaugaucgucuaccaaaucuaccaucuaucuauuucccuaccuaccuaucauuuaucuaaucuaucuauauauugauauauaucuaucuggucuauaucuaucuugauaugacaucugucuguaccuauggucuaucaucucuauuuaauccaucgucucuauaucuauugauuaucacuuaucuguuuuacuuauccuaaucuaucauuaaucuaucaucuuucuaaucuaucuguauauaucuauuguuuaucuaaucuaucaauugaccauucaucuguucaucuuucauauaccaaagaugcaguugcaugccaccugauuccagauggguuaucucacuucacugucacuuagugagaucaggaagaagucucaaggauuguuucaacuucaagccuauguacaugaguuugcguuuugaacauagcaggaaaaacaacgauguauaagaagcuuucuuauuggcugggcauggugacuuaugccuguaaucccagcacuuugggagauugaggugggaggaucacuugaaggcgccaggaguucaagaccagccugggcagcaaagugaagccuugucucuaccaaaaucaaucaaucaaucaaucaaucaauaacuaaaaauaaaaauaaaaaauuagcugggcguggugacacauaccuguaguccuagcugcuugggaggcugagguaggaggauugcuugagccccagaguuugagggugcagugagcuaugauugugccacugcacuucagucugggagacagugagaccccaucuuaaaaaaaaagguauaauguagcuuauagggcuuauaauccuguaagaagacuucuuaugcaagaaaauaaaaauuuuacuuuucgcuauuuuuuuuuuccuccuccaaauaaucucuggagaauuuggagccugauuuucuugacaacacaucuggcccugcagauguaaagcaguguucccagaaaacagcccgucaaaucaauaacucuugcuaucuuugaauuuucagccuuuuuuggcauucaaaugaggccaacuuuauaaguggccauugcugugcuguugaauucaagccccuccguuuuucaugguggauuccuugcauugucugcuagggggguugcauuccucgcugaaccagaccucugcccucuuccccgcugccuugcaguuugcugagcuuccaggcagggcugcagggucgugcugcuggaaguauuggugacaaauucuuccccaguggguguuucggcuaaggaagcauuuagucauguagggccuaccaugcccagcagugcagcgugggagaggccuggcagagggcagagcucucuucucuccagccggguguggcugguggcuccuuccucuuuuguagugucaaaccaagggauaguauggacccagcagaacugaaagcaaagggaggacccauuauuagccaguucuggcagaggcgagcagcuucuuuguguggacaggcauaucucaugccuuuuugcuucagcugggaguuuguuuuuuuuuuaauuacuguuauuuauuuauuuaguaccuuagcucauuagcugcagaaaucacaggggaugaaaaagcagguaggauggguccauccuuaaagcaaggagagaguugaaugaggaaacugucccugaggccuugacagauauuuuggagcuaacucugagcccagugagggaggaccuaaucuuuuggaggaagugcaacuuuagcuucagaguuuuaaauggaaacugggcagaaagccacagcuugggcacagcauugguggcguguuguugugucacuuugcacaguuagauggggcuucagcccucuuuguaggaugaacguuuagguucuuguccaaacgaauacacuucuauauccuacuaaaaaugauugcaggacagcagugcaaaccagggcuguccuaggcaaacccaggcaucugucacucuaaaggacacaaggacacguguugaguccucuuguccuccagugagcucgggaaggggaugacccuagcaguugcucucuggaccucuccacagaccugccgggagucauggguaggaguugugugauucuguccuuuucacaagagaugguuagaagaaagugaggaguuuggagggagcagauaauugauaucauuuaucgggaaucugugggacgcaagcccugcauacaccauuucuaauccuuccaucaaccccgaagauagauaggcuuauccuccuguuauaaaugaaguaaugagcaguccagagaagugaaaugacuugccugaagccacagagccugcaagugcgagggcugggauuccaauccaagcucugggccaauggcccuugcauauccuagaaugcgagaggaacguuuguuuuguagcaguuagacagccugcucaugaaagcugcuuugugcccagccuugugacaggugcuuuacaacaaucccagacacagcacccaccuugaguuugcccucagguacagggcuccuauccauccuggaagaacagaaagauuuugguguucaaguuuuauccugcccuuccauccaccuguuauuuaaaaguacuuuuucuguaauauauaggcagaaaaugaucagauaucauacgucuccuacuaagugggaggcugcacccagcauggaagaugcucaccaagacggugguauauugggugucucuucucuccuacagaagcccuggguugaugcccuagaucuccccuugcaucccagagggggauuuggagagcaaucaagaggaguaacugaugccaugcauucaucaacugaacuuaauccuucuucugggaggcccgggagccuucuuccaugcggggccagauugagcugauuucugucacguaggcugcuccgagguugccuugcccuugccuggcacucaucuuuugcauuucucugaaucgcuuuggcgugggcuuuuaugagguucauuaggcucagcaccucccaugucugcuugggaaacaccacgggcagauggcauuuuucuuuucuuuucuuuuuuuuuggauacagagucucccuccguugccuaggcuggaaugcaguggcuugaucucagcucacugcaagcuccgccucccagguucacgccauucuccugccucagccucccaaguagcugggacuacaggcgcccgccaccacgcccaacuaauauuuuguauuuuuaguagagaugggguuucacuguuuuagccaggauggucucgaucuccugaccuugugauccacccgccucggccucccaaagugcugggauuacaggcaagagccaccgcaccuggccucuuuuuuuuuuuuuuuuuuuugaggggcagagacaaggaggaagaucagacaauuucucagaguuggaauuguguucuggguauuguuuuucuccuuuauggagauaauccagggagaaacaugaaguguaauggaaagaauuugaggcccaaccuucuugaugaugcaucuucauggagcugggagaccuucgugccagggucgacucugcugcuuauuagcucaggcucggugccccacggcuugguccugguuuucugaaucgucagaugcaccuggaucagcaugucuugcauaauaggguugcuuugaggauccagggaggugguggcuauggcagggcuuggacaaauuacauguaugggggaguagccccuucaccccaguuuugcuccugaccguugaagcuuuuuauauugacccguggcuacugugguauucgaagggcuaaauuuguuuugugacuuuugccuucagcagccaucgcauuacaucaucuaccuuuucuuguguucuucugucgucgagaaucaauuaaaauggucagcauugcuaugaaaugguuuauuuuuuuguggauguuuuagagcuccuccucuccaucuccugaauuucuuuucuugcuaagccuauucagcucuguuuuuuagagaguucuuuucccuccugcucuaugaaaacguauuuuccauguuaaaaaaggaagauccauguugcuguacuuaaugcuucauguuuuagaauguuagugccagcagaaagcaccaggagacacccgaugugcccccaccuuggugagcaccuuuccccccaggcacagucccugcuuacgggagauuugaggcauuugaucauuuuuucccguuagcuuacagcacaaaguacuuugaaauaaagauuggcucgcagggcagguugaagcuucaacaccaaaaucucucuguuccuuguggguggaugggagccugacaccugauuacaagcuccaggugaagagcagguuugagacuuacaccuuguuuauugcaaucuuucuuucauuuugcaggcggugggggugggggaaugaaagcccagaaagggauguggcacucgggcaggacgggggcugcuucugugccuuuuccccacugugcguauucuuagcugcgcaagugucgugcaugugcguuuggcucacacccagcgggagugcccuucuugugaaggaagcucguucucuaccgaaaagcucacuuuucagagaagagcuggagaaggccuguuguccaucuuaguccugaaauaugaguuuucauuccauggcaaguccuuuuaaugaaagauggacuggagaagcugaugcauagaaaagaaauagguucuuuuauguagagggggaaaguguccacucugcgguauuuccuggguccuguggcuuguaggcauuugaacuguuuugucuugguucugagagagucagaugauucagaagcuguguucugcugaacauuccugccuucuugacagaaauccccuauuuuuguggucccccuggcagguaaagguggccccuacugacuuguaggauuucuguccaugauugugucugaaaugucauuuuuucugguuguuuucccucuucauguauuagcuuggcucuuucuucuccucuuugucuuuaagguaauuugcaaaggucacacuauucuugcuucuucuuagaaaugucauaagggauuuucaaagaaagaaaauuucugaguaagaguaucucccuccccuccccuccccucccuccacuccucuccccucuuuuccccuucccacuuccuccuuuccuuucuuucucucgcucucucucuuucucauuuauguuagcuuacaugaguauacugacucuaaaaauuuuugauucuacuacugcacuccagcauggguaauagagcaagacccugucucaaaaaaauaaauaaauaaaaauaaaaaaucuuaaaaaaauuuagauaugauuuguauacccucagauucacucucugaaaguguauaacucagugcuuuuuaguauauucacagaauuguggaagcaucacuaccaucuaauaucagaacauucuuaccaccccaaaaagaaacccuaccaauuaucagcugcuccccauuccccaccucuccccuugcaccccuagcccauggcaaccacuacauuucuauagcguugccuguucuggacauuucauauaaauggaauaauacaauauguggccuuuuauagcuggcuucuuucccuuagcauaauguuuucaagguuuauccaaguuguaauauguaucaauacuucaugacuuuuuauggucgaauaauauuacauuuaugaguagaccacauuuuguuugcccauucaucgauggauggcauuuggguuguguccacuguuuuggcuauugugcaugaauaauguacauuugugggcaagcauuugcgugggcguguguuuucuguucucuuggguauauaccgaggaguggaauuguggggucauguggucauucuauguuuaauuuuuuuuuuggccauguuacuggcaaauauauuuaacuuucugagcaacagucagacuguuucccaaagugguugugcuauuuuacacucccaccagcagugugggagggccccgguuucuucgcauccuugccaacacuugcuauugucugucguuuugauuauagccaugcgaguggguguuaggugcugugucauuguggcuuuaauuuuaggcuuuauuuugaggcccguguacucauucacugaccccuagucacauuuaucuugaccugugaugugagaacuugguuuggguguguuuucccuacucugcacuggcucaucugguguggcaagugcaaagauguuugcagagaugagaaugaguaccugcaaccagggguccccagaaaggcagcccucuuagcucuccccacugaggacccuugagcccucccucuagggcucaccauuuguggcuggcuggaauggcuaccuccauucccuugagccuggcaccgcuccucgagauuugcucugaucucaccgcauggcugagaguaaauccuguuuugcucccuuuugugagccuucuucuuucugcuuccugauggggugggcagauaggugguuccaugcuggggagggaacuuggcagaggcccuguuagccucuuccuccagugucacccuucugacagcacacagccugcgggguccaggcacucucagccaugauauggaccaucuccagggccaguccauuccugccgcugauggagauucccuccugaucuccagagggcagaggaaucagaauaguuuccuucuacauuuguaguuugcaggaaccauugcucacagcugcucccuccuuggaugcuauacccucacucuguaagauagggugggaaaugucgccuacuuuacccaugagagcaucgcagaagggagaggcugagggacuuacccaacuaguaugaggcugaaugaggacucagaugauggucaucuggcuccggggccagcacuuaauccugcuggguauguuccugggcccucucuuuuuuuguuuuuguuuuuguuuuuuuuuguuuugagacagagucucgcucugucccccaggcuggagugcgguggcgccaucucagcucacugcaagcuccgccuccuggguucacgccauucuccugccucagccucccaaguagcugggacuacaggugcccgccaacaugcccggcuaauuuuuuguauuuuuaguagagaugggguuucaccguuuuagccaggauggucuccaucuccugaccuugugauccgcccgucuuggccucccaaagugcugggauuauaggcgugagccacagcgccugggcccucucuuauaggaacuucaggugcuaauguugcaggauuuaggaggacgagagagaccuuggguugaaacaggagaauuuuuacugaguguacucaggcccagcugacuuacguuuaaaagacugggccuggaacaaagacaguacuugacauuuauauauauuuuauaaaagggggugggcuagcuugaaauaagcucauaguggugcgaaagcagggauauugaggcaggacaaagacaggauuguauaugacuguugccaagcaaccuagauguuuguuauuuagguuugccugggcaaaggcuuauuuuauaaccuuuauuauggugcccaggcagcuguaguuuaggcuuauuuaggcuuuuuaugacuuuuguuguauuuuuuagauaaaacagaauacuugaaguuacuaguuauagagaacaggaauuuauaaauuuuauaaaacaaaggaaauuuuuuuuuuuuuuuuuuuuuauguugagggagugcugcgagaguuuuuaggagcguauuagauaauauuauuaagacuuuuuugggucugggccaugccuuugcugccuuugggacaaguuagcuuaauacaggaaaacuuauuuuuuuuuaauuuuauauaaaaauucuccuguuucaacccgagaucucucucguccuccuaaaucccgcaacacuaagugugguucccuuaagugcacuggauucaaggugacuuuguccuugcuuuuggauguuuuggauguaacagcgaugagauggccccucccagagcugagaauggagaguauuaugcuagacaccugaggcugcagugaugugggcugauggaggggugucaaggagaaagcauguggucaccuucauggcaccaucacagccuuugguuuguuuaaacaaagugaauuaguguugugguuucugcugcuaagaaaacccuguucguuuauucauucaccuauucauuccuucauccguucauuuauucauuuauucauccauucauccauucagcugacauuuauuggccaucuggcaggugcugaucugggcauuagaaguacagauaagguccucuuugcaaaaaacuucuugucuauugggaagaccuacaaagaaaagaugaaaaugaaaugugaagauugcuguacuaagguuccaguggaacagagaagagaaaucuuuaaaaucugccugggagagccaagagaggcuucagccaauagguccuaugugagcugacccuugaaagccggcucaaauuuuacccugggguggauuucacccauggggugggcaggagaagggaguguccacccaagagagagaugugugcagaagaauuugguagaugagucugguguauuuuagaauuuagacuccggauuugaccauaggauguuugaguucuaucuucauggcuugcuagcugggcaagugacuuuucauuucucggagccacaguuuucuuucuucuuuauuuauuuguuuuuauuuuuauuauuuuuuuugagacagggucucgcucuaucucccaggcuggagugcaguggcccgaucuuggcucacuacaaccuccaccucccggguucaagcgauucuccugccucagccuucugaguagcugagacuacagguguccaccaccacacccggcuaauuuuuguauuuuuaguagagacgggguuucaccauauuggccaggcuggucucgaacuccugaccuugugaucugccugccuuggccucccagagugcugggauuacaggcgugagccaccgcgcccggcucuuucuucuuuauuuuauagugguagcauacauaacacaaauuuuaccacucgaacuauuauuaagugggcaguucaguggcauuguguauucgcauuguuguacagucaucaccgugguccacuuccagaacuuuaucaucaucccuaacugaucaucaucccuaaacuguugccauuaaacacuaacuccccauucccaccuuucucuagccccugguggccccuauucuauuauaguuguuucuauggauuugacuguucuaggaaccucauguaaauauauaugcuuaugacauugcagaauggccccaaguucaccuaugugauagccugugucagaauuuccuuuuuuuuauggauaauauuucaucguauauauagaccauauucuguuuauccauucauccauugauugauagauacaugggcugcuuccaccuuuuggcuauuguaaauaaugcugcuaugaacaugagugugcaaauaucuauucaagucccugccuucaacucuugggugugugcccguaaauggaauugccgcaucauacgguaauucugcaccacaguuuucugauuugucauauaauuucaggguuacugugcagcuuaaauuugauugaagguacaaaguacugagcauugccuggcacauaaucaguauuaagucccauccugaagggccccuucuagccucuccugaaaagugaacccuuuaaagcaaaaggacuuuuaacuauuuggaugaaaaaauaccucuucaaauguaguuuaugguucuuaaauggagguccuuuuuggcacuuuuguggaguuugggugaggagucagauggccacauuugcauagugaggugugauuggguccuggaaugucaugccagggagcaggugaaagccaaugaguauucugccagguccaaaggcccaguggccaguuuccaucuggaugggccuggaaggcuuccuggaggaggggguaguggccccagcuggggaaagaggagguaaaggaaugggugagaaccugccugccucaucuugagagaggcugaggaagcacagagcugggaagguagccacuggucuccauggccacuaugcuuugaacauaccuuugcugcagggccgaugaaaaguuggacguuagcuaucuucaucucaaccuacucccugucaagucuugcuuuuuuuuuuuuugagacaagagucuugcucugucacguaggcuggagugcauuggugcuaucucggcucacugcaaccuccaccucuccuccuccgggguucaagugauucuccugccucagccucccaaguagcugggauugcaggcacaugccaccacaccuggcuaauuuuugcauuuuuuuuuaguagagacgggguuucaccauguuggccaggcuggucuccugaccucaaguuauucacccaccucggccucccaaagugcugggauuacaggcuugagccacugugccuggccacgucuugcauuuaccaugggaaauuguuagcguggucaucauuuggucugcuuuaguagagaguaucuuuuauguuucucaaaggcguuauguucugcauuguaaaugugcggaaaucagucacccagucaccugaacuuccauuuaacaucaggucccuggccaugggacuugggcaggagcaccagggcuggcccaucaaguaccucaauauauugcucccugaugagggaggggccagaauacauguuaucacuacuguuuaacaugguuccggauauguuagccaguguaauaagauacgaaaaauaagaaguaauaauaauggggagaaaauauaagauuauuacuauuuuuuuuuauugcccaggcuggagugcaguggugugaacucggcucacugcaaccuccagcucccggguucaagugauucucuugccucagccucucaaguagaguagccaggauuacaugcacccacuaccacacccagcuaauuuuuauauuuuuaguagagaugggauuucaccauguuggccaggcuggucuugaaauccugaccucaagugccugccucagccucccuaagugauuauuacuauuuuuagaugguuuacuuuagccauucaaaggaauuaaaugaagaaauauuugaucuaagaagaaaguuuaugaagaugacugacuuaaaaauaauguauuaaaaauuaauagcuucccuguaugucauaaauaaccaaucagaaaacauaauuuaaaaaauccauacacaauagcaacauaaaauauaaaauuacuaggaauuauaagaauacauucuuauauauggaauccaagaagagucuuaaauaaauuaaaagaaaugcuauguuagugaacagaaaaacccaauacuguaaagaaguguauacuuuagauuaauuuuaaaauugaaaaccucaaaaggugguugaguuuuuguuuuguuuuccauuugaccaaaugauucuuaaguacaggugaaagauuaaacaggugauaagaaccaaaaaauauucaaaaaggucauaaugaauaaggcugggagaccacuacuggcuagauauuaaaacaaacuguaaaaauauaauaauuaaagcugugugguacuagcuccagaagagacagcuauauaagcagguuaaaguagaaaaucugcaaaugugacuaacuguaucuagguauuuaguauauaaaaaaggcuacauuucacacucaugguaaaauuguaaaauauucauaguauuauauuagaaguuaacuauuuugaaaaccaaaguaaacaucuuaccuuaguucguauaccaaaauauaucccagauggauuaaagaauuacauuuaaacaguaaagucagaagagaccagaagaaaauacagaugaaaagccauauaauuuagauauuucagcaaaggcagaaaucagaaaagauggagaugcuugacuacauaguaauuaaaaacauuacuaacaguuuaauaauaaaaggauaacgaaguaggacauucgacuugcaauauaugauaaaggguugaugcauuuaaaauaugaaauuuuaacauuuuaauaaaaaaagcaugcuuuaauagaaaagguaaaugguaugagcaagguauucacaaaaaggaaauaauuccaccauugaacuauaaaaaauauucaacugaaugaguaauaaaagaaauacaaauugaaguuucacugagcuaaguuuuuaucuacuaaacuuucaaauauuaaaagggguuaaguaagcugaaaaaaaugaaacuauguuggaggauucacuuuuaucuguuuuauuuaauuucuuuuauauaaauaauacuucaggcaaauaugauaaacuuaauaaaugucaauucugaggggggaagaauaaaggaguuaaauaaguagaaguuguaauacccaguguuggcuagguugugguuaaaugaacacucaaacugcggauagguauuuacauuggcauggcccuuucuggaggguaauaagacagacaguaucuaacaagagcuguaaaaauguguaaacaaaaaaauucauacgccuugaccuagaguaaucuauauguaaacauuuagcucuaaggauguucauuguagcauuauuuauaaugaggaaaacaggaaaugagcugaaugaugaaaauuggugacugguauaguaaauuaaggccaucccuagaaaauaguaguauauagucauuaaaauuuauuuugggggccggguggugccucacgccuguuaucccagcacuuugggaggcugaggugggugaauugccugacaucaggaguucgagaccagccuggccaauauggugaaaccccaucucuacuaaaaauacaaaaauuaaccgggcaugguugcacgccuguaguuccagcuacuugggaggcugaggcaggagaaucacuugaaccugagagguggagguuacagugagcugagauugcgccacugcacuguagccugggcaacagagugagacucugucucaaaaaaaaaaaaaaaaucauuguggggcugggcgugauggcucacaccuguuaucccagcacuuugggaggcugagauggaaggauugcuugagcccagaaauucaagaccagccugggaagcguagggagacccugucucuacaaaaaauuugaaaauuaccuggacaugguuuugugugccuguagucccagcuacuuaggaggcugaggugggaggauugcuugagccuggcagguugaggcugcagugagcuaugauccugccacgaacuucacaaagcaagacccugugucaaaaagaaaaaaaaaaaucggcugggugugguggcuaaugccuguaauccccacacuuugggaggcugaggugggcggaucacaaggucaggagaucgagaccauccuggcuaacacggugaaacccugucccuacuaaaaacaaaaaauuagccgggcauaguggcacgcaccuguaguccuagcuacucaagaggcugaggcaggagaaucgcuugaaccugggaggcggagguugcagugagccuagaucacgccacugcacuccaaccugggugacagagcaagacuccaucucaaaaaaaaaaaaaaaaaaauuguggaaaauauuuauuaauaugaccauguucacaguauauugauggaaauaagcagaccaugauuucauuaugucugauuugauacuuuuuuaaaaaacagcuuuuugaaacauaaaaacauuaugaugcuacuuuuguaaaaaguguauauguguauaauaaguagauaggaaaaagauugucuagacauacaucaacauaguaauagugacuuuuuuuggaugauuggaugagucauggaagauuuuauuuuuuuucuccauucuuucugguguuccaggguuuuggcauugaaguacuuuuguacuuagaggaguuuuauaaaaaacaaaaguucccuuugagggauacuuugcaucuggacuguuaucucuuacccacaucauucuugaggacgaagagaaaauaccugugaggaaguauuuacauuuguuacgguggugcugggcugaguuuguguggacccuggacucccagcuguccacacaguuauaaagaguaauuaaaagcucccugaacaacaggucccuuaucagccuuaaaccuuauuguucagauacauuggcuuuuauucauagucuuacuaaucaacuggggacaaaaaagacccauugaaccauuagcccucagcccgagaugagaagcgcaugaugguacaauggccgugguucagacucagauguuaugcuauguuuugaauucaguccagguuccuaggaggaaaacacccaucaaauuauguuggcuuuagagcgaucucagucaacagaugacaucaccgacuuuuccuucccugcuggucuuuauuuggaggggaugcaagaauugugcaaccuuggaauaaacagaauagagacccgacuccucacucauuguguuucugaguuuaguuucaauccaacagcggaucuguuuuuuuacuccauguaaugggacuguugcugcagcuuuuguacaaggguggaguggguguccauuugcugacgagcacccuguguacacgcuaguuuuuauuugaacgaggugcucuugucuuuauuauguauugucugcccauaaaugaugucuugaaauagaggggugagcaucaccucauuuauuucaacccauauuuguacagaaggauuuuuguaaucaaaucaugggguuuguguguagaacucaguaagaaguaaucaugacccuguccguucauuugcucuuuguucuuuccuguuauuaacaauggcuuuggggcuuuuggggcgcauuuaguucugcacguuguguauguaaguagauguucuucugugggggcugcaaguccuuaaguuauaguuggauucccuucccagcaaggaaccaacaggaaggaaaacgaagucaaacccagucuuugcacguggaagcuuguggcgugacuguuauuuuuuugugauguucuguacagcccuguaaucucuuauuuuuggcaagccaacucugaaucuguggucccguagccccaggcaaccaaaagcugagacaaacagaggaagugucguuauucacauguuucucuggccaccucaucgggcuggacgcugccggcugccacccgucgcugagcuggagcuccccagagugcagccuggccaggcagggacuguugacccuggccccuguaggaagcaccucuggcuugucccccagcccccagggucccugccacucauuacuucucugcacucuuucuguaauuuguucaucgccuggaauuuauuucuggcagacuuuguggucaaaacugggaagugucuguuuccuuaaaacagccuuuccucaaacccaggaagugaaguagggagcuauccuuccucaccuccucccugucacaugcacaugggcauacacacacguacacacucacccaugugcacacacacaggcacacacaugagaaagggacggggaaagcuaggguguccaccccagccugggcuccugguaucccuaaggguuuuggaagaagaguuucaguuuuucaaagccugcuggagauguaacugucgugauguuucgugggaucugcaagagccuguagcgucagguuucuuuccuuuugauugggaugacaugaagucuguuaaugcgggaucguuuguguuaucugcucugauaggugguuuuacuugcauuugauuuuugauagaaugagagaugaauugauuuguuccugauacauucuguugggauacaguccauuugauaggaagguuguuuacaucacaguguccuguauuugggggcugcccugggaugugaaaagucuguuuaugucuguugacagagggucucuaugcuucuuccuuuucuagcauuuacucuuauguuacaauuagugccugcuugcugugugaacaggacagauuugucuuguuuguuugggucguaugcaguuucaugcagaagacuuagcuagaugagugacucaaaguuccaugccuggggcccuccacccuccuucccucaaucacgccuuuauccagucccuucccacgcccuguuccucauuggaauccucuguccuagccuauccccccugcucuccccuggcauagaagggugcaucucgucuccccacaacagcacuggaaggugcuagaacacuuggagaaaacuaguucuguaccagggauuauguucagcagguuuaucuccucaaggcaccccuaaaguauguuuuuacuauuuaacacacgauuuuguaggcccuacuguuguuagcuguucguagauacuauuucagaacaaugcugugaguagauacuauuauuagguccauuucacagauaagaaaccugaggcccugacaggguaaggaguccuaagguucuguagcuagccaugguagagcugggguguaaacucaggcuuucugacuccaaaguucauauuuuuaaucccuauacagugaaguaggcacuguugccauuucuauuuugcagauggggaaacugaggcacugaggaguuaaguacuuugcccaggguccuagaacuagucagugguagagccaggauucuacccagacaggugagcucuggagccaaagcccugagcaucuguaguagauuccuuguggcuuucuguccuguccuuguuccgagaaaguucccaggggacaguuacggaaucacugggugcuugcuguucucacacgcacaguuucuacuggcucucuagcauuucuuucauuagugagagaauguuucagcccagcuuuucagaugguggaguugaggcccccuugucugagcuggguauuugagagccagcaggcuugagggccugugaggucucuggaggacacgguggugguggggccaggagaagucacuucuugggacuuuggaaagccuagaggaauuccagaaaugaaacaccacacacuuacuggaagccaaguucguguuucucccacugguggaagggauaugaggugcuguaaacguggccuuuuuucagaugcagaaugccugucuaauuacaggaaacagagaugucgccccacacugagccaaggauuucaacaucucuuggagaaauucugcauggaccugaaguuugaagcuuugcauuguaaccaaguuggcucuccuugccuuccccccaggccacgauuucgucauccugcuuuacggauggcauuuccuauuaagugucugucugugaacauaaacauggagcugagacaaagcacagcuucucccuggacccggaaagagggacucaggcgccuggggcuggggccuggcuccagaccugcugcugcugccuggccugguucggggaugccuagccuaacaaggcagccugggcugggaaucgcuuaggccucagguugaugaagcugggagaaggguugagagggcaccagaccuaagaugguggccagagccauuuaaucaugugguuguaaaauugucaguaacuucuuuguauggcuaguugaucugaucucucauguaggacucagucccccaguuggaucuuggaagguagacauuuauuugaaacagacagccugguagagugaaaagagcuuuguguuuuacccccucagauaguaagcaaagaaaauggaaaaagcagcgcugucuggggugacauccugaugcauugcuggugacagagugaagaggugacacauuuggaacauaauguggccaucuguaugaagaaccauaguucauccagucaucccaacccuaggacucuccagagaaaaccguuuaaaauagggggaaaguuauuugcaugaauauguucauaagaacauuauguauaauagaggaaauuuggaagaaaccuauagguucuuccacagggaaauuguuaaggaaaugaugguagauucuccgcaagaauggcucccauuaaaaauugaauuaguaagacucuaagauaaugugguauuaagaaaaaaacuccaugauuaaaaaugagcaugggccaggugugguggcucacgccuguaaucccagcacuuugggaggccgaggcggguggaucacuugagcucauuaucugaugcccugaauuggcuuuuucucaugcacauuagguuaaggucaguaguuacucacuuaaguuacccauugcauguguuuccagugacagaaaaggauuuagggauggaucguugaggugacugcuaugcauagaaaugccuagaaggaggcggugguuuaagcuguagaaggaggcaggugccaagugcucccaguuugggguuugagcucccacauucugucugcacagcagcaggcaagucccguggccuccaggcucugcaucugugauguaagaucguaaaccuguccugccuaccuuguuugagcaucagaugagauaagguacgugauaacacuuugugaaucacuuaaaaacacuaugucuaugugagguugauauuauugcuauucaauaaaugcaaacguguaggaaauuauaaaaugauucaacuguuccauuccuguuuuugaaacuuucugaagagagguggauauguuucccugagguggggagcuaggguugugccuguguucauccaggaaaaugggaugaaaagcccaagauacaucugcgacaucaucuucagaaugugaaauuacaguggguuuggaaucugggccuucucucugccugcucccugccucuccuucccuacccacagucuccagcucugacuccuggccucccaggguccucucccagcagccuggaaggaagggacauccucauuccagggcccaggccaugaggaaggaagcagugggcagggaugcaggcugcaggugugggcagcuccaggugcccacucuaggcuucaggaugaguggcucccuuccugcagugggugcccauccuggcagguacagucaccagagaggcccgccugcuucagcugcauaccaugggguuuuuccugagacuaaagaggguccugcuccuuauauccauugaccagugagugaugaggaagacugaaugcugacggacgggaggaaggaagucaggagaaagggagaagggcuggccaggaaggaggagagaggaaaugacagaggagagggagagaucaggagccccaugccugccagccagggaaggcccugcuguugcacucuucagaaccccaacuugggacauuuugaauagauguuaggagugugaguggaaucuaaugagugggacagaccucccaagugagcauugaauaugagggcggguggggcaugguagcucaugccuauaaccccagcacuuugggaggccaagguaggaggaucauuugagcccaggaguuugagaccugccugggcaacaugggagacacuuucucuacaaaaaauuaaaaauuaacugggcaugguggcacgugccuguggucccagcuacucgggagguugaggugggaggaucgcuugaguccuggaaaucaaggcugcggucagccagauugcaccacagcauuccggcuugggugacagaaccagacccugucucaaaaaaauaaauaaaagauaaaaaauaaagaaaaugaggguggaggaagaagagccagcggaagauucuucugagacaugggaaguaaauuugcaagauugcugucugggagcuggacagacaggaagggaacagaacugggauguggcagggacagguuccaggcacuggcaggaugggggccagugugcagugggccaagagggaaugggagcgagaagguggggcgucagcaacauucagcucccuccauagcucgaugagaagagagggguggggacaggcgguagcuggaggguccuucaggaucauuuuauccguaucccuuucguaucuuuuagugaguuuuuguuuucccuaacuggauuguuggcauuuuaagggcacaguuuguaucuucuaccucuuuguuuccuccaaaguuggccgaucaccagaucacuuaaaggagguuguuuguuuuauaagcguuuuaccagaucuuggcuuaacacuucccccagaguuagucauaaucauucuagcagggcuucuagaugcugaacaaugaccgauggugccacuugauuuauaugaagauacugguuuaguuuuaaaagcaaacuuacauugaacaaaguguaggaaagagaaaggagagggcuacucaagugccugaagguccgagcagugaagaacauguuuccauaugccugccacccuuaggcuaaggacacgguuuuccuaucuguuuauugaauugggucacuugcuuuaguuauaauauaugaagggauaagacugaauuucacuucucaauuaacuagcccucuugcucucuuuugaucacacguucuggggucagauuccagcucugccagucaguggcugcacuggccaaggccacgugguugaccaccauccagaguucugccaagagccuuaccugccagaggcacgggagguguggcuguugcgcagcuucuguggcccaggcccucugccuggcacauuuuaaguaaugugagcggauuacuuaaucuuacugucuguucagcugaaaacuagggccaacccuggcucagagcucagggggccguugcgaggauuaaaugagagaauccauggaagauguuuagagucguaccagacacauaggaagugcugaauaaaucagaaugguuuuuacuaugacucucaccuuucaauguuugugacuuaaacuuauguuacaguuagucauuucacuggcgugugcuaaccaaagguggccuggccccuccgcauccauuaggagggcuugaguuuaaaauccaggcccugugagucugcagggaggaccgacgggagagcuggguacuccugggacuucaguguccaguggaugcugggguucucagguugguauauugagucacauaguuccaugacucccuuggaggaagaggcuaaaguugucuagaggcaggugugauguuuggucuguccugugugcacugagcaccuucuguauaccagucccccugcuugcuucuuccagacagaagaaaacacagauggcaauuggucauauuugaacagugccucuuauagcuuacaaauaccaucuuauugaacacucaugaaaaaugcugggauguauguuauuuuuacuguuucaaagaugaaaaaacucaggcacagacauucuaaauaguuccagcucuuaggaaaaugcuucuuuagcauugcgggagaaacaguauauuuguacaaggcaaguaguucacccuguaaggcagcacgugcuuuggaggcaccuaaauacuacacaguguuuuaugcaugggcguuuuucuuacaaaggaacauagcuuuaucuuccuggggguguuuaucaaaccacaucuauguagcagaugcucuucaagcauuucccauauucccucguuuacaacacccuggaacccugaguuaauuauuagucccauuucauggcugaggaaucugaagcucugagaguuugaacuucuugucuaaagucacauggugaggaagugguagaacugaccuggaccccagguaucuggcucuggucuuuccaauagugccucuucaguggguaucccuuaaauucucaggggcaggugcuuucuccuccuuuuaugcccuuuuuuucagagcaaaaccacguuauccuaacugccaagcacaacccacaaaggcucuuaucucuccuucaaaaaaagccauucccugccugguugaugaggucaccuggcauuuugcagggcauuuugcaggguagaugccagcucgggaaagccacauagauaagccaguggauggcuuguguuacugccucccugaugguuugcuuuuaauucaagucgauucauuuaucugagaugaaaaagggagaggcugauucacacacauugaaaagcagggaauggugcuggagaaugaggccgugacuauuuggaauaagauccuggagaugggcagugcugauagaguaaauauccagggagcaggggaaggugugugcacugacaacaggaguuuuagcaucugccccuccuugcuucaaggggcuggcggguacccgaggcggggucggagggcugagugauggcucccauccucccucuucccuccugcuccacggguguaaccuugaggugggauuggagggcuuggugaccucucuccucccucaugcuccauggguauaaccccaaggugggaucacaggcugagugaaggcuccucauccucccuccucccuucuauuccacguguguaaucccaagaugggaucagagggcaggguggaggguuacacauccucuccccucccuccugcuccacgugcguaacccccagcugacuuacagacugugguaccugcucaacugcuucaauuccagaacuggaacugcagggaagcuguuucugacaucccugguuuuaauuacaaagggccccuugagaccuugucagaaauacugccagccuagcccuuuaaaaacucaugauauuggguucucuaucagugucgcucccuggcuguaauauuguacuauaauuaggcaagauguuuccuuugggggaaacggggugaaggguaugaagguucucucugugucauuucuuaaaacuccaugugagucuauagugaguuuuaaaaagaaaaaguuccagccugggcagcauagcgagaccuauugucucuacacauaauaauaauaauaaaauuagacagugugguggcgcacgccugugguccuagcuauuugggaggaugaggugggaggauugcuugagcccaggagaucaggacugcagugagcugugauugcacuacugcacuccagccugggugccagagcgagacgccuucucaacaaaagaaaaaggauaaaagaaaaaaaaauuaaaaguagggucauuuaaauauggcaaacuccaaacgggucuucucuuugaaguuuuagggagcagcuuauuuacuuugugucucacacuuugcuaauauccaaaaugcagaacauuagggaaccgcuugaggcaggaggggaaggaagcacugauucucgcugcagcauggaugaaccuugacgacaugaugccaagugaaagcagacagacgcacaagacuacaucuuuuaugauuccauugauaggaaauguccugaauaaacaaaucuauggagacgggaaguagauugaugguggccaggguuugggaguagcagggguaggagggaauggggagugacuguaaguggguaccagguuucuuuuuugagucauguucuaaaauuagauuauugcaaugguuguaaagcucugugagugaacuaaaagccaccggguuauacccuuuaaaugagugauugcauagcaugugaauuauaccucaauaaaacuguuaaaaaaaacaguaggguccuuugauaguuuuaauagaagucauaauaagaggaauaguccuuuuucagagacugcuuguaacuugcaaauucaggccacuguccuggggcauguuccuggcucucauaaaccagauucacaggcccaccacgcagaccaugaggguguuuccagucacucaucuugagggaaggaacacccagugugugccaggcauuuugccaggugcuuuuaccuacgcuuuauuauguaaacuuuuugcagcccugcaugguaugugguuuuacgccuuuuuuuuuuuucuuaauagacagucuuuaucuguugcccaagcugaagugcaguggugcagucauagcucacugcauccccaaacuccugggcucaagugaucuuccccacuuagccucccgaguagcugcgacuacaggcacauaacaccaugcccggguaauguuuuuuuuuuuuuuuuuuguagaguuggggucucacuauguuacccaggcuggucuugaacuccuggccugaagcaaucugcccaccucagccucccaaagugcugagauuacaggugugagucacugaacccagcucaugccuaucuuuuuauagaugaguaaauggagguuccuggcugggugcgguggcucaugccuguaaucccagcacuuugggaggccgagguugggaggaacaucugaggucaggaauucgagaucagccuggccaacauggugaaaccccaucucuaccaaaaaaaaaaaaaaaaaaaaaauacaaaaauuagccgggcaugauggcgcgcgccugugaucccagcuacucaggacgcugaggcaggagaauugcucgaacccaggaggcggagguugcagugagcugagaucgcgccacugcacuccagccugggcaacaagagugaaacgccaucucaaaagaaaaaaaagaaaagaaaaaagaaauggagguuccaaaaggcuaaaccacaguaagggaguacugcagcaaaaacuagaauuugggggcuccuugacccccaagccuauucucuuuucacugcugguauagucggguugccaaggcugcccucuuggaggggccgauagcucagggaggucaccagaggaaaggccugugagcucugugcaagucauuuucaggcuuguguccucaguggggacucuacucccuccggaagugaguaugacauucugcccuauucccuuggagcagcucuucccaggagagcuucaguggaaagaaaacugugggaaaacauuuggaggcauuucauggacacguuucugaguguuaugagcucuugaaggaagcauguuuauuuccccaaagugcucagcuguguccggguccugaguuuuucaaggguuuauaacccccggagcugaauuuggauaugcaaggaagccaugggauugcagccagggaacaugcuauuuuuuguaagugaugaugcuguuguguaguaaacaggccccucgugguaaauggagagcagugaauggagguggagggagaaguuuugggaaaagauuugcacucaguuaaugaugcucaagguaguucaaggcagacucaguagcucccggguugcuuaguagaaaugcagauuacugggucccagucuggaccugcagcgucagaaacucugggguaaggucugggaaccuguguuuuauuuuuauguuauuuuuuugagacagggucuugcuguguugcccaggcuggucuugaacuccugggcucuaguguuccucuugcuucagccuuccaaagugcugggauuauaggcaugcgccacugcaccuggccagaaccuguguuuuaaggaacacuggagaucauuacugugcacccugaagucugaggagucuagcaccagaugaucugacgacacaucauugggauguggagucaugguuccagucaccagccugaaguuguccuugucugucacccuccccacuuugucuaagggugaguggaacagacagaaaguagacuagugguugccaggggcugggaguagcaggcuaggagggaauggggagugacugcagguggguacagccuuucuuuuuuggugauguucuaaaucuagauuguggugaugguuguaaggcuuuagauggcuugcuugagccuugcaaugggaaugagugccuuggccuaaggagaagggaagaaaaucuuguggaggaaaugagcuuuuauuuuuuuccuuuuuuuuugaggcagucucuugcucugucacccaagcuggagugcaguggugcaaucucagcucacugcaaccuccgccuccuggguucaagugauucuccugccucagccuccugaguagcugggauuacaggcaccugccaccacacccaguuaauuuuguauuuuuaguagagacgagguuucaucauguugcccaggcuggucucgaacuccuggccucaagugaucuuuugccaccagauauuaaaauguaucaaaaagcugcucuauuuaguacugauugagaugaauggagcaaaauagcccaggaacagaaccugguauugucucucuguaaaguaugagugaauuuaaaacauuauuagauauguuaucuaguaauaauaaugauaaaguauuuuuuaaagucaucaugaaucaauagaaggaaaggauuauucaguaacuaugagcaugugggucuuagugucaccaguacuuauccuucuucuuaggagggauuuguuuuuuuaaucuuaaaggaaauagauauguuaaaccuaucaggcuuccuuauuuacauuggcuagagagccuaacucuaaauuuagccaauguauaagacuaaaugucaaguauuuaucuauacaaacacacacauauguacacacuugcauccacaucuacauacacauauuuuacauacacauauacacauauaaauacacacguacauacauacacauacauacaugccucuuuccugauuuuauuuuaccauuauuuuucuuccgcuuuaucuugcauuacucuuucugguuuaucacauuuucuuguauuuuauguaucucuauaaaccacuuuaaaacuuuuugggggaagaaaguggacuauagauaaagaaauagaauaagguauaauauauagaaaaaaggcaguaaaaauacacccaaauuugaauagguugauuuuggggugguggugguaaugggauuauuaacuuucccuaaaauuuucuguauuuuugaaauuuucuacucaaagaaucauaucaucagaaaaaaauuauuauuucugcucauucccuuugcuggccagugaaaggaaugcauuuccauaagugagggucuggcagagcaguguugaggggaggggucuuugccgcagcaaaagcugguccgguucccaggagagccccuccuuugcugcuugaccugauugcaaguggaaugugagagccagaaggaaauauuccaucacuuauuuagagcauucauuuggcucuucccugaucuaggcguucaguaccugcucagagggaguuuacauucuagucaggggucagagaguaaaugagugaaauggauucagaaacgaugccacccugggauggugacauauagccccagugagaaggaugaggagaugcccaagucaagagcgaggggaauggguuuccagagagagagagggcugcuugugcacaggcuuggaguugcccagggguugggcaggucaaagugaagaauggccgggguggccauugugggugagcaggucagggauaaagaguaccuuggagagaucaacuaggaccggaucugacuggccaagagaaagaguuugaauuggacucuaaggaugguagacagcuacuaaaggauuuaauaaggggaauggcaguguuugaugaaagguuuaagauccuucuagcugcuucugaagggugauuuguagaaggacaagagaugaagccaggggaguggguagggagauucugcccaaacugauugcuacacagugauauuuuuaugcuuuucuuuuuuuucuuucuuucuuucuuuccuuccuuccuuccuuccuuccuuccuuccuuccuuccuuccuuccuuccuuccuuccuuccuucccucucucucucuuucuuucuuucuuucuuuuauuuuuguuuuggguguugaugaggggacauacaacuuaagaagaaaaauuggaauuauuuugucaacuuuucuacaucagcauuuuacugauggaauaagcuugcauuugaacuggacaucauuuuuguuuuuauuagauaacauuaucuguauuacagauaccagauauguguguacccauuuauuuacuaaucacuaauacuuacaaaaaaguaaauuuugucaaaagaaaauucagcuuagauggccauauuguauguguguguguguguguguguguguauauguguguguguguguguguguauauauauauuuuuuuuuuucuugagacaaggccuugcucuguugcccuggcuggagugcagcggcacaaucuuggcucacugcaacuucugccucccgggcucaagcaauucuccugccucagccucccaaguagcugggacuacaggcaugugucaccauggccagcuaauuuuuguauuuuuaguagauacaggguuucaccauguuggccaggcuggucucaaacucuugauucaugugaucugucugccuuggccucccaaagugcaacggcuauauuucugacauauacaaauccaagcccaguugaucagaauuuagcaguaucugcaagauuugaaccauuucagaaaucugagcucucuagcauuacauggacugauguuuucuuagcucagaacugcuuaccuguguguagaaaaucuaauauuuaggaagaauaauucauugcuuuaaguguucaguccugguuuuuauuucuauuguugcacaaguuugauuugaccuuggacaaaucauuucaguuuguauuuuagugcuugugugcagaagauggguaguaauaguccugguaauccuccugccaucauguuaacugggugagagcucuucaagaccuaggagagauaauagcaggugcaaagucccuguggugggaggcagcagguagauauuuuaggagcugaaaaacggucuguguagcuggagagcaggguacaagggagaggugguccagggucauguuauagagguaggccagggccacacugguugggguuuugcaaaccuuacuggggacuugaaucuuuaucugaagagcagggggaagucauuggaggauuuaaaucagggaaugacauaagauugauggauaugcuaucuccuuuaauccucauaacaaauguaugugcuagguaauauccccguuuuaaagcagcacagaaauuagggcaguggagauuaaggaguuuaccccaggacaccaugcaggugaaugauggagccaggaaaccaacucgggucagcuugcauccaaaguccucagucuuccagaucagcguaccuccauaguaauauaacaaugacugcaguuuuaaaacacuuugaacucuuaagaugaaagauuucccuuaaauuacaaagugguauuaugcugcagaaaugugagcgguaaugagagagcagguaaugcccgggaacuuuugaaaggcccgguccguguggcucugcuccagcaccuucaaguucccugccgucuggcggggggcgucucauaagcugcuuucaacacaaagaaggguuuggcugcuccccggccauuugacacugccauuguccauaaggacucguuguccgugaaaugcacccaaagcuugagcuuucagggguuuugggaaaucagaucugggcagugcaugugugguuucgcuggagacaucauccaaugccaaguuucugcuuucugcuuucucccucuuggauaaucagcuggguuacauggauucuuagaagcugguuguagagaucaccaucucgauuuugaacccaagaagccuuauucaggguucaagugggaaaauaccugcuggcccacggcccuugaggcucuuggugaugaugacauaugucuguuucuuucuaguugaccacguuguuccugagccugggacaagccugcucgcugccuuugaccaguggagggaaugggccgacagcaaguccugcugugacuacucucugcauguggacaucagugaguggcauaagggcauccaggaggagauggaagcgcuugugaaggaucacgguagguugcacugagucaaugcccucugcagauguuuccgcuucaguccaucaacuggcacagcccugggaagaaagugauaaugcuuccagaucccauuugugccucaugcccaugccugccccugggaaggagagagggcuuugggccgcagcuuaugcuguuuggagguggccuuacccagugcaguaacaugagccuucauugaugauaagagaagaugaggcuuacugcugggaccuguucuuaggugacagcugcucacagcuuauugguuugugagcaccgugcucucuagccaggguggggaguugaggcugcugagagagagauuuacccucaaaagauaacaaauacauaucucagugaggauuugacagucucaggagaguguugggcagccccuuccuacaaaccuggauggaucuaggauagauuugagggcuaugagacacuucaaaacugagugacaaccugagagggcuuuuccuuucccuagaauuauuuuggagaacaaauuuccagggauugggaagauucacagagaggcaggaggaaucuuuaccaccucaaggugccucugggacucuugucaacaagaaccucggggguuugcggggaagagccaggccacaucaucuuccugggucucgcugggcuuggcuagagaccagauuaacuucacuggaucuuaguguucagggaaacaccuauugcuuuaggguucuggggacuuccaggcuuagaaacaccaugugcugugagugacauggcaagagggaaaucucuagguacuagaaugauagaaaaugccccggaaugaaaagcaagagucuuggguuuauuucucugaucuuccacagacuaacugugugacccuggguaauuugcugaaauuuuaugggucucaguuuuuuaaacauuucucauauaugagggucuuggacuagauguccucuaagauucuuuccagcacaaagcuuccacauaaaagaaaauagguaaacuuugacuuuucucacuuuugaucaugcggagacuccaagugguuuaacuguggauacuuagacugaaucugcuccaaaccaggcaggaggguuaccaugguaacuguugccuggcaacgggagaagggccaggauguccagaggcauuuaacucaggcagcucccagcaccccccagguggcuugaauuaaacuccaaggcugcgagguugucaggacaauuguuuaaaauugugaugaauguugggcagggauguuuggucuggugccuagggaggcaagaacuccaagacgccaggaugagaauugcgacaucugcuuguugaacuaauggaccuuuucuuacuuaaaaaaucauuugcuuaaaaaucagcauggaaggcagucugucugccaaagaaaagacauuuaucacaguucuucauaggcagaaacuucuaauucauuuucuuguuacagucgcaacagacuuguuugguagaggcagcuuaaaaaauuaacugugguaaaauaaauauaacauucaaguuaccaucuuaaccauuuuuaagugugugugcaguucauuguuuuaaaauacacucauaauguuguugcaaccaucaccacccuccauccacaggucucuuuaucuugcaaaacuaaaacgcuacacucacucauuaaacacuaacucuccacuguccuucaccccagucccuggcaacugcuguuguacuuucugucugugaaauugacuucuagggaccucauacaaguggaaucauauaguauuuguccuuuugcaacuggcuuauuucauuuaccaugauguccuuaagguuucuccauguuguagcaugugucagggugucuuuccuuuuuaaaggcugaauaauauuccauuguauggauagaccacauuugguuuauucauuuaucaguuaauggaggcuugauuuuugcuuccaccuuuuggcuauugugaauaauucugcuaugaacauggaugugcaaacacuggcaacuuuuaauuuugauauacuuguaaacuuacaggaagauuauaagaauacuaaaaagcauccuugugccucuuccucccacauucacagguuauuuauaugguacucugcuuccuuuaccauucugugucuccauuucucuccucucucuuucucuguacugaaacacacacacacacacacacacacacacacacacacacacguacacacacagacaguauuaucacuuucuuaucccuuauuugguuauuugguuuaucuauuaaaaguccacuucucuauuuuguccgcacuagggguaaauuccuuccucguguacauggcuuucaaagaucgcuuccagcuaacggauugccagguaagaaagucggcuuuucggaagaggcacccugacauuugguaccuucaggcuguggccguuugggaaagcagucuccgauguaugcauguuuccuagcuuccugggaaguggcugguggaugcaguuacugauguaacugagccuuggaagagaguaugaacgcagugcccuggcccccagcacugccacuccgccgcccuggaucugaggcucugccccgcacggcgugugugggagcggcacucagaaccuccuuagcaaaccuggugcagagccaggugucacccaagagcuucucacucccgguccacguccugcuaaguuguacugccucuguuaauuucugaggggucuuucuccaucaaauguggccaguaacauugcccucaucauaucaaaaaaagucaggcuaauagaaucgccuagguguccuguuucucaucccagaaaugccucugguggggagaugauugucuuugugaacaggaagauggaagucccugucucugaucccacccuugucucucucucagauuuaugaaguacugagugugauccgggauauuggcgccauagcccaaguccacgcagaaaauggcgacaucauugcagagguacagggcuuucuuuuucgucauuucuucaucaccuggagggugagaggcaggcucaagaaagggaagcugcaucuguagcuuaacaccaagguggaaaagcagagggaccugguguucccuugcuggagcucugcucagucucacccauggcaugaaugccagugacacacgugccucuccgugugugccacagaacaucuaagucaguuacuauugcagagagaggccauuucucucggugcuguaacgcagcugccuugggugggguacgggaacccucacgucacacacaggcauuuuacaccguggcugaggguugcaaaugcaccagucgucagcaucccagggaacagcugaauggguuuugggaggcuguaauugauccauccugcucaggcgggacugggaacagggcagugaacccuucucuucaugaggucuugggaugagggcagaacgaucggcagugguaauuuuccaucuugcccggauaacugcaugcccgggccucugccaucagagcugugcaaaauccacucucccucacagccugacuuucucuaaacauugcaggagcagcagaggauccuggaucugggcaucacgggccccgagggacaugugcugagccgaccugaggaggugaauguucaccaagcggaaugcgugaaucagugucccuugggcacugugcagagccucagggaaccugcuuccugccuguugagaagggggcuucucugaugcugacuguggucuuucugagaagcugugggucacgugugugucugucugucuacgcaggcaaagugaaguguuagauugcuccugaggguaaggugguguggacuguuucgccagaagauucuucuuucugucuguaauucuucaagcccuugcuuguauagacacaaacaguucuucauuggcauccugcaauguagauuuuagugguucacaacuuauggucuccaauaucuuaccaaaauucaccaaaacguaguuggaaggauggaaaagcucuucuaaaugccuagaaggcguguggggaauuguuuuuccaagguaacccugcacaggauaucacaugauaugcagaguuugguagacagaaucuuuuaaaauuauggagggaagauucagagcaggggccugugcuggcucaaagguggagacucaccgucuuggugaggugugugaguucgaagggagggugcacacgucuuagguaauggagaaccuguguucaucaguuagaauuuguggcugugaaauacuuuucagaaguugguuccuuaaugacaggcuggaugucaggcucuaggggcccugacuagggagcagccugcagcuucgagugaagcgugcaaucagggaaucuccagggaaccaccaggauuuccccuucaugggaggaaguggcagaaaagggacuggcgccgagcagugggggaagaucaccaagggccugaguggaggcugacagugaggaggcuccagaagccugggagggaggagcuuggcaagagcucccugcagggcuguggccacugagucacugagugucagcaccgugccaccacccugaguuugggauguggucauguucauaccagugugggaggggagccggucccugugauaaggaaguggauucaggagggcuuggaagcaaaggcaccaucuguguacugccucgggugcaggagggggugguugggauccuuucagacuugaggggaagggaugaggcuggaagaggagaaaggagucaagacaggcagaaagacgagagugggagccacucggaaugcuuugcacacagucaggguccacgcuuuguucuauccuucuugcugcaugcauaugcacacauagacacacauguacacacagacauaggcacacgcagacagguaggcacacaacagacauagacacacaugcauacacauaguaacacacacagacacauagacacacagacagcuagacacagccauagacaccuacacacacacacauacacauagacacacagacacauacagacacagacacagacauacacagacacauacacaugcagaggcagauacacagaacugcaugcuccaagacacuuucaguagcauuugaggcccugaggacauuuuccucuccccagaugacagaauggaagccgugacauuuucaggauugcacguuccugcuucaggccagggaugcaggcccuuuuguagcuaucaaccuucucaugcgugcuaaaggcugaaaggguggccuggcacaggcccgaggaugagggaggcaggcaagccccugugucagcugagggaagccccaugcugagaccguggcugguggacagugauugcaggggacagcuugcaggcgagagcaggcuaagaucagccgaccauaaacaugccugaggcugauuuuauuuuauuuuauuuuauuuuuuuuccuuuuucuggagaacggggucucacuauauugcccaggcaggucucgaacuccugggcucaagcuauccucccaccucuuagccucccugagagcugggauuacaggcgugagccaccgcgcccggccgaggcugauuuuaugcacauuugugugcacacagauccacgugcacaagcacacacacgugcacacacucacguucacacacauauacauacacacacguccauaggcacagacaugcacguguacacacacagacacauuuuagcauacgcacaugugcacaggcacagacacgcacauauguguuguacccacguauuuucacauacacauauacacauguacaagcacagacacgcauagguguacacacacauuuucacacacacaugcacauaugcgcuugcacacaccuaugcaggcaccaucccccuuugcagacaccgcaaggguucguuucugugguuucacuucucccucugggccggcuucugugacugcccucgccagauuccccaggauccaccugucgggugguuuaaaccauggcagcauaagccaugguugcucucagcccugaccucccuggaauugggcuuuguucccagggcuuuguucccagggcuuuguuccgcccugaaacagucuugggauugggccuuggaaaugcacagaguccgggagagguggagggcugacacaguucucacgugagcccuguucaaagcugccuucauuuagugcucacgugugcuggacacuguguuccuggcccacauuucaguuuuguaacuguccugugcaggagguacaacaucuccuucccacaacuccagggaugccauucaugcaggcugcauggcuguauucagggagcaccauuuacauucuacugcccaugaguggugguaccagagcugugcugcagugggcuccuugguuaucucucuuuagaugaggacacuccagaagcaugaaguuaagugacugcccaguuaucaaagcagagagcuagaaagugcaggguccugccugcuaccccaaccccucccgcaguguacacauacucagcuuaaagccacaccuggaccugggcuuuauuagaaaguuuccuccugcuuuccucccguuuggugacugggagccagucccucugccugccauguaccagcuguacaaggaggugagaagauguccucugagaaaagcaaaugccacuucugcaaaugcuacaugaggcuccugcugagacccucacucuucaaguuuuagagccuucugaggggcuugcauuccuucuuucuccugcuuucugcagagaaguacacaaacacagaaagaaagggcccuggcuuugcugaagaggaaaaugcucucagagaguuguuauucugguugcuuguauucauccauuuucauacuacuguaaagaaauacgugagacuggguaauuuauaaagaaaagagauuuaauugacuuacaguucugcauggcuggggaggccucaggaaacuuauaaucaugguggaaggugaaggggaagcagguuccgucuuauguggcggcaagagagcgagugagcagaaggcaaacugccacuuuuaaaccaucagaucucgugagaacucacucauuaucacaagaucugcaugggggaaaccuuccccauaauccagucaccuccuacaggucccuccuucaacauguguggauuacaauuugagaugagauuuggguggggacacagagccaaaccaugucauugcuauuucaaccagagaaauugaaaccauuuuuacgugauuaggcccagcagcuguugcccugagaacuucagaauccccagcaacugauuauggagucuccuugagggcuggcagauccagggaugcaccaguaugggaugcaguuuuucagcugauuuagaggccccucuuguaugccaggcccugaguccuuuuagccauaugacagcccagugaggcgaggaggggggaugcaggggguuugaaaggcuuggauaguggcagagcgugauuagaacucaagcccacaggcaccugccggcugacgucuccucucauggugaguuugucaagagggaucuguuguguguuaaacccugugugggugauaaagagaacaaguauggaacaauuuugugugaauuuuagcuucccagucuacuuggggaggugcugcugauggaaugaaacacaucccaguguaacuucucuguaguuuggugaccuauccaucacuagcaugaugguucucuuggauuugaacuuuccaaaacauguuccuaacccacuaggccuuucuucccaacccaccaugugagaccacccaguaggauuuucccucguuuuccacccagaggauuggaaaggacacuagggagugcagacaucuggaacugaaccaucuguggcugagaggaguggcgacugagccugcgugacaauccgggcagugccuggcauuguggggaugcaaaacagauaagaaagugauccuuucugaagggacuguggacaaggcgaggagaaagagguagacagaaagugaguguagagauagaauuugacaguggcucugagcuguaagacugaugucugggaagagaguggggacuuggagaugaggauaaugaagaacccuucacagggacgggcacuuuccagcaggccuuguagaaugacagauguccugacacugcucugugucccuggacaggucauuucccuuucugaguuaccucaucauuaaaaucagaagauaggcguaguggcuuguaccugucaucccagcacuuugggaggccgaggugggaagauugcuugagcccaggaguucaagaccaaccugggcaacauggcgaaaccccguguugggacaauaaauggaguagucaccuguaucucugggaggugcugaggguucuaguggaguccaucucacacuucacacccaugcaagacgucccuguccccgccuggugcugccgggccacaggcaucucugcuguaaguggagagagagggcuucuccuucagcugucuuaggaaugaaaaacauuuggguguuuaauaugcuuuuucaagagcccuuugcuuggauuguggauuucuagacaucccuuuucacauaguugaugccugaaaggccaaaugugaaugaaguugucucagcucugcuaaauuagauuaccaguuaaugcaauuacagaauuuaaucuuuuggccaagcucugguggagacaagguaaccaauucaguuauaggggcucaguuauuucuugugaaaaauaacaguguucuguggagcagccuagacugaaauaccaugaacauaaaaugaaaucauuuauaugcuuagcaaacauuuuugagcaccugcuguguaucagacaggacauugggagcuauugggggcagggcauggaagauacuaagcagugaguaagccccagucccuccccuccaagaguucaagccagagcccuuuugcugggauggagagggagccagugauguucugagaucugccuuccacaauuucaccugcuccuucccuugcugauuggugauuccucuguaggauagaacuugauccagggagucuugccugaucagauauuccacagucaucaugugggauuugaaauaucauucaucugaacauccgauguauuuauuuauuuaugagaugaagucucucgcugucacccagucuggagugcaguggcgccaucucagcucacugcaaccuccgccuccuggguuccagcgauucuccugccucagccuccugaguaguuggaauuacaggcaugcgccaccaugccuggcuaauuuuuuuuuuuuuuaauuuuuaauagagacagaguuucaccauguuggucaggcuggucucgaacuccugaccucaggugauccacacuccucagccucccaaagugcugggauuacaggugugagccaccacacugacuggaacauccgauuuaaagcgccagauuauuuacucaagcaguucuucaaucuugugcugaaggucguaccaggcuguggcuggccaugucugugcuucacacacagggggccauugguguagacaaacggggcccacuccguuccuagagcccugugaggcugcauuguuucgugggugaugcugacuucauucaugagcauuuaaugggagcccagcacaaacuccacaucacugaauaucuugacucaagacccugggagcagaaugaauauauggaauugagagcaaucagugucuguguguggcgguucucaaacguuaguaagugugaaaaucacccacauugcugggucccgcccucagaguuucuagccugugaguuucuaguccagggcagagccagaaaaucugcauuucuuacagacucugggccagugcugaugucacaggcuugcugccugcaccuggagaagggucagaagggaguuuucuuuucuuuuucuuuugagacuuagucucacuuuguugcccagguuggaguaugguggugcaaucucagcuuacugccaccucugccugcuggguucaagugauucuccugccuuauacucccaaguagcugggauuacagucaccugcugccaugcccagcuuuuuuuuuuuuuuuuuuuuuaauuguauuuguaguagauacggaguuucaccauguuggccaggcuggucuugaacuccugaucucagguaauccaccugccucagccucccaaagugcugggauuacaggcaugagccacuguguccagccacaggagggaauuaguucaaccaaaccaauguugagagacacaaggcaagucauacuccuuugaauuguccccugggguaggaccuuggagaccagcagccucgccuucaucuuagccucucucugggguggaggauaaagguagcggcucguggggugggcugagccacauucucaugcucugcugcuguuuugcaggucgaggccgaagccgugaaucgugccaucaccaucgccaaccagaccaacugcccgcuguauaucaccaaggugaugagcaaaagcucugcugaggucaucgcccaggcacggaagaagggugagugcuguggccggacuggcugauggcagguggggagguuuggaggggaggggggcuccucacuagggagggcuccuuuuccagacccucaugccaagugggccacuugcaccauguucuggcauuaaccuaauuacagccgggcaaggcaggagcuccaguuuccuccucugcuccacugcugcggccuuguuaguaucuauuuaaagccaugugcacgccaaggcggggugggcaggcacaugucccccagcccccgugcaagagcuggacuuacuuugaugugguugaaauaaacuaggcacauacacagauuacgucaguuuccauccgccccagaauccuuggucacaucaugcaccuccccuccaaggcugggagugauuucugccgggguauguaaggcagcuuugugggguguggggaugcauuuugccccagacacuaucacauccagauguuuuggugcuugauaaacucucuugaugcauucugaacuggggcugggucucugguauuacuaggguguccacuguaacuaacugaugaagugcagcuuccagugcuuccucuagaggacgccccaugaggcaccucaugcauuuugaaugcagcugagcccuguugucacccaccgcugacaacaugaauuucgauaaucacacugcaucuuuuaugcuugggaguucucuccucguacagaaagccugagggcaugucguucauuuugaugguggaucuuaggcugaucugaaaugaacauuauaaaaggguccccuucuuucuuccuuccuuucucccuuuuauguucccuccuccccuuugccuguugggaucucuccaucucugugucuccacuucucuucccuucuuuccugauuucuguuucauuuuaucuuucauuugacucuuucucagucccucugucauucucucucugugucuuucuuucccuguuaggaagggagccauuugaccucuauggcuugguuucuacuucccugcaucaugcaauccacauggaucaaggugggcugugggauuuuuuucacuggcgggugacuugcugcaagcccuggaacaaauugcucaaugaugacugagucaucuugucccagagaugaugacuuccagacggacccagcgacuccuggcccugguucuuuggagugcuccuggggccucuguccuuaggcuacacaucaaaugguugcugccuuucugucuucuccuggcaccuugaaggaauugccuuuuagaaauaagaaagcauucaccuaaaauaauguaaccuacucagaaugagcuuugaguuguuuucuaggagauauuguggaugacgauggaaucgguggccuugggccacccagacacgcauuugcaagaaggcagcgcauuugugggaaucagccucuguacagaaggccggccacagcacugcugcccccacguaguguggggaugguuggcauagugucugaaagggggaaagaaugagacggcuuauuuucuguauuuuacuacugcgcuguaccuagaugaugaugauacgugaguuaggcuaacauuucaacguaauuuuggauagagaccuugucuaaaguuuacuucauauucaaaccuguccaaaugagaagacggagggguccuacaugucccagacuuuaguugggggagguggagucgugggccagcccugccgcaggccuccuccucucugucccucaggguucuucucagguggaguugcggagcuggaguguguuguugcggugcccaguuuggaccuauuaccccaacucagugccugguagcccccguuguuguuuuuuuuaauuuauuuuauuuuauuuuugagauggagucucacucugucgcccaggcaggcgugcaguggugccaucucagcucacugcagucuccgccuccuggacucaagcgauucucccgccucagccuccuuaguugcugggauuacaggcgcccccccaucacacccaucuaauuuuuauauuuuuaguagagacgggguuucaccauguugaccaggcuggucuggaacuccugaccucaggugaucugcccgccucggucucccaaaauacugggauuacaggcaugagccacugcaccuggccaccccuauugucuuuauaaccuugacacacugugugucuuauggggugagcaguaggaggggacuuuagucuguucccuuccagagccuucugagugugaguccaaaugugcccacaccaugguucccaggauggcauuugcauucaaacuguuacccauuaaucugugaaagccugagcuuuagacaaaccugagcugccagaaaggaauuuccagugcauucaggugcuaaugagcaggaaugagaaguccuagcuaacuuccuaggcucuuaggcucuuucccaucuugcuggaacuuccuagcaacuuugggaggcagcccuggcaggaauuuuuauauuuuguuuuacuuugcagcugaguaaacugaagcucagagcucauguauaguggaauuggggcuugacugucaggcaucuaacuugaggccacaaauauccguguaaauguuugacugacuuaccuucaugcuuugagauuauuuuaauacggugaugcuugugaccugugucuguuggggcuuaguuccuuaagaauccugauugaaacaguggccugacacccagcagagauauggguaauguacacacaaggauucccaaaugaccaagaaggaaagcucuguaagggaguauuaauuguuugccuccaggaucaguauucauucuuggaucaaaccccagcuccacuguacaccagccacgugaugcugggugcuuccucaucaucuccacauguccuuuugccaucugcaaggggaggauaguaaccaugacucaucucacagggugaugaugauguguacaugagauauugcagguaaagauggagaugagaagcgugaccaguuauugugacuacaggaugaaggggcuggucuaaccuugagcuugcgaggaaagcagaguaaagaugccugcugacccuggacaaggguuuucugcucagaauuguuuguccacuucagguggguucuucuggcccccugaggcaagugugugcacugccacagcccccuuucugaugcugcauuucuuccucugugaauggagagauucugaauucauugaaugcauuuucaugaugugauacuuuaggccugcguaccaggaaaauaaauggucccaaccacaguuagcuccucgacuugcaggggaaggaugcugaguggaaagucacauugggagguagucggggcuacaaaagggguacaagucaggagagguugagcccagaagggagucucagagaggucaggcugcguaagcagacucgaaauuuugcuauaaaugugagcuuugaaaaaugauaauccugcccugggaggaguaguaaugucuccuucucuuagugauccacaugaaccuccccagccaagaccugcugguccagaaucuaagacaagagaaguucggggaagugaggauaugaggugaaacgaaugagaacuguuuucacgugccugcuugagccagcacgacugcauccugccuucccugagagacacgcugagagacacgcugcuuccaucagccgcucuguggcuguucagcaggauggcguguucagccggggaguggugugucaucaacccaauuuggcagcugaggcaaugaacacagagccaggaccagacgaccugggggcauuuuuacucuugaaaagaacuuagacauugaucaacuuaauaggcucauuucauggaagaaguagaaaugcagaaauugaaaaucuugcccugguucauguagccugugggaauuagaaaccaugauuccaggcuccuggccaccucucuuuccauggagggccccuuguggggauuucuucucuagaaugggcucccucugaccacauuuuguccaugugugaaauccagcaugacugcugaugccuuccaugugugagugguggccgugggcagugccugaugaccucaucugauggacauucuuuuccguccuccuccucaccccucucccauaacccgggugcagaaacauucaggacauuaaacccugggaaccucaauuugagauaagaccucuuauguccugugggucaauaggagugacucaaacguuaugagaagcacauggucgcagggccugugaggaccaccucagcuuggggaugaguccuuaguuaagcuuaugcuugauguugcaaucuugaacagaaaagggggaugagagaggagagaggacaguagagaaagggggaagauuuauuuuaaagaauuauauuuaaggaaucaacucacacgauuguggggauggcaagucugaaaucugcagaucaggccacagacuggagaaccaaggaagagcugauguuggcaucggaguccaaaggcagaauuccuucccaaucuaugcccucacuuuuaacggcagauggucugcaagguugggaauucaauuugcauuguaauucagccacugccaggaugagauccuacuucugguuuucagccaucucagcucugcaucuaugggacauaagggcagacauagaaacuuuugauucauucauguggugcuugagcugggaauuugaaucccugaauucauucuucuuuuuucccccacuuugucuaguacaauuaggagcaaccaaccacucucguuauacuuguuaauuuuacaaaaauguuuaagguaucugcuacacacccaccuagaaccuugccucuuagaagccuuugggaguauuuaauaauauuuucugugucucuauugucccaucaugcccuguacucuccucuuuuuacuacuggacguagaaucauuagugccuuucaacccaaucagaucugagaacgaauuucagaaaccucagaacccauucagaaaacucauuuuuaagaugauguucuucuagaaccacucuugcuacgaaaaccugacagcacaguccccaggcuguuuguuagggucuggcauaaauucuuggaaaggcaaaggagaauggugagagcguguguaacugucugucugucuguccaucccaguugguuuucacugugcuuugguggcugcauauggagcuacagauacugauuucccacaguucccacuuuggauuuguucuccugcuucucguccaugggaaaugacugccagagcugggagcuaucaagcauauuuaaaccgcagccuuccauuuauucuucaugaaugcacacgggccccagacugguuguaaauaagcaccagcucccauccccugcaguucuuggccuuauagagagccugccagaggcuggcuuggucacauccuucaguuuagacuuuaccuggagaagaaaaucacaaaggucuaacgggcacccagauagcaucagcaguguauuuagagaagugcagaagggccaauuaagcccauuucgugguuuauuauuauuagugguaauuauuucuggcaugcaguucaagggugucuguggccuggcugagcuccggaagugcauccacagcacccuccugugaauguuuauagacccaggaggggagcccuggguugggagcuccagaccacuggggaugggaggcagagacucuauguauagaucauacucuuguggagguagaggccuggaacaugauggcuaaacuccugucgcugauucugggcuaagaaagaaagaaaauccaaaagacagcaaggaccucugaaucccugagggaaguugaacagagcaaaguagaaaugaaccacaggauggcuccaucccuccccuggcauccacugccccugccccugaaugucccuaucuuugcuuagcuguggcccagaaguccacucagccuuugucuaaagaggcagguucugcucagcaguggcguugagagcucagaccccauuuuggguuuucuagaggcagaaggccaaguucauucucuugaagugagguagauauuccugugcacagagagaaggggaauccagcuccucauagagcagcuccccaccccaagcugaguuguguuucgcagggagagauaagccuguggucagcagcauucauccccaugguauucaggccacuuuccaagaaccagccccuccuuguacuuaaguuucuagaggcagggccgaggagcaggcacagggagaggaugagcgucggcaaguuacaggaaacucaggaaaauguuuauguguguccagggauuuucagagacuauccagccauucuuuaucuccaagugccucugcucucaugaacuucuucauguggacaaaagcaggaagccuuuagggccacgcaucucuuguuuuccugugacuuacacagcccucaccuuugugcuuagauggacuguggccagcgggaccuccaggccuggcugggucaggagaguuuugcuuaaccagaucuguuugauccuugaaccaaaagcggggagccagagagauccuuugagaacugaugacugcugcuggguccugcccagccauuugcauuuuauaaaggucuuuggcagcggccaaggccuucucauuaugugguguuuuuccacuucgggaugaaccggagugguuugugcagccaccugauagcucuuugcaccagcuucugcaugggagacuuugagcaggccaggagccaaggggacccuccuaggccuuccgagcaccuagcacuggcccuuuucuuccuuggggcuuccuucuggaggagguuucccuggguuuggaguccucccuccugcugggggugggggcgugguugcugguggccuggagugagcugccugcuguggccuccagcacuccccagcugaacagcgaguccuuugugaaauuccugaggcaggagggggcagcugugcagagccagcucucagaguggccgacagggaggguguugugguguaucaucaagugauaaggccuucggaaaggcuguggagaggaaggaaaacacauuccugacugugguguguuugcccuugagggcccuguguuuggggaaguagagaagcuuggcugcauuguuguggggugggaguuagcccugugcuggggggagcuagugagagaugaauucagcugaccugggaucaaauuccagcuuggaugccuuuaauuaauaacauauuagaccauuuaaucaauuuaacacacguuuuuggagugccuacuaugugcaggcagguaaaugaucuucaaggugucuccaucagguggaaagucaaaaauucagaacugggcaaugacuggaggggaggaugggauucucaggugaagggugugagacccgaguuguguuuuggacgauguuaaaggaggagaucagcuuccaguagugaagagcaucugaugcuuuggugaggaggauuuucuuuuaaguccuugaaugcagaagggcuccuuuggaagauuuuaugcaagagaaugccauggaaagauuauauuauaguggaucacucuggaagugucaugcggaaugaauggagagguaggaagcgggguugggagagcaaacguaaaucuaagguccaauugggaggcucuguuggaaugagcuggcgagagaugaugagggccugauuuaaggaacgauuguauugaaggcacuaagguauuggcauucagcgaauguacaugagucucaacuuucugguuuacaucugaauggacagagaagaggacaugaucugagcaucagggaguugauguuugucuuggacauugcauuaauauaguuaggcuaggcuuccagaaacucugaaaucccaguggcauaauguccaguuuguuucucucucacagagucagcugugaagaugguggcuguaacggacagcuucuuccaggcagugacucagggauccaggcugucucuugaggauaucugggggguuauguauuugcccugaaauacuucgcccuggugaugucaugugugauuuccucccgcagaccuuuagucagagcuagacacugugaagggcuaggaauugugaaaagauugugugaaugaacaggaagguuaaauuugaggugccauaggccaugcauaaagaacaguccagauggcaccugggaccggaugccuggacaccauccgagcaggagauuaauggaauugaaaaucagcaacguaggagacagaagccuucaggaugucugggauccuauagggaggguguguuguuugaagagcaggggcugaagguggaaucuuggggagcucaugacaggcuggcagagguacugaauuucuccaagucucaguuuccucaucugcgagaugagccugauauuuccuauaaagggauagugagugcacugggugcugcugggcaggcaguggcuccucauaggggugguucccuucccccugcauuguguuggacugaaccuuguguguucuguuugucaggaacugugguguauggcgagcccaucacugccagcuugggaacggacggcucccauuacuggagcaagaacugggccaaggcugcugccuuugucaccuccccacccuugagcccugauccaaccacuccagacuuucucaacuccuugcuguccuggugaguccuggcgacuuguucacacuucacauucugucuuucuucagaccagacugaccuguuaggcgaaaacaacaugguggccaagagcagccauaaaacugggagacccuuguucaccaaacuagguuggcuacaugaguacagggaauugucauucuagcaccauuuugggaggggauucuggauaaaaaccugggccauguugaaagucaagccaagaagggagaggaggcgucaaaaggacuccacuuggguuggugugaugccauucaugagacagcccaccaaauagguguaggcgcacagcaucuugacgaagcugcagcaccacguuaugcauuuucuuugcaguggagaccuccaggucacgggcagugcccauugcacguuuaacacugcccagaaggcuguaggaaaggacaacuucacccugauuccggagggcaccaauggcacugaggagcggauguccgucaucugggacaaggcugugguaaggagcgauggccucacuccuugguggcucucagccuuccuuguccuccucaucugggggccauggggcucauggaggccuugaaaugacagacaguggaggacauccuagaagccaguacuuauaugacaauauuucugaggguuggaaaucuaagaccucuucuaauaggucauuucuuccuaaauauuacauauauauuucuuuuuaaaacaauuuuuaaauuuuuuucagacaaggucuugcucugucaccaggcuggagugcagugguacaaucauagcucacuguagccucaaacuccugggcucaggugauccucccaucucagucuccugaguagcuaggaccacaggcucagaccaccaugccuggcuaauuuuuuuuuuauuuuuuguggagaugggggucucacuauguugcccaggcuggucucgaguucccggguuuaagcaaugccucggccucccaaagugcugggauuacaggugugagccaccacgccuggcuuaccuguauauuucuuaucauuaucaucaauggaacaguaaagacugaaaaccuacacagcuuuagaugugacucugggucagucaggaacaaacuuccuuagcaaccaggugacuuacucaguuaauccucgucuacucuuggaaaugggcucaauuuccuuaaaagugucuuuuagggcucucuggacuuagcaugucuucuacugccagcuuccaguaggccugcuaugaacauacacugaccuuuagaggaucuuugggcuuuuucauuuuaauguuuuaaaauauauuaacagaauagguuuucuguuuuuuagugaauuguuuagauuauaugaagaauauauccuuauuuccagaagaauaaggaaguaaauaaaagucacuguguuucagauauaaccacaauuaacauuuuggcaaaugucuuuccauuuuuugcuacuacacaggcacacacauguauaugugacaugcgugaguguguaaauaauauuggcaucauacagcugggcccacucccagguucaugccuauaaucccagcauuuugggaggccgaggugggugaauuauuugagcccaggaguucaagaccagucuggcaacauggcaaaacccugucucuacuaaaaauacaaaaauuagugaggcaugguggcaggugccuguagucccagcuacucggugugggggaggcaggaggaucaccugagccuugggagguugaggcugcagugagccaugacugggccacugaacuccagacugggggacacagugagacccuguuucaaaaaauaauaauaauaauaauauuggcaucauacauacuauuuuguagucuuuuuuaaaaaaaauuuuaucauggaaauaucuccaccugcuuaaauauacuugaaaaaguugauuuauaauaacagacucuuccaugugagugcuaaacugggacucauuuauuuauuuauuuauuugagauggagucucacucuggagugcaguggugcgaucucagcucacugcaaccuccgucucccggguucaagcgauucuccugccucagcccccugaguagcugagauuacaggcgugugccaccacacccagcugauuuuuguauuuuuaguagagacaggguuucaccauauuggccaggcuggucucaaacuccugaccucaggugauccaccugccuugaccucccaaagugcuggcauuacagaugugagccaccaugccuggccaggacucacuuauaauucuuuuuuuuuggcugggggagacaguuucacucuuuccccccaggcuggagugcaauggcgugaucuuggcucacugcaacguccgccucccggguucacgcaauucucuugcuucagccuccugaguagcugggauuacaggugccugccaccaugcccggcuaauuuugguauuuuuaguagagacgggguuuugccauguuggccaagcuggucucaaacuccugaccucaggugauccacccaccucagccucccaaagugcugggauuacaggugugagccaccacgcccagccacauuuaugucuuugguugaacauuuauguuguuucugguuuuuuuuuuuuuuuaacuugaaugacauuuuuauaauagacacauucuugauuauguuuguaggagaaauuucuacaaguggcauugcugggucaaaggaugcauauauuuuuaacauuuuugguacauauugucaaaguuccuuccagaaaguuuguacugcuuuauacgccaccaccaauauaugucauuccccagugucuucuaccaccugggugucaucagcaaagauccauuguuugcugauuugauaggugaauuuugugucuuauuguuuuacauuuaauuuauucaauuacugauuagagugaaaauuuuuuccuaugcuuaguggccauuuguacuuuuuucucccucuuaauaccagcuuauuuccuuugaccaguuuuuuacuggauuuagaguggguuugggaggggaagcacuugaggaaaugugauuggcaccuaaaaccagauguggggcggagacuucuagguuggcuagacuagaagaugacaucuggccaggcaugguggcucaugccugaaaucccagcacuuugggagagcgaggugggaggguugcuugagcccaggacuucgagcccagcugggcaacauagugagaucugucucuuaaaaaaaaauuagccugguaugguggugcaugccugucuucccagcuacucaagaggcugaaagaggaggauugcuugagccugagaggccgaggcugcagugagcugugaucacucuacugcacucuagccucaaugacagcaagacccugucucaaaaaaaagauuaaaaaaaaaaaggaagccuagaucuguggcuguauuuuguugaaaaggacagccaauugggccaaaugauauuuccuaaagagggauugccaccccugcaaauuaaacgaauuuuuuuuuguuuugaaauaauuauagauuaagaagcaguugcaaagauaguacagagagaggucccggguacccuucacccaguuucccucaugguuacaucuuauauaaauguagaacaauaucaaaaccaggacacugacagugucacaauguguggguauagcucuaggcuguguggccaccuguggagucaugugaccaucaccacaaucaagaugcaggucuaguccagcauuucagagaccaaccucuugcugcuccuccccuccacccucccuaacccuggaagaacccaucuagccccucaucuguucuccaucucuaccauuuuguuauuuggagaauguuauagaaauggagucauacagugugugaccuuugagacgguuuguguuucacuuggcacaacgcucuugacauccaucuaagcugucguguguaucaauaguuuguuauugaaaaguaacuuuuuaacucguuucugcugugugccuccugugcacaccuaugcugucucccucaggucacugggaagauggaugagaaccaguuuguggcugugaccagcaccaaugcagccaaagucuucaaccuuuacccccggaaaggccgcauugcugugggauccgaugccgaccuggucaucugggaccccgacagcguuaaaaccaucucugccaagacacacaacagcguaagaccuguuaacugugcagaccccauccaaacgaauuacagucacagagacacagacggagggagagccccaggguuucuaaaaagaacuugcugugaugggaaugcgcucgacugaggauguuaugauuugcaauuugcugggaaaagaauaguuauuucauuuucuuuagugaggucaauaagauuguuacucucauaaucauuuuggaauaccacagccucucuaucuauagaccuuuagagccucuaaagugaugucaggaugugcaaagcuuccagaagucaggcaccgcuccauuuucauagguuggcacagcacuucucauggcaguacuuggugcaagggaccucaaugaagcagugagauguccucuccugagaugcccacuggggacuuugauccucuuaagccauuguuuucucaggccaguauccaugcagaaaacuggaugacagccauucuuauuaucuuaaaggaauugauugacugacuucucccuaacagaaguaccccccagccauuugauuguuguuuuaggaucugccgcuuuggguaucucuucccucugggucugggcuuuagagcuuagagauguccucucuuguuaacaggacccagggcaagucuguuaaugucuuacgcuccucagcugagagugagggguucagacgaggucuccaaguguccugugauucugugaggucagcagacauuaagcagaguuguuagacacugccgauuccucacaagcaacaugguauaggcagaaaaacugaaggaauaugcccagagggagagcuuuggaaaagaaaugggccucgggcagaagaguuucgugucaggaacucauuugaaucuugaagacagcucaggccagcaagcacugacaccucccccacacaccacgacagcuuagggcagguuucuggcauuucuccgggacaacccugggacuuugcccugucccaguccucucucauuugcacacacagagguguuugggcugcaaugggcucaggcucagcucuggcuucugccaccugugaggaccagggugguggguguuucucagaagacuguucaagucuguguuuaaagcugucuuucucccucucccaccaccacucacuggcucagccuggcagcgcagccuuaugaucgcgccccuuacagcccagaucaugacuucuuggguguccugacuggcuauuuuauggucagggauccuagggcccugccccaugaaccucccuauucaugugccuguaacuucacauucucauugacucuuucauuugaccuucucaauaaagggacugguauuauuaucccaauuugggaaaauaaauaaacggaggcuuagagagcuuaagugaccagucuaauguuacauagcgauuuugcgguugagccagaauuagaacccaaaauuguucaggacucuucccugccagacugcauaugcagccucuuggucaggcuuagacggggaaaaugcuuccccucucuugcaagguugcuucccccagaggugcuauaaauggcuggcugggcucguuauuuaagacacaaaugaccuagcuggggaacuugcauuuggaguucuuaaccuagaagacgagacagugggaaggagagaagauuugggaagacagauucugcccuccagacauuuucaccccaaccuacccugcuuuuaccuccaggugaccuauggaagaaauguugacuuucaaagcggugcuuuuccauccccaccuguuuuaaagagccagcacuaagcaugugccuguucguucaucuucugggaaaaugcaaccaggagacuuucccugcauaguacaguguuuccuaccaugaggcuaauuagcuuuaguucagagcaucuagcuaacuauuaucgacagcccuguugcuaagccuuugcuuggauuuuccaggcaucuggcccgaugaguaauuuuagggagccuguguggauguagguuaaaaaugucuaugcauggugagugaggaagccucccugcaucaugguuugauggagaguaggcucugaguaucugggaauugugaucugacccuuggacuugucaauguuaagucacugagagucauggggcugguucuuccaucuuuuaaaaaugauagauggccccagaggucuucuaggugcucauuuauaagcaacaagacucaacgcaugcauugugugagaucuuggaugcugcagggcuggcaaguguuagcaaagugcaauaaagagccagacagugaaugagugaagauuuucuaaaugccuacugugagccaaauagugagcuagaugcuuuuguucauuuuauuucauuugauucucacaugaguccugcaaagggggaccuacuuaccccucacagaugaggagguggaggcucaggggugugagggaugcauccaaagucacauagcuggugaauggcauaccuggggugugaacccagggcagaugucuccauggccgaggcugcgcccauacucuacccaguagggcacaagaggagguugucagggcauaaacuguuagcuguggagugauguggaagagauggcucuugauccaggccuuaaaggaugacucacacccuuucaaagguuguuucugagaugaccagggaugaggcuuuuuguauugucaucuucacauacaccucgggagggugcagaugaagaaacugaagcugagacaggauuaaagcaaucuccccagagucacacaacuucuggauuuuaccguaucugagaugccaucgauuuuaagauauuccauuagguuauguaccacgaugaaagaaaacaugcccaagacgaggagucucauaggagacugggccaccaagggccagcgugugcuuauuauggcaucucuggggagaccaucugcugugcagacagggguggcagaaaaucucgcaggccucgaccuuggcauugguugccaagagggaaaaaugucucccccaagaauuggaacuggaagugggugcuuguccagccuuguggucugaaugcaugccgccugugugguccagaacaaugucaagcugagaauuuacuguaaaaugcccucagugggguugucccccaacccaguggcacaaacaaacccauaucccccuagaagaacuuggauuuagucuaggcuggcaguacccgcguggcuccggcugcuauaagacacauucugacuucagggaugagugucuuagaauugaugaaagacaauuuuaagucuugggucucaguaauccaagugcagaguccucuucccucccugcuggcgccucucugcuaugguuccuuugguagcuucugcaugacugcuuugagacucagagcaauguacugacagcccucgugguuguuuucacccaacauuguaugcggggcauugugcauuuacaugccugaugugagcugcugagcuggccgaauccguguuaccagccgcugcacuaagcagaaaugucaucuugaacugcagggugcuagcacagcucucuguucagaggccagcucccugagugcugauaaccuggucugaacuuucccagaagcccagggugcuuuuuaugguuggagcaaccuauuaauccucuaguccagacucagccacagccauugguccccgugaaccaaacaggcaggaagaagcgggaggcauuugggaucugggaaguagcacuggguuagcagaagcugcaggauggaaugacuccugugcaaugacuccuguguucuguugcuucauuaccaaccacaaacucacauccauauggagaccccaccuauuuuccaagagggcacacagauaugucucuguuuuacccggaaaaacuugaaaccagaaggauagcuacauagcuacauuguucuggaaauuaacuagcccucaaucauuuuaucggaggcaugucucuucagugaccacaauccuuucauuuagggacuucaguuuaaccacaccgcaaacagacuagaaaaccaggcuagccagugggaaaaccuacuuguggauggcucauuucaagauuaaauuuagaacuuggucagagaaggccuuuggaauucaaccggaauggagcuggagauggugggaacacagucucuguuaauaggaagaaucauuuucuuuauauuuguguagcauuuacaaacaugcacccuuuucacacaauuauucuguuuaauuauuuuucuuucuaauguggagagguagaaaaaguuauuucauauucuagacagggaaauggagacacagcaaguaagugccugcuggggugcccaguugggacaggaucccugucucugagucucucuuuugucucugugggguuggggcagugggugcugccggguggauugaguccagccagaguggccuguucuagaguuuacuuugccuucuucucagucucucgaguacaacaucuuugaaggcauggagugccgcggcuccccacugguggucaucagccaggggaagauuguccuggaggacggcacccugcaugucaccgaaggcucuggacgcuacauuccccggaagcccuucccugauuuuguuuacaagcguaucaaggcaaggagcagggugaguaguuuuguucugaugaauuuuuuguuaaaucacgaauuaaguucaaggccacaaacauuuauuaagcaccuugagacagaauauuaagaugaauuuaguggauuccagggauaagagggagccugaauuuuuuauuccuggcauuuaaaauacuggagaaggagucagucguguccacagagagcccuagcaaagugagaucaugguauaugcuaugauaaggaguguggaguaaggacccagaggagggagccacugcuguaguuggggagagugucauggggagaggacauuuugaguugggcuuugaagguuaaguaggaguuugucaagucaaagaagggagaugagggaauuugauaagaguaucaugagcauagaaaauguacaguguauucagggcaugugaagcaggaaagagauggagcuauaagggaauuaaaaggagagaaugcaauuggaaagaaaguuuggggccagaucuugaacaugauaccagauccgccucacagcaugcuuaggggauucuuacaggguuuaaaguugaagugucuugggggaaaaauuguaagguguguuaguuuuuguagaguuaaccaguuacuggaccuuguggggaguuuuggccuggcauggugggagcuggccccacacaacaccuguccaccugucuguaaggagagcccuccaucccuagaucucacaggcccauccucccuccaggaggguuucuagagagguauccucuguggcuguggccugagcuggggggacucuuguguuuugcagcuggcugagcugagagggguuccucguggccuguaugacggaccugugugugaagugucugugacgcccaagacagucacuccagccuccucggccaagacgucuccugccaagcagcaggccccaccuguccggaaccugcaccagucuggauucaguuugucugguaggguuggggcuuggggagggcacaguucugcagggccagcucgcuggugcuggcgaggcuacaguugcauuuggaaaggacacagaaauagaagugaaugauauucccuuucucuccaacgugagaaauacaguggacucagaucucuggagauguauuuucuuuuucuuuuuuuugaggcagggucucgcucuguuacccagacuggagugcaauggcacgaccuuggcucacugcaaccuccaccuccugguucaagugauucucaugucucagccucccaaguagcugggauuacaggcaugcaccaccauaccuggcuaauuuuuguauuuuuaguagagacggaguaucaccauguuggccaggcugauagaacuccugacuucaggugaucugcccgccucggccucccaaagugcugggauuacaggugugagccaccgggcccagccuagcuuggccuggagauguauuuucauaguuaaugacugguuggguuucagaaucuugagaucaguuugugucacacaaugcccauacuguguuuuaccuaauauauuaagaagacauuuguucaauuuauuagguccaucauaagaaaggacacugugguauuucaggacuucucuucucuccuacaguauauuguaguuuagcuuguggaguuuggaguuucaacagccuaacuucagggcucagcucuggcugugcuucagucuccucaccuguauaauggcaauaauaguaguugcucccccgugagguuguugugaggguuaaauggguuaauauauauguacagugcuuagaauggggccauuugagaacuguuaguuguauuugcuuggguaauuugugugauauccccuuggugagaggaaaggguucagauuuuuaaguuuccuugcuugaaacuucuuucccaucuuucauuugucccaugacuagaacauuccacucuuccagcucccugggccacagauuccuauggcguauuaaagaaauuguuaaaccagagagaauuuuuuuucuuggugguuguauggguuuuuagaaaguaaccuaugucccauauauggauuaccaguuuucaaaacauuuaaaaauaaggaacuuuacuuuguuguaaguaaaacguguauaaucaugucuguguuuucugaucucucaaagcuguuccaauauaaggugccaucguuccuccuacuugugauuauauguguaggauuaggggauuagaaugccagaagagggcuauguccucagaaaagccacagccaauuugacuaaucagaacaggggacaggacagagucuaagauguagugauauuuuguauauaguuuuacuuucuccaguaauagauccaacaaccuuuauacagugucugauucuuugguuaccuuaggcucaucuccuuuuuaaaaaguuuauuuuuauuuuuagagauauaauaguaucucacugugucacccaguacccaggcuagagugcaguggugcaaucacagcucacugcagccucgaccuccugggcucaagugauccucccagcucagccuccccaguagcugguacuacaggcuugcaccaucacgccuggcuaauuuuuuaauuuuuuuuuuuuguagagauaggcucucacuguguugcccagacuguucucaaacuccuggacucaagcaaucuucucaccucagccucuccaagugcuguuaguaggauuccaggcaugagccaccaugccugcucuccaccucccuucuguagucuaaacuucagugagguuuuaagagaagaacaaagaaugugaggccgggcaggguggcucacaccucuuaucccagcacuuugggaggcagagguaggaggauugcuugagcccaggaguuugagaccagcgucagcaacauagcgaaaccccucuuuacaaaaaauuuaaaaauuagcuagguaugggggccuguggcuguggucccagcuucuugagggggccgagugggaggauggcuuaagcccaggagauugaggcuguggugagcuaugauggugccauagcacuuuggucuggaaaacagagcaagacgcugucuccaaaaaaaaagaaugcgacuagcacuuuuccuccugagcugugagauuucaccuucaagcaggaucuugugugacuguccuggccccucacccgcuccucucuucuccucucccuccaggugcucagauugaugacaacauuccccgccgcaccacccagcguaucguggcgccccccgguggccgugccaacaucaccagccugggcuagagcuccugggcugugccguccacuggggacuggggaugggacaccugaggacauucugagacuucuuucuuccuuccuuuuuuuuuuuuuguuuuuuuuuuuaagagccugugauaguuacuguggagcagccaguucauggggucccccuuggggccccacaccccgucucucaccaagaguuacugauuuugcucauccacuucccuacacaucuauggguaucacacccaagacuacccaccaagcucauacagggaaccacacccaacacuuagacaugcgaacaagcagcccccagcgagggucuccuucgccuucaaccuccuagugucuguuagcaucuuccuuuucauggggggagggaagauaaagugaauugcccagagcugccuuuuucuuuucuuuuuaaaaauuuuaagaaguuuucuuuguggggcuggggaggggccggggucagggagagucuuuuuuuuuuuuuuuuuuaaauacuaaauuggaacauuuaauuccauauuaauacaagggguuugaacuggacauccuaaugaugcaauuacgucaucacccagcugauuccgggugguuggcaaacucaucgugucuguccugagaggcuccacaaugcccacccgcaucgccauucuguagucuucagggucagcuguugauaaaggggcaggcuugcguuauuggccuagauuuugcugcagauuaaauccuuugaggauucucuucucuuuuaccauuuuucugcgugcucucacucucucuuucucucucuagcuuuuuaauucaugaauauuuucgugucugucucucucucucucuguguuuccuccagcccuugucucggagacgguguuuuccucccuugccccauuaucuuuucaccucccaggucuaccauuucaugguggucguuggguccgccuaaaggauuugagcguuugccauugcaagcauagugcugugucauccugguccauguaggacuggugcuaaccaccugccaucaugaggaugugugcuagagugugggacccuggccaagugcaggaaugggccaugccgucucacccacaguaucacacguggaaccgcagacagggcccagaagcuuuagagguaugaggcugcagaaccggagagauuuuccucugugcagugcucucuggcuaaagucacggucaaaccuaaacaccgagccucauuaacccaagugaaccaaccaaagucaccaguucagaagugcuaagcuaauaggagucugacccgagggccugcugcuuccugguuaaguaucuuuugagauucuagaacacaugggagcuuuuuauuuucggggaaaaaccguauuuuuuucuuguccaauuauuucuaaagacacacuacauagaaagaggcccuauaaacucaaaaagucauugggaaacuuaaagucuauucuacuuugcaagaggagaaauguguuuuaugaacgauagaucacaucagaacuccuguggggaggaaaccuuauaaauuaaacacauggcccccuuagagaccacaggugaugucugucuccauccuucccucuccuuuucugucaccuuucccccuagcuggcuccuuuggaccuaccccuguccuugcugacuuguguugcauuguauuccaaacguguuuacagguucucuuaagcaauguuguauuugcaggcuuuucugaauaccaaaucugcuuuuuguaaagcguaaaaacaucacaaaguaggucauuccaucaccacccuugucucucuacacauuuugccuuuggggaucugguugggguuuuggguuuuuuguuguuguuguuuauuuguuauuuuaaagguaaauugcacuuuuaaaaaaauaauugguugacuuaauauauuugcuuuuuuucucaccugcacuuagaggaaauuugaacaaguuggaaaaaaacaauuuuuguuucaauucuaagaaacacuugcagcucuaguauucacuugagucuuccuguuuuuccuguaccgggucaugguaauuuuugguuguuuugguuguuuucuuaaaaaacaaguuaaaaccugacgauuucugcaggcuguguaagcauguuuaccuguuggcuugcuuugugugucuguuaaaugaaugucauauguaaaugcuaaaauaaaucgacagugucucagaacugaauaacugcagugacuugaugcucuaaaacaguguaggauuuaagaauagaugguuuuuaauccuggaaauugugauugugacccaugaguggaggaacuuucaguucuaaagcugauaaaguguguagccagaagaguacuuuuuuuuuuguaaccacugucuugauggcaaaauaauuaugguaaaaaacaagucucguguuuauuauuccuuaagaacucuguguuauauuaccauggaacgccuaauaaagcaaaaugugguuguuucaggggugugucuguauugagauguucgggaggcggcugcuugacuugggccuccaaccagacuuccccuccacaagcauucacggagcccucggcuucaguuuggugaauauaccaauucaagaguuuucacuccaugucacaggcugcuacguccaggccacgggauucuaauucuaagcaaagaugcagccugcgggugcauggcaaaccaagugucagaaauucacagacucuauccuggagagcccuccagaaucaagcugcauacugaagcuugaaacugggaauggggugggaccacaugcuuucaugugggugaccccucugggcucucugcuuccuuccagcuuguuuaccccggaaaauccuccagcaugaaagauaagaggcagguguguuggcccuuauccacaccucaguccggaaacuugugggaaaccagguuauaaaggcuuggucuuccacuuucaugcaagugucaagaaugcacuuuggccaggagccccgcccaccccagcaguccagaugcuugguuuccgugguuacccugauaacuggcacucacauuauugauucugagaagacugaaugaagagagugugugccuugggccccccaggccuaucauaggguugaugaagucauuaucuuuuuuucccuuccuccuccccucuuuuuuuuuugagacaggguuccacucuguugcccaggcuucagugcaguggcacgaucuuggcucacugcagccuugaccccuugggcucaagcgauccucccaccucagccuccugaguagcugggacuacaaguugcacaccaucaugcucagcaauuuuuuguuuguuuguuuuguagagacacgguuucaucauauugccugggcugguuuugaacuccuaggcucaaacaguucacccaccucggccucccaaagugcugggaugauagaugugagccacugcagccagcccauuuuuauuuucuguccagcccuguccaaacaggauaugaggugacuuauacaaacacauacacagugccacaguuuauaaauaaagaguguuugggu

SEQ ID NO: 17633 - RNA, 10825 nt, Homo sapiens
agagagagaggggagggcggcaccgccccuagccccgcgcuccggaagugaagcggccagaccaccagcuaauggaugcggagcggagggcccgcugaccgcucuccgcgccuggguaaguaucgggcagggcacgcggagugaggaccggaggacgcagcccccagccccagugccccucuccuccaccugccuggcccaggcgccucugccccgccgcauggcggaggugggccgggggcgagggcgcacuguggauaggggucccgccccguuacccugggugugagcugauggaugggaaaaggggacaagccgggcgccaggcuacucagggugugggaagcgggauggcacugaagaugagcaaggauagcacaggcaggguggacaggaggggggcagccaagacgcuggacaccccagcuucaguuuguccacucgccuuggcaggcugcagggagcagagacugaaacgagaagguucccgcuucgugcauccacuuuggugugguuggggugacgggggaguggggggggggcacacaacauggcgggaagaaauucagaggggcguagcagaugggagaggaauauagagagagacgcaggucugcggucuauggggguguagcaaagagugcagucgggaauuccagcccagggccacgacuuaaagacggggugcagaccgacucuauugcgcaaggcgccauggaccgugucugcgccacugcgccaagaagggcgcaggaacgugucgcgauuugguuuauucugcuuccuccaccaaaaaaaaaaaaaaaaaaaaaaaaagagagaaaaaacaaacugaaacccccuucccaaaucuccagcuuuccccugcgccccagagccccgccugguucccccgccccuguugcgcacugcgccacagucgcagcguuucccggguuaccagaugccacguguuuggggaguaagugcgggugcgcaucuggugcggaguaggagguaggaugugggcugugagugccaugaauuguguggggccaagcaggggaaagguguguaggaacuuggugugugugugcaguagcugagccacggccaccggguugguaaguaaccagggggcaauuagauuugugugccuaacacggucaaugcugguccuucauugcuuauucccaucuccacguccuuuccgcguaucagucccugccucugcgcgaugacagcuccgccucucuuuccacaguggcaaaauccugcagaaauggugccccuccuuugguggcccgggagggaguucugggcaugcucaguaaccaggguggguuugggcugagaggccguuuaccgcagggccaccgcguagggccguguaaccagggauccagucccauugucagcccaggauuaaaugcgguuaccaaccacccccacaguccaauugugagagauaguuuggugaauauaguuacaucugcuggacaaucagucgcaauuugaagaucagcccaucuugauagguggaaaggcgucuccggaugagaaacagacuggggaagaagaauauaggaguggaggggcugagagaaccggagggggcauuuuggacuuagcggcagaugugcuuugcauuugaauaaagcauuugaaaaaagcgcuuccaacugaauuacaucauuuccuacucacagccccacugugagaugcgugccuuaucagcacugcuuuccagguuaggaaacagauuuagagagcuuggggcgcauagccaagguuggguauuuaguuaaaugauccagcaauuccagugggagucuuccaccucaaagucuggcuucuuuuccagcuuguccugugacccccuuuaugugagaaaauacaagguucuucuauuucuaccguauccagauauuuccauccauggcccuauuguauaucaaggguguuucuugccauguuuuuauuugaagguaacacugcaggucacacugggaggaagagucaucugaagauagccuaacuucagcauagcagucauucuguagaccauagagaugcuuuuuccugggcagugucuuuuuacauucccuguuuccucuaaauaucccaguggggaggaagguugcccccagcugguuuuuuuauuuuuguuuuuguuuucagacagagucucacacugucacccaggcuggaaugcaauggugcaaacgcaacucacuguagccuugacccacucggcucaagcaguccucccuccucagccucccaaguaguugggacuacaggcgagugccacacgcccagcuaauuuuuuuauuuuuccuuuuuguagagacagggucgcacuauguugcuggucucaaacuccugggcucaagugauccucccgcuuuggccucccaaagugcuggguuuacagguguaagccacugcaccuggcccucccccacaguccccacauuuuagaaaggaaaagucaggcauggagaagucagcagucucaggucucuggggcuccugggcacaggggugaagcagcauuuugcccuccuggcucucuggcaccccuggugccuucagcacuucccagaagacucaggagaucuucccacagcaggagcacugcugauagaguuacaggacagcacuguggcguauggcccccauucgaauugaugaagauguuuaggccaagggggaaaugguuguagccccuuaacacacacuccgcagcaguaacugggagguauuaggaacucuaacuuuuuuuuuuuuuuuuuuugagacagagucuugcucuguuacucagguuagagugcaguggugcaaucguggcucacugcaacuuccgucucccagguuuaagcgauucuccugccucagccucccaaguagcugggauuacaggcacgugccaccacacccagauaauuuuuguauuuuugguagagacgggguuuggccauguuggccaggcugguuucgaauuccugaccucagugaucuacccgccuuggcuucccaaagugcugggauuacaggcaugagucaccacgccuggccaacucuaacuuuuuuacguucucuaauccucacagguucuccagaacaaaauccuugauaggugugcuuccuccuuuuuucuuuuuucucaaaugauggguuaaaguucaaauguuaggaaaggcuggguguggugauucaaguguguaauucagcacugugagaggcuguggcgggaggauugcuugagcccaggaguuugagaccaggcugaacaacguaaggagacugcgucucuacacaaaauuuaaaaaacuagccaggcaugguggcaugugccuguggucccagguacucaggaggucgaggugggaggauugcuugagcccaggagagaucaaggcuacuacagugagccguguuuacaccacugcauuccagccucggcaacagagugagacccugucucaaaaaacagaaacagaaacaaaugcuuggagaguguuguguuaguaacuuauugucuuagucuauuuuguguugcuauaaaggaauaccugaggcuggauaauuuauaaagaaaagagguuuauuugggucacaguucugcaggcuguacaagaaguauggugcugacaucugcaucuggugaccccucaggaagcuuccagucauagcagaaagcaaagagggagcagaugcggcaagaaagggagcaagagugaggggagggagguggcagucuguuuuuaacaaucagaucucgaggaagcuaauagaacaagaacccacucauuaccccaagaauggcaccaagccauucauaagggauccacucucaugacccaaacacaucccaccaggccccaccuccaacacuggggaucacauuucagcaugagauuuggaggggacaaaccuucaaacuauuucacuuaccauucauagcaaaagcaaagcccaaauguguguuugcaaagccuuccagacacaacaaaagagaauuaauucauaauucccgauuuaacuuagucggcccugagauuuuuuucccugaauuguuauaccuagauuaaacuauuuuuaaacguuugagugauuccucauuaguuuuguuaaucaaagagguaaagcaacuuaauauugaguaguauugugaaggauuaucauauuuuugaauaagugcauuaacggucuuccuacugaauauuaaugaagcauaaauaccuguucuuauuguuuauguguaacagagcagcuuggcuuggcuggagcuaagagccagacacaccacuguguggaggugggugaugucuuccugugcuaaaaggugaauaaauaagcuccucaccucucgcggaacacucgggaacacaucaacagguauuuagccacaucuccugauuucaucuuucaauggcaaagaccuugaauccuguccuuaacuggggcucagacauuaaucaacaggucugaugagcauaugguggggacaccagauuucauuggaguccccaagagaaaaaaaagucacagugagcaaagaaggggucugacagagugggacaaaugcaagcgcaguguaaagcagaaccgccaucugcccccaguuccauuccagauuagaguauggaugcuuccaaggaaagagagugcuguguaguaaaacugaacauuguuucaccagggguccaagccgcccugcugggaggcuucucuucaagaguucugggucccagaguggaaggcauuuucccaucaacuggagagagacgaaacaucagagaccaggaggcuguggagaaagcagcugucccaggugccucaacuaucagagaagggucagcgucacguggcugccagcaucuuugagaaaaucacuggcaaucggacuucagagcugcgggcacaggugugguuagaacugagauacgaccugcccaccugggucaggccuaaagacaagaaguccugaguucuugccacugaguaggccagggucauuuguccagaaaacuuugugacugucuuugagugaccuagucugggacccauucauugguggguucuaagguuagaagcucauccaggauauuuucaauauuaagucagugcauagcugcaccacuaacaaauuggugccuguagagucagagugggucaauucuuaggacaauggcgcuggcacuguuagaggacuggugcaggauaaugaguguggaugagcagaagucacugaugguuacggggauaccggcggacuuugaggaggcugagauucaggagguccuucaggagacuuuaaagucucugggcagguauagacugcuuggcaagauauuccggaagcaggagaaugccaaugcugucuuacuagagcuucuggaagauacugaugucucggccauucccagugagguccagggaaaggggggugucuggaaggugaucuuuaagaccccuaaucaggacacugaguuucuugaaagauugaaccuguuucuagaaaaagaggggcagacggucucggguauguuucgagcccuggggcaggagggcgugucuccagccacagugcccugcaucucaccagaauuacuggcccauuuguugggacaggcaauggcacaugcgccucagccccugcuacccaugagauaccggaaacugcgaguauucucagggagugcugucccagccccagaggaagaguccuuugaggucugguuggaacaggccacggagauagucaaagaguggccaguaacagaggcagaaaagaaaagguggcuggcggaaagccugcggggcccugcccuggaccucaugcacauagugcaggcagacaacccguccaucaguguagaagaguguuuggaggccuuuaagcaaguguuugggagccuagagagccgcaggacagcccaggugagguaucugaagaccuaucaggaggaaggagagaaggucucagccuauguguuacggcuagaaacccugcuccggagagcgguggagaaacgcgccaucccucggcguauugcggaccagguccgccuggagcaggucauggcuggggccacucuuaaccagaugcuguggugccggcuuagggagcugaaggaucagggcccgccccccagcuuccuugagcuaaugaagguaauacgggaagaagaggaggaagaggccuccuuugagaaugagaguaucgaagagccagaggaacgagauggcuauggccgcuggaaucaugagggagacgacugaaaaccaccugggggcaggacccacagccagugggcuaagaccuuuaaaaaauuuuuuucuuuaauguaugggacugaaaucaaaccaugaaagccaauuauugaccuuccuuccuuccuuccuucccucccuuccuccuucucuccuucucuccuccucucuccucuccucuccucucuuuccuuccuuccuuccuuuuuucuuuuucucuuucuucuuuauuucuugggucucacucucaucacccaggcuagagugcaguggcacaaaaaucucggcucacugcagccuugacuucccaggcucaggcucaggugauccucacaccuuagccucccaaguaccugggacuacaggcacgcaccaccaugccuagcuauucuuuuguauuuuugguagagacaggguuuugcuguguugcucaggcuggucuggaaccccuaggcucaaaugaugugcccaacucggccucccaaagugcugggauuacaggcaugaaccgccaugccuggcccuugauuuuucuuuuuaagaaaaaaauaucuaggaguuucuuagacccuauguagauuauuaaugaacaaaagauuaaacuccaaauauuaaauaguaagccugaaggaaucugaaacacuuguacuuccaauuuucuuuaaauaaucccaaauagaccagaauuggcccauaccauagaagaaagaauuggcagucaaaaaaaaaaauaccuuuuguaauguuugaaaaauaaagcuguuugacuugucagguguuuuccuuucucaaaucagcaaauucucucugagugccuggcuuugugagacacuguacaaggaguuacaagacuacagcuauaaccugcaguugagcaguuauaaaccuacaaaaugggcccugcccucagagagguuccagucuagaugaggagcugaucuagacagguaaaaggcuaacuaacccuuuguguaaauaaguucaucaccccaguaaaagugucaucacccagugaauaggaccaccucugccugcagauuuuuguuguuguuguugucauuguuguuguuguuuuaaccugggaaguguucuuccugccuuucugcuaggugucagauagauggucccagagcuaggugcugugucaggcccugaagacacagaugacucaaccuaagcuuuacuuuccagagguccacagccugagagguguccccaaagaaagggggacaugaggggacugcaugcuugagagcaggguuguuuagggcagguuuggauuuagugagcaggcugguuugcuuagagaaggcuuuuaguggcaacaaaggaugaagaggagagaaaaggaacucacauuuauugagggccuacugugugcaaaguguuucauguauaucucauugaauguauacagccacccuguugugguauaauuuugcucuuuauaaagagaaagaccgaagcucagaugaguuaaguggucuccucaacaccaaaaugccaagaagugauggagccuagacagaagcccagaacuuucugacucacacuaguccauccucuaccaucacgaugacuuucaaauugugcucugcaguucugcagauuuucuagcagugccaucuccaaaauguguuuuaaacucuuuauuuuuuuaauuauuauuaguauuauuuugagacugagucuugcucuaucacccaggcuggagugcaguggugcaaucucagcucacugcaaccuccgccucccagguucaagcgauuucgugccucagccucccgaguagcugggauuacaggcacccaccaccacgcccagcuaauuuuuguauuuuuaguagaaaugggguuucaccauguuggccaggcuggucucgaacuccugaccucaagugauccacucaccucggccucccaaagugcugggauuacaggugugagccaccaugccugggcuaaacucuuuaagucucuaguaaaugcagcuagauucaaaugggcugauaaccaaauuuuaacacaucagcauucaccaccagguuuacuuuuauuuucagauuggcucauuuugugcagaccuuagagcaaaguuuccuuuaugguaucuguguacguauccaaacuucuuuuaauuguucacagauuuuaaaagcgguagcaccacaugguuguguagaucagaccuguguauuuagaucagaccuguguaucacguaagugugugagugcagugcagaugagcaccauuuaguuauaugugcuaggcaaaucuccaacacaguugauguguagucuugugguagauuugugcauacuguaagcaaauugcuuagcuucucuagacaucaguuuccacaucugaaaaauaagaagaugagaguacacgguuguuaugaacaaaugacuuaaugcuuuuuaagcacguugcaugacaucuggaacacagaaagcccucaauacauugaagcucuuaggauuuucacgauguuccugucugcucaaugcaugcuuucuuuauuguucugacaguugugugguaacaagcuaauaugcuuccaguugacuuccagucuacccugguguuagaaaccguuucaucucuuauuguaaauuugagugcuuguuguuuuuuauauuugugaugacucuuccagcaguuguugacaauuguuagagguuugacuuuuaaauaauuacuuauuuuuucugauugugguucaguuuaacugaagaauauccugagauuguaagaaaagcauuuuuuaaaagguaucacuugugaucauuuaucuuucuaaauucuauuuuuaauacuguuccaccaaagugaugcagugguuaccaugacacccuaauuucauguguuuuuguauuuaugaaaauaguuucauugucauuuauuggcgguauacaaaguaaaauguuauaaaugugaaguuauaaaauaaauauaugcuaauaaaauccugaguuuuucuguuuccuauaucguggucucuauaaaguacugcuugaagaaggagcuuuguuacugaaaaauuuugagagauaaguugagaaaaucaagcuaaagccaaaaggucuuagaauccuguaggcaagaaaaccugaaagcaaaaaaaugcuugaacaagaauacuugaacuaugucucuggggacaagggagagcucgguccacccauuaucgauuucucuuuuaaaauauacagaaacaacagauggaggucaguugccucagagaccccccagcucauuugcuuaggaaaguaacuguacagauaaauucccagacucuauucugccaagggugaaugacccugaaggucgaauauugcuuuucugggcugaagucacccuuuuucuucuucuucuucuucuuuuuuuugagacaaggugucacccaggcuggaguauaguggcacaaucucggcucacugcaaacucugccuaccagcuucaagugauucucaugccucagcuucccgaguagcugggauuacaggggugcaccaccacguuccagcuaaguuuuuguauuuuuaguagagacaggguuucacuauguugaucagguugggcucgaacuccugaccucagguaauccaccugucuuggccucccaaagugcugggauuacaggcaugagccaccgugcccagccugaagucaccuuuuauucuauggagguauauggggggaaauuccucuugccuuuggccuucuugaaauugcuucuccuucuuuuuucuaaagugcaaugggggaguaucuuucacugggccauacauccugcagaccagcccauuaaagaggaaugucccaagggggcccaacgccaucucccacucacccaagcaaacucuccaagggguggucucauccuauacuucauacuucuccaguccugacucucaaauacaggccccaagauucuugaaucacugcugaggauaacuuuccaccagugcugucuggugaagacugaggccaucagccuccugccuuuuuaggccuuuggugucaccugccaugcaccugcacccaccauguccacuaggccaccccuccucuuggguucugcugcccauccuaaaugcaagacuuugcucagcagcucucggcuuugcucuccuuucccagcuaugccaugcuuccaacuuaccuucuggacauuccacgguaucuauacaaaccagccugaacaucagaguccuuacugaauaccuugucaccaucuuccugcacugaacucugguccuccucccugugcagccccuggaggggaaggggcucagucucccccagcucaggagaggcuggaagguggugguagcauuccuccuagcucauugucauugcaaauacauuuguuccuuccuggcauaagcucacccacugugucccaccaccugcuguggagugucccugacaggccuggaugauggcaaugacaaagcaaugacaaaaugagucaaggcagaggggucccuuuagggcugaauguggccugguguuaccuaaagcaacaaagacuaggaagaaaaauacaaugaccgug

SEQ ID NO: 17634 - RNA, 30106 nt, Homo sapiens
caggcgcagaaaagggggcggcggacucggcuuguuguguugcugccugagugccggagacgguccugcugcugccgcaguccugccagcuguccgacaaugucgucccaccuagucgagccgccgccgccccugcacaacaacaacaacaacugcgaggaaaaugagcagucucugcccccgccggccggccucaacagugagugcggggccgaggcucugugaaggggaugggggaggaggagcagccccggccgccgccaccggcgcggcgcgggaggcgggaggagaaggcagcucauuggcucaggcaugggauguccaggugacugacagcucccguccccugucaagaggaggggcgccugccuugcuccgggccucucuguugccuccuggggucuugggcccggggccguuugggcucgcgguccgggagcggcgcggguagcgcggaucccccuggugcggggggugguccccagcagcggagccgggcggggcggggcgggggcgggccuggggggcggggaggccgggugggcggagcgggccgcggaggggacgugggccgggauggggacgugcggcggggacgccgggggauggacgcgcgggagcggggcggggcgggcggcugccgcgggacgugucggggaucaggugugcggggcucgcgggcgggcagcgucuggcgggcgcgggagccccccagcgagcauuccuuuguugccacacguuugucaggaaaauucauuugcucgucuaggguuggcuucagucacguguggggugagaggcugugccuugcuucuccuuuuuccuuuuuuauuuuuuuauuagauuucucgaaguugcccaagugauuuuuuuuuuuuuaaagcgauggguugugcgcccaguaaagcugagagcagccuccugaaccacccaagauugcacacgucagggagucuggggccaugcauuuaaagaaacggaauuaaaaacgcacucgggcaguugaaaguuaacggacgaggcugauagacaacccaggccagggucuuuucauaacauuccgcugcccagacaucuuguccucagauuguuccuagucgugagaaccgggagccuucuuggaaggguucuugccuaaccuuucuuuaauucaacucuugggaaagagguaaugggagcagugagcauauggccagaugaagucuuuucaaaaccacuuggaugcuuaaaggucaugcaguaucuuucguaagagggaggugcuuccaguguggccugaagauuauuuuagggaagagaguuucagcccucaccagguagcgauggaguuuggagauuuuaagauggaugcugcugcuccagguuuugauggguuaauucccaaaaccuuuaagugucauauauuccagaauguaagaugguuauauuauuucccacaguaaauuaggaugaauguaugagucuuuaaacguuacuuguaucacauauuccuaugcaauuuuaaguuauuugcccauguuuagcauacugucuuagauuuuagaaugggaagaaacuucagagcuagcuaacugccuccuguuguuugccuguagagaaacaggucuagaguaaauggccuuguccaaguucacaaccggcugggagcaaagcagagguucucauguucagccugucuacugcucuuuugaggacauuuuuuuuuuuuuuuuuuuuuuuuugagguagagucucgcucugucuacaaccuccgccucccagguucaagcgauucuucugccucagccucccgaguagcugggacuacaggugccugccacccgcccagcuaauuuuuguauuuuuaguagagacgaaguuucgccauguagcugggauuacaggcgcccgacaccaagcuaggcuaauuuuuguauuuucaguagagaggggguuguuggucucucaccauguuggccaggcuggucucaaacuccugaccucacgucauccgcccgccugggccucccaaagugcugggauuacaggcuugagccaucgcaccggcuucuuuucaguggugcagaaccuccugcuggugugugugucuuauuuugucaguguguuauucuaccuaauugacaaagguggccaaccuuucuguuucuuuuuaguauuguuucuuaauuguacaguuuucuuaugagugaagauacuugguagguguacgugauuucacugaaagcaaagggauuuucaucuuccuuugacccuuuaacaacaacaacaaaaagggcugagccaggcagggcacgauggcucacaccugucauccuagcacuuugggaggccaaagcgaguggaucacuugaggucaggaguucgagaccagccuggccaacauggugagagaacaacccccucucuacugaaaauacaaaaauuagccuggcuugguguugggcgccuguaaucccagcuauucaggcggcugaggcaggagaaucgcuugaauccgggaggcagagguugcagugagccgagaucacgccacugcacuccagccugggugacagagcaagacucugucucaaaaaaaaaaaggggcgagggcgggggcugagccauaugucauuguuuaucuuggugucugacagaccuaugaggaguuugaugucuuuggccagucgguuccugcuuggcugacaucagcucuuacagagguggaaguacacucagccugcaugggacaucaaaauguugcuuugggacaucugcuagauagaaaguauuuugugugggauagggugagcuuucugaaaagcuuuuagauauugccauauuuaauuacucccuucuugccucucacucuguucguuuuuuuagcucauuacacaacacuguacugaacaaaacaagaagccucauugaauuccuugaagugauuuuugggcaaugggcaaaacaacuuauucaggcaucuaguacuauccaaauugcugauaagucgaaggacuuuguuggguaaaguugcacaacugaaaaacaggagaagaaauguacagauuaucuugcguuugggauuuuaucuuugguucaggggucaaagcaggguuucaauagcaaauuacugaaguauuugaauagugaaguauuuuugugauuuuuuuuuaacuuuaccgcuguggagagacuguucacuuucauuaaaaauuacagggcaaauacccaaacuccuuccaagucaaaaggauguuguccaguuuguuuuauuguuaagaaaacuaucaacuuccuuaagaauguuugaauaagauucaauagggccgaauaaggaaaaucaaaguaguaguguaaaucguaguauaauucuuguuguugagaaguauagccuuuuuuuucuuuucaaauuuucuuguucuuuuuuguuuuuuguuuuguugagacagggucuugcuuugucacccaaacuggagugcagugguacagucauagcucauggcagcuuagaccuccugggcucaagugauccuccugccucagccucccaaguagcuaggacugcaggugugcacccccacauccagcuaauuauuuuauuucuuguagaguucgaguuucacuuugucacccaggcuggucaccggcuaacuuauuuuuuguagagauggaguuuugcuuuguugcccaagcuggucacaaacucuuuuuuuuaaauagaaacaucuucaagcacaauguccuugcuuucuuguuaugaagagugcucuuaaggccuucauggauugucacugccucauaauaauguuuugaauaccuacguaacuuguauguaaauacauacugcugcaaaaagaccaacuuuucaaaaauuuauuuauuuauuuuuuuauuuaagaagaaugccaguaacucuuguuggccuggucuggauuucagcaucagguuggccuggucuggauuccuuucaauaaugaaugaaaagcuuugaggaaagaauguaaauauaaugaaauuucaaaagaguuacaugugggccuugaaaaguuagggggaaagaugaggagaaauacucuucauucucuccuccccuugucccaaagcuccucucuucuucuucuugcaagaggauugaacuagugauuauaaaacuguaaagauuauacaacauacggcaaugaguauaaucacaauuauuggaccacccuucacagucuauuauguuagagaacggagaagcauucacagaaguuucucugaaucucuuagucauucccaaaaacccaaaccagaaaauaucucaugucauuguauguuauguacaaauuggcauaaggaacagcucuuaguuuguaaagucuuuuagauaauggagaaagcuuccagcuuuuaguuuucaagcuugaucauuaggaggagaauucacucugugguuguuuucuacuuuguguugcuuggacagcacaaaccucuuaucuagccuuguuuccuuuccaaguaaaaagggacuuugugaggauugguagaguuagaacacuaagaaauucugaggcuguaaaucaggaacaaaucgggugaugggaaacagacguguuguucaucuauugaggaagacacauuugcuuuuuuauguguuacucaaaagauuaauauguagccucuuaaugccuguguacauaacuuucucuguaccacuauguauuuccauagaugauauuuuugaaagagaauuacccuuaauuaauuaaaggaaaucuacacuuuuaaggcuguuaauaccuauugucaaauuauucuccagaauguucacugaagcccuaauuguaauaacaaaguauuagaaacaaccaucucaguaguaguuaaccauugccauuuagauaaugguuaaaguaugguauaucuuuauaaaagaugagaugcaaugcaguuguucaaaagaaugaaugucaguauauauugauagggaagacaucugaaaaacgacuuacagaauaugucaguauguguguaugguacaguuccauuucuuuauaaaaacaaaagcaaaaacagaccuauauuucauugacaaaaacucugcaagucuccaugugaaacugucaaaaguggcuccuuugggaguaggaacgggagguugggagagauguuaauuuuuaauuuuauguacugauguuuacguuuucuaggaacacauuuuuccaguaaggaaugguuuuucuaugauauagaauauaauuguaguagcuaaaacuuucuuagggaccuuucuuauuguucugcgugcuauauucauuuaauccuccuaacaaagucuucgagguagauacaguuauuaucucuauuuuauagaugagaaaacugaggcacaaagagguuaaguacccugugcgaggguaacagcuauaacugagagugggagccuggcuucagucucagccccugaccacacuauaccaguguaucccaaguacaaauuguccgccuuaaguagaaaugcuuucaguuaugauucaggguguggaggccacagcagagaucacuuuuacuaagcuuuucuagguaugucucuuucagguuccaaaaguauauauuggauuaugauugcuuauguguuuuuaaugaagaaaauaggauccagacauugauuugaaaguccuucaaaaaaguaaaaaccagguugggagcaguggcucauaccuguaagcccagcacuuugggaggcugaggugggaggauugcugaagcccaggaguuugagaccaaccugggcaauguagggagacccugucucuacuaaauaaauaaauaaauaaauaaauaaauaaauaagucgggcaugguggcaugugcccuguagucccagcuucuugggaggcugaggugggaggauugcuugggcccaggaaucaaggccgcagugagcugugauugugccacuguacuacagccugggugacaaugcaagacugucucaaaagaaaaacaaaaguaaggaccagaaaaccugauauuguuuguuacacccuuuuuucucuucgauugccuacuucaagugaauauuaauuguauuuuagggaagacugacuuccacagagaccuaucuggaacuccugguuccuuaccucugcuucugucagagcagcucuggguuuugguuuguuacuauuguacacauuaggcuucuauacaagaagaacuggucccauugguuuaaaaauaaguuugaaaauccuagaaacagugagagucagaaaaaaaaacuguuuuuauauacauauucucucccccacccccuuucucuccaguugaaauauguugcagagcucuaaauuuagggaugcuuuuggcguauuucuuauacacuccagaggcacucgagauaaauuaucuucaauguuagaucucucuuagcuuugcuaguuguauuuguuaauccauuuugaguucucuagccuguguccauuuuauguguguauagaaugaggccauggagauguuguacaacugugucguuuggcagcagaguccuaaggaauugguggugacuaugggauggugguagccacuggggcugccucaaauggaaaggaaaggguucuaaguauuuauaaaagaaaauucuaguguauaacugagcaucuucuauuuaccagcacuugauacuacuaaaucgucacagcaccccgguguuauuauuaucucuguuuacaaaugaggaagcugaagcucaggucacacagguagacaggaagugauggggucagauucccagcuaggucugccuuggagcuuuccuucuugugagggugauguucaguucacucuggaacugguguagccaucgccacauuuagagugcauuuuagaguuugagccaguuuugaugauuuuacuucaacuuacugauggaacuccuuguucaucccuggaacucucuaacacuucugcugggaguuuagagggauggccacaccaagcugcuuggguacauuuucuaaaacaaaauuuauuguaagaaauggaaauuaugaacaaaauauaccacuaucucuuuuugcugugaaguuaaguuuauuggcuacuguuaacaauuuauuuacuuacuuacuuacuauucuuuuguagagacagggucuugccauguuccccaggcuggugucaaacuccuggauucaagcaauccuggugccucagccucccaaagugcugggauuacaugugugagccacuguaccuggccucaacucuuguuaaaauuaaagcaccuuaauacguuuagcaaacucaucagaccaauaaauauuuucaagauguaugcagaauuaccaguggcacauccccuuuuucuguggcuccaccccuucaacuuuuuguccaagaaaacuuuucguguuugccuguagcugaugugcaguuguuucugcucccaaaucaacaggguuuaaugaaaacccuagaaaguagaaacccgugggagagaaaagaaaaaagacaaguucacaagguauguuuaguguauaaaaaaggagaaggacuagaaagccugagauacaaaggaaaugaagaaacuaaucagugagauagagauaaagcuuuuuucugaauuuuuagcauuauuaccugauuuaguuaaccagcugcauuaauuuuaugcuccugauuugugcacaaauugaaauuuuugcuauuggauuuagguucccucucuaggaguuucucaguuguuugcacuaaguaggauauaguugcuaacuuacuuagaugaccuuuuaugaaauuuguaggugauauauuuauuucauuucuggagcagauacagcugagcagcuuagguagacuaugaagaaaguguguguguauauauacaccaacuaaaauguuaaagguaaauagccuaaaaguagcaauuuuuuuuugaaaagcaaccugaguuuucaguagaguguuauuauaaaccaagcuuuacccagagagaaauugacugaaaaacacguuuucugagauguuuuagaguuugagcuguuucucaguugauggcaugagcuauuucaggaacagaacuauauagaucuuuagacuuuuauuacuucuuauuuauuuucuucagaauacuuuuacauuugguuugaggagagucagaauucuuaucuggauucaccauguucacaucugugugcacaugacagauuucaguucugcugugguuaacuuaucugacuuguccaacagguuccuggguggagcuacccaugaacagcagcaauggcaaugauaauggcaaugggaaaaauggggggcuggaacacguaccauccucauccuccauccacaauggagacauggagaagauucuuuuggaugcacaacaugaaucaggacagaguaguuccagaggcaguucucacugugacagguaagugagacccauguuuugguggaauucaggaaacagguggguuacagggcucauucacucuaggaaaaaucuguuugcuuaaaucuucacuuagcaaaauaugccuccugauauauuguaguauaauauauauugcacagauauauauuguguuuauaugagacagcuaauugacaggugcuucagugcccacuguuuuuccccagauugucauuuuucuuacccagauuauauuguuucuagcaguuuaucaguuuaaaauucaguggcauaaaugcuaauuuauagaauuaaucugacuuucccccauuuuccuuugugucccuguguuacagaucacagacuguucuugaauuaguuaccucuguauauaugugucuucccuucuagauguugacguugcaaagggcaggggccauguuuaauuuuuauuaccuucacaguaauggugcuggcacguaguagacacucaguaaauguuugauucauaggaacugcagguugcuucacguuauagcaauauuugcacaguuggaagcaccaaccaaggucuguaaagauaguuuugaagucuccucugcuuucucaggggauguuuuguuucagaccucauuuuucuauauuugagcugaagaaacuaauuacauggauuaaggacugcuuauggugaaagaguaagaauacaacgagauauguguguggaaugaaaccaggucauuauuuuuuaguauaaacuuuucuguuuuuuuuuuuuuuuuucagaagggcuagauauuaaaugacauuuaagaaauucuuguuucagugacagcuacacuguuagcauuauggggcacuggaugaccuucugggugguuguuaacugauguuaaccauuuagaaaaugcaaaugcacgggaagcagauuaaggaaauguaaacagugacuauuuuuaggaaugcaguauggauauguuucuucuuaacauuuuuguauuuuguaaaaauuguguauauugcacauauuauuacuuaucagaagaagugaaaaaaaggagaaaugaguuaaaucauguccaacuuccugaguggcuuaugauccacuaauguugccaaggcagcgggggacugguuuguuggcucuguggcacacugugcacccccgccacccccgugucaucccugacuugucccugugcuucuuagagccugggauggcucuugucauaagcggaaccagagcagauggcucucuucugaacagcuugcccuugauuccaguagcuacagcauuagucugucuuuccgaaugaagauuuauauuuauauuauggaacuugcugauggguuucucaaguuuucugcuuguuauggccugucaacaaggcuuucacucugcguucaggugugugggccuugaucauugauaccaugguguccaugagccuguuguucacauggugcugucaaugagcagagaacagucaccugcuuaccugucuguucaucuuacuucauuuauggugcaguuuuacgugugacugaauaugccuucacccuccuaugaucauguuuaaguuuagguugccaugaggaggcauggcaaaugcuuuugaacacuuucguaccccucaucuuaugucucuccaggcccuagauuaguggucaucuuucagagaauggcuagaacucgagucuucugggauagccuacuaacacgcuuuaccauugaggagugucuucaaaacucacaucaucugaauugccaugcgucucuauaugugaaaaguaauuggaaaguguuucuuguagggggaaauguuuuaggguuguuggguaucaguccuagagcugauuuauguauauuuucaacuuaaaaauuauuccauagaaauauuuguguugccgcagggguuguuagcugggaaccccaguguguucugcuuugccuuucacccugucacagggguuuucaccuugacggcacacuagauucacccagaagcuuuuaaaaauggcagcacauggacugcaucucaagaacuucucauuuugguugacaggggcaggguagagacgucacaauauuuuaaaagcuccccagccgauucuaauaugugccaugggugaagcucuaaugcauuccaaauuguuaggaggaguaaacaguuuagagaagagguugguaccagugugaagaagcauauagaagcagagcaaugcuuccauaggauucuugacuuugucacccugacugccuugaccuggucacggcuauguaaggcugacccuuaacuugauguguagcugugaacccaacaguuaugagcacaaagauaguaaacugaggccaguaggagugcccaguucggguugacuccugugcuaguucaagacaaaaauuuccuaaauauauaugacguugguuugauacagaaccagcuuuucuguuuuccuguccccauuuaaaaaucuccuaugucaauuauacuagucuaaaagacuccuaggccuaaucugucugauaaauuucugacgaucuuauuucugagucagucucaccaacgucucuauacauuaauuaacauuauauacauacucuugauaacuuuaauaguuaauaucuauucuuuucagcaaguuaagccccaaauauuuuuuauuucuauuuuagauuuugggggaggguuuguguauguagugaaggauccccagugacuuucaguuuuuauacaagaaaucauuaauaaagcuaagaaauuaacuuagcacauucuguucaucucuuguaucaagugcaguuugugaucauguuguuuuugucuaaaaacuuauuuguaaauuuuuacaguucuaagaauguauuuugugcaaucauaaagguuuuauauuaauauauaaguuauauaauucacucugaaauaucucaaagcaaauauuucugaaauaaguaaaauagugguucucaaaguuuuuggucauuacauaccuuuacauucuuaaaaaucauuagggaccccaaaaaacuuguuuguggguuuauauauuuugauauuuacuauauuagaaauuaaaacugagaaaauauauauucauucaaaaauaauacauuuuaacauaaguagcauuuuuuagugaaaauaccuauuuucuauaaacccuccaaguuaauaagaauaguggcauuguuuuacacauuuacaaaucucuaauaccaagcuuaauagaagacagcugguucucaucuguguuugcauucuaacuguugugcuaucacacaucauguagccuuuggaaaauuccacuauacacaugggagaaugagaaugaaaaaggcaaauaaauccuacuaguauugagaaaggaacuguaaccucaaagacccucugaaagcgucuuugagaacuaccuuaugcacuuugagaacuacuggugaauuauuuaaugaugagggaacuuugagaaaaagaacucugaaguuccugaauuugaagauuauuuuaccuuuaguggacaaaagaguaaauauaagagaaugugacaguuugugucuguagauaguauuuccuuugcaaauuuaucauuuugaaggauuucauuacuacugaaaaagugcagaacauuuugggaguaagaaugcucaauuucauuuagccuuuuaauaucacauaaauuuuucuuguauaggguuaugauauauucucugauuugcuuuuucaaagccauacugcuguaacuuuuaauuuucuaauuucuaguagagacuaagucauuugacaaagugagaauuaaaacuaauagcugaauuccuucucuucuagcccuucgccacaagaagaugggcagaucauguuugauguggaaaugcacaccagcagggaccauagcucucaggugugucggggggauucugauuuacaguaaacaauuaagaaagauguaaauucucuaaguauauuuugcuaaaauaaaugugaagacuuuuaggaauaguuugaagcuauuauugaguuucugauuuuggaauuuauuuaggaugauauaguucuugucgcacuccuuuacaacuaaggauuuugggcccugucacucuaaacgaauuggaaaauucuuguccauaauaaaucaugccaauacuccaggcuaguuucuugaguguauaaguagaaaaagacugagauagaugcuuuaagaccacagaauagggaggagccaagauggcugaauaggaacagcuccggucuacagcucccagcaugagcgacgcagaagacgggugauuucugcauuuccaucugagguaccggguucaucucacuagggagugccagacagugggcgcaggccagugggugcgcgcaccgugcgcgagccgaagcagggcgaggcauugccucaccugggaagcgcaaggggucagggaguucccuuuccgagucaaagaaaggggugacggacgcaccuggaaaaucgggucacucccacccgaauauugugcuuuucagaccggcuuaaaaaacggcgcaccacgagacuauaucccacaccuggcucggaggguccuaugcccacggaaucucgcugauugcuagcacagcagucugagaucaaacugcaaggcggcagcgaggcugggggaggggcgcccgccauugcccaggcuugcuuagguaaacagagcagccgggaagcucgaacuggguggagcccaccacagcucaaggaggccugccugccucuguaggcuccaccucugggggcagggcacagacaaacaaaaagacagcaguaaccucugcagacuuaaaugucccugucugacagcuuugaagagagcagugguucucccagcacgcagcuggagaucugagaacgggcagacugccuccucaagugggucccugaccccugacccccgagcagccuaacugggaggcaccccccagcaggggcacacugacaccucacacggcaggguauuccaacagaccugcagcugaggguccugucuguuagaaggaaaacuaacaaacagaaaggacauccacaccgaaaacccaucuguacaucaccaucaucaaagaccaaaaguagauaaaaccacaaagauggggaaaaaacagaacagaaaaacuggaaacucuaaaacacagagcgccucuccuccuccaaaggaacgcaguuccucaccagcaacggaacaaagcuggauggagaaugauuuugacgagcugagagaagaaggcuucagacgaucaaauuagagugagcuacgggaggacauucaaaccaaaggcaaagaaguugaaaacugaaaaaaauuuagaagaauguauaacuagaauaaccaauacagagaagugcuuaaaggagcugauggagcugaaaaccaaggcucgagaacuacgugaagaaugcagaagccucaggagccgaugcgaucaacuggaagaaaggguaucagcaauggaagaugaaaugaaugaaaugaagcaagaagggaaguuuagagaaaaaagaauaaaaagaaaugagcaaagccuccaagaaauaugggacuaugugaaaagaccaaaucuacgucugauugguguaccugaaagugaugcggagaauggaaccaaguuggaaaacacucugcaggauauuauccaggagaacuuccccaaucuagcaaggcaggccaacguucagauucaggaaauacagagaacgccacaaagauacuccucgagaagagcaacuccaagacacauaauugucagauucaccaaaguugaaaugaaggaaaaaauguuaagggcagccagagagaaaggucggguuacccucaaagggaagcccaucagacuaacagcggaucucuuggcagaaacccuacaagccagaagagagugggggccaauauucaacauucuuaaagaaaagaauuuucaacccagaauuucauauccagccaaacuaagcuucauaagugaaggagaaauaaaauacuuuacagacaagcaaaugcugaccgauuuugucaccaccaggccugcccuaaaagagcuccugaaggaagcgcuaaacauggaaaggaacaaccgguaccagcugcugcaaaaucaugccaaaauguaaagaccaucgagacuaggaagaaacugcaucaacuaacgagcaaaaucaccagcuaacaucauaaugacaggaucaaauucacacauaacaauauuaacuuuaaauguaaguggacuaaauucugcaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagagacaaagaaggccauuacauaaugguaaagggaucaauucaacaagaggagcuaacuauccuaaauauauaugcacccaauacaggagcacccagauucauaaagcaaguccugagugaccuacaaagagacuuagacucccacacauuaauaaugggagacuuuaacaccccacugucaauauuagacagaucaacaagacagaaagucaacaaggauacccaggaauugaacucagcucugcaccaagcagaccuaauagacgucuacagaacucuccaccccaaaucaacagaauauacauuuuuuucagcaccacaccacaccuauuccaaaauugaccacauaguuggaaguaaagcucuccucagcaaauguaaaagaacagaaauuauaacaaacuaucucucagaccacagugcaaucaaacuagaacucaggauuaagaaucucacucaaagccgcucaacuacauggaaacugaacaaccugcuccugaaugacuacuggguacauaacgaaaugaaggcagaaauaaagauguucuuugaaaccaacgagaacaaagacacaacauaccagaaucucugggacgcauucaaagcaguguguagagggaaauuuauagcacuaaaugcccacaagagaaagcaggaaagauccaaaauugacacccuagcaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuuugaaaggaucaacaaaauugauagaccgcuagcaagacuaauaaagaaaaaaagagagaagaaucaaauagacaaaaaaugauacuacaaacaccucuacgcaaauaaacuagaaaaucuggaagaaauggauacauuccucgacacauacacucucccaagacuaaaccaggaagaaguugaaucucugaauagaccaauaacaggagcugaaauuguggcaauaaucaauaguuuaccaaccaagaagaguccaggaccagauggauucacagccgaauucuaccagagguacaaggaggaacugguaccauuccuucugaaacuauuccaaucaauagaaaaagagggaauccucuguaacucauuuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacacaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaggcaggagaaggaaauaaaggguauucaauuaggaaaagaggaagucaaauugucccuguuugcagaugacaugauuguuuaucuagaaaaccccauuuucucagcccaaaaucuccuuaagcugauaagcaacuucagcaaagucucaggauacaaaaucaauguacaaaaaucacaagcauuccuauacaccaacaagagacaaacagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaagaaauggaagaacauuccaugcucauggguaggaagaaucaauaucgugaaaauggccauacugcccaagauaauuuacagauucagugccauccccaucaagcuaccaaugacuuucuucacagaauuggaaaaaacuacuuuaaaguucauauggaaccaaaaaagagccugcaucgccaagucaauccuaagccaaaagaacaaagcuggaggcaucacacuaccugacuucaaacuauaccacaaggcuacaguaaccaaaacagcaugguacugguaccaaaacauagauauagaucaauggaacagaacagagcccucagaaauaacgccgcuuaccuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucauguccaaaacaccaaaagcaauggcaaccaaagccaaaauugacaaaugggaucuaauuaaacuaaagagcuucuacacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacaguuaugcagccaaaaaacacaugaaaaaaugcucaucaucacuggccaucagagaaaugcaaaucaaaaccacuaugagaugucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagguaucuagaacuagaaauaccauuugacccagccaucccauuacuggguauauacccaaaugacuauaaaucaugcugcuauaaagacacaugcacacguauguuuauugcggcauuauucacgauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggagcggggaggggggaaggauagcauugggagauauaccuaaugcuagaugacgaguuagugggugcagcacaccagcauggcacauguauacauauguaacuaaccugcacaaugugcacauguacccuaaaacuuaaauuaaaaaaaaaaaacaaaaaaaaaaaccuaccaguggagguacaaaauaaaaaaaaaaaaaaagaccacagaauaaaugaagaugaagguuguauuagaacuagacaugaagacuuuuuuuugcaucugaaaucaaagcaguggcuuuugagauaaauuuuaaauuuaucuaaauuaugcaggauuccuucaagauaaauauuguuuacuaggaguugacaauguuggaaacauagauggauauaguauuaaaaucuuacaaauguuuguguuauaagacuuaaaauaugguaaguauauaacuguggcuaaugauuuagaauacucauagccagccuuuaacuuuauugauauguaagaucaccuaaaagugucauuagaguacaaauucuugaggacgggaaccauuaucuuuuucuccuguauuuagggugcuugaaaaauguuuaaugaaccuuugaaugagucgcaacaaaaaccuuguuuugucggguucucacuauucuguguccugggcacuagaaauauuuugugugucuuagauccacccaguauucuuucuguuuccaaaggccacagaauuccucuauacuuuacuaugcucuauuuuugcuuuucucugaaaugucgaaaaucuuuggauucaacacaaauuuauuuuaugaugaugagcuuuauacuguagagaagcucacaauagcaggcugucguauauaagaugaucugacuggagcauuugaauugcuggcuuauguaugucaguuuggccacaugcaguaagcuauagcugauguagaagaaagcuuacaaagucuccauagcagaaaguguaccacggaauccaggagagaaaucgaauucuuugccguggucuuuccugaggaggauuucuucaaucuauaucaccuuuuauacagaaagcuuuaaguuuagauuagcauuuuccaaaauguguuuucaagaacauuuguucaaaggucaaauaaauggaagguaaugcagccccagguucccccacacucucaccuuaguagucgcaugaguaauucugaccaguuccugcaguaaagaaauuauaguuuaagcuggacaugguggcacuugccuguagucucagcuacuugggagguggaggugggaggaucccuugagccccacaaguuuuugaguccagccugggcaacauagcaagacucucugucucuaaaaaaaagaaaaaaagaaauggguuuaauuaaaccaaauguuucccaagcuuauuugaccuuagacuuucuuccucuucucugcauacguuuuucccuuaagaacuuaauaacuccguggagcacugugguaagugcuuuccuggcucauggaguugcagaugugcaaucaggcuuaacucaauauugaauguacauggaauucuagaguugaaugcaucuacccuggaauuccaaaggaauuuuugaaauucaggaaagaaaaugucagguuuuuggccuuugguagguuugccaguguugaucccuucucaggaccaaaucccuaaaagagcauaggcuaucaucaagaggagguacuuacuuuauguugacaaucagaucggucaguuucaacaaagggaagaguuuggaaagacagccuaaccccugugagagauaacaguugaguaggacuuaauaagggagcugucagcagguauaguuuaaacuuucaaaaaccuuugacauugccuuuuuuuaauggaagaaacaauaauuuaaaaauuaauuucuuuaggauuugggaaaauugauuuucuuccugaauaagaagaaaguuuaggguuaggaaacuuaaaaaagcaguuaaaggacuguuauuguacuugaucuuauagaauguuuuuauauguguuuauaaggacuauauauaauuuucaagcuuuucuaagaugaggaaguaaagucacuaacauuaacuagauauguucuagguacucaguuucuuuuuuuuuuuuuuuggagacagcgucucagggucuugcuuugucacccaggcuggaguguaguggugcaguuguagcucaccacagacuucgauucccggcucaagcaaucuuucugccucagucucccuaguagcugggacuacaggcucacacugccacgccuggcuacuuuuuuauuuuuuuuuuguauagacagagucucgcuauauugcccaggccguuuucaaacuccuggccucaaaugauccucccaugucggccucccaaagugcuggaauuacagacaugaguuacuacucccaccucucuuuuaauguucucaauccagugaaagcaaugauauuauccccauggaccaguggaaaaagugaggcuuuguacuaauuacuuaucuaagaucacaaagcaagucacuguuagagccaggauucaaagcaggucugagucuguggcccuuguucuuucuacugaacuaaguaaaugaauucgauugauaacaggagagcucacaaagccaugagaaugaacugaaaaaugucugcugaguuaugguauggggaaucugccuaaggcagugugcacuuaggaaaaagaccaugaaacugcuuuucggaugaucauccucaagagucucaguuuuguaucagaaaacagacuguagauuguuucuucacuugaucuuagccaaaaguccgagaagcgauauagauuauuuauugaagacauuuuugcauuguguuucugggaccaaaaaugccagcacaauguugaguguuacugaaaaaugauccaaacagaaaauauccuccauuuccugucuuguaaaacugugauuuuuaucuguacaugaaucaugguauacagcuuaauauccauauuuagaggacagagugaccuugagguaaaccagagaaggaaaacuuaagugaucagaaaacaaagaacuccaugugagagaacaggcuagaacgaucagaaucuucuuuguuuuuguuuuuuguuuuugagauggaccucacucugucaccaggcuggagugcaguggcaucggcucacugcaaccucuguuuccaggugguucugcugccucagcugcccaagaagcugggauuacaggugugcaccacaacgccuggcuaauuuuuguauuuuuaguagagacaggguuucgccgugcuggccaggcuggucucaaacuccuaaccucaagugauccguccaccucggccucccuaagugcugggauuacaggcaugagccauggugcccagccagaaucuucuuugaauagauguagguauagagagaggauuauugauuuuaaaagcacaaaucuuacguaauuagauuaaguacauuuuuaccauauucuggaauucuaagaauuggaaggcaguuuaaaaccugaaaguggcaaauuuaagauuaauaaaaggaagcacagagugguagugaaugaggaaagcuuaccacucuuauucuuaaaguauuguaaguugggaaacuuauggaguucuuuuuuguuuuguuuucuuuuuaaaacacuuguccagagauaacuuugcuucauucaacugagaaaauuccauccucaugaaaaaaaaaauuagagcgugaaaucuuacugcguuucauucugucagaaauuaugaaauauuaacuuguuaaaucuuugagcagguuuaaagaaagaucugugaggccaaagcaggaaacuaaacagaagcgaccugcaguguguugaguauagucagauauuguguguacaggaacugaugugcaaguaaauuguaacaguuuauuguuuuugauuugggaugauuucaguguuacuccaaagagccaacucaugauucugaguaaucucaauagccaauggaaggagcuuaauccuaaaugcuacauugugucauucaguggaauuugccaaguucagcagaacuagauaagauugguacuaacaagagcagcagaacgcacagggguuuuacuuugcccugucugaagcuccuuccugggguagcuguuucacagagaacuagaccugucaagagucaugugaauaugucagacucugcauuucuuagcuaccuacugaaaagaaugacagcuuuggucauucuuuugagugaauccuagucaaacaaaauaaaaugucaaaaugcuucuuaguuuugagaccccuggguuugggaucauagcaugacaucccuuaaaacugacuaugaccaggcacgguggcucacgccuguaaucucaacacuuugggaggcugaggcguguagaucacuugaggucaggaguucgagaccagccuggccaacauggugaaaccccgucucuacgaaaaauauaaaaauuugccagguguagugccaggcgccuguaaucccagcuacucuggaagcugaggcaggagaauugcuagaacccaggaggcagagguugcagugagccaaggucgcgccacugcacuccagccugggugacagagcgagacuccgucucaaaaagaaaacugaauaaauaauacugaauaaauaaauaucauuuuuaggacuuuuucauuccuuuugguucuauuaaaaggggagcuauuggaaauguuaauuguucuuggccugaaacuuuagguuauaauaagcaauuuuuaaaagucacauuuuuuauuuuauuugauaugacacauguuaaauucugacucaacuuauuauagauuauucccaaaaacuuuuggcuaacauaguuucgaaaccuuggaaaauguuuguauagcaauuuguccuaaaaauauaaucuccuuccagagaguaaacccuggugcuuaacaguagggccucucuauacaguauuccuggguuugaauacuggcccugcuauguacugguuguggaaccuuaggcaaguuauuuaaucuaugucucagucuccucaucuguaaaaugggauuuuaauaauuauuuuuauaggguuauuuguugcaaggugaaaguuaaugcauguggcugggugcagugucucacaccuguaaucccagcacuuugggaggcugaggcagggaagaucccuugagcccgggaguucaagaccaggcugggcaacauagugaaacacugucucuuuaaagaaauacaaaaauuagcugggcgugguggcacacaccuguagucccagcuacuugggagguugaggugggagaauuaauugagcccaggaguucgaggcugcaguaagcugugauugcacucuggccugggugacacaggagacccugucuccagaaaaaaaaaaaaaaugcauguaacaugcuuggaauaauauuugccccuuuaagugcucaauaaauacuauuauuuauuuccucaucacaucucucacuuauuuuuguuuuacuucucaucauuuuauuuuuagcauauccuuuuauuuccuuuuauuuuuuuaauuaugaaauuuuuuuuuuucuuuuuuuuguugagauggaaucucacucuaucacccaggcuggaguguaguggcuggaucucggcuccaccucccaggcucaagcaaccuccaccucccaggcucaagcgauucuucugccucagccucucaaguagcugggauuacaggugcccgccaccaugcccggcuaauuuuuuuuuguuuuguuuuguuuuguuuuuugaggcggagucucgcucuuucccccaggcaggaguguaguggcgcgaucucugcucacugcaagcuccgccuccuggguucacgccauucuccugccucagccucccgaguagcugggacuacaggugcccgccaucacgcccagcuaauuuuuuuguauuuuuaguagacacaggguuucacuguguuagccaggauggucucgaucuccugaccuugugauccgcucaccucggccucccaaagugcugggauuacaggcgugagccaccgcacccagcguguaaguuuuguguuuuuuuuuaguaaagacgggguuuuaccauguuggccaggcuggucuccagcuucugaccucaagugauccgccugccucagccucccaaagugcugggauuauaggcaugagccacugcacccggccuaauuacgaaaauuuuaagugcauacaagagagaauaauauaauggaccuccauguaaguauugcccagauuuaacucuuaucgagguuuuucauacuucccuuagcauuacaucccaaaguacagucuuaugcaguuccugugcugugcuuagauaucccaacagugaagcucacucagguuguucugaagauauuacauacucugaucuuacauuauuuuucagcauuuuuuagaaaagcaacauguuuguuaucuaaaauuucugagacacaaccuuaugaguuugguaucuuuucugucuagauuuuucuuuguauuaggaggaauuggucuuccuuuuuuucuuaaaguuugaauucuucuuuacagucagaagaagaaguuguagaaggagagaaggaagucgaggcuuugaagaaaagugcggacuggguaucagacugguccaguagacccgaaaacauuccacccaagugaguucucacauguuucuugucaguggacacaguugaucugcgcacgcuuacaggcaaugggccugguaauccccacgauauuuucagcaaaugacaucugccucugaauuucuuucucagggaguuccacuucagacacccuaaacguucugugucuuuaagcaugaggaaaaguggagccaugaagaaaggggguauuuucuccgcagaauuucugaagguguucauuccaucucucuuccuuucucauguuuuggcuuuggggcuaggguaaguaccggucaacuccugaaguuuuuuccauucauuuuauccucuuauuuucagauugaagaaauguaugugaaagcaguuuuuauugcuuuacuuucaauguuuuagugcaaauaaggugaacuuaaaaaagugggugcacaauuguucuacaaauaagcauuuuuaauaauaguagaguguguuuucuuauuugaaaauaagauguuuggccuggugugguggcucaugccaguaaucccagcacuuugggaggccaagauggguggaugaccugaggccaggaguucaagaccagccuggccaacauggugaaacccggucucuacuaaaaauacaaaaauuagcuggccauggugguacaugccuguggucccagcuacuugggaggcugaggcaggagaaucgcuugaacaugggaggcggaaauugcagugagccgagaucaugccacugcacuccagccugggggauagagugagacuccaucucggaaaaaaaaaaaaaaaaaagaagauguucauaauaauccccuaaaugaucaaauguaagcggacuccucugugauugauuuuucuuuuuggguuuuguuguguaauauuuaaucuugaguaauuuaugaacuaaacuaaucuuuagcauguacauuuuguggucagugcaaauaccuuuuuuucauaugggaaaauacaugauuacauugaauaguuuuuuuuaaugaaacugguagguugauuggugcuaauuuuuuccuuuuuuaacuuuguaguauuuucauuuauuuugcuaaaaucaaccucauauuuacguguaauucauuaguuucuuagccacaucuuuuaaauaaauugcuuuuuuuccuugauuuaaacaauugaggaauuacacuucugaaagauuuuaggaguuaaacaguagcuguuaauuuuuuucaagacguauguugugcucuaagcaugcccagugggucauuuucaguauaagauaugcagaagauggggucauccuuuuucuucccuuuaaggagcucagcauauuggagagagauucuuagucacgaccucagaaacuugcauacagcuuuccacacacccgucuugucucucuugggugcuugaucugcuuuugugagggcaaggacaguaaucaacaaacagcaaccuagaagggguuugugcagaaggggacugugugacuguugcguggggguugauguggggcagguguaggaguuuaauacauugcugccuauacagcaguucauugcccuuaagcgauuggugucuauaccuugccgucucucuuucagucaucuucagauuguuugucuuggcuguaaguauaacuauugcuauagaugaauguaaaaagaguguuuaaaaaguucguugcuuuaauugcacuggaggugaagcuaguuacauacuuuccuuaacuucccuucugcuuuugcuguugaagaggccaaauacuuucuuggcaugaaaaaguauuauaaggccccuaauccuuaggaguuauuaguaagagcugucuuuaaagcacuggcagcuuuuaagguuuuuuuuuucuuuuguccuacauagagcaccagaauaauuucacauauuacuauauuuuugugucugaaaugucaguagaaccuucuguccaccaaagaggaacaucuugaaggaguugggcugcuuuauuuacucuguggagggaucuguucucucuggcuuuacuuugucuaaucacuaccccuuugcugucgagccccgauauuuaaugaguaaacaaacucauauaaaaccaguuuggccgggcuggugacugguuuuaagaaagucagugaugauuucacgguguuuggggagcgguacccacaaaccuuuagagccuuuuacaaagacugaagaguuuuaaguagaguucaaccuguggacaagcugguauagaacuguugaaacaggugaaacaugaugcuucugcuuccuuucagcaucuauauuggaaagcgacugagcacacccucugccagcaccuacugagggaaaggaaaagccccuggaaaugcgugugaccugugaagugguguauugucacaguagcuuauuugaacuugagaccauuguaagcaugacccaaccuaccacccuguuuuuacauauccaauuccaguaacucucaaauucaauauuuuauucaaacucuguugaggcauuuuacuaaccuuauacccuuuuuggccugaagacauuuuagaauuuccuaacagaguuuacuguuguuuagaaauuugcaagggcuucuuuuccgcaaaugccaccagcagauuauaauuuugucagcaaugcuauuaucucuaauuagugccaccagacuagaccuguaucauucaugguauaaauuuuacucuugcaacauaacuaccaucucucucuuaaaacgagaucagguuagcaaaugauguaaaagaagcuuuauugucuaguuguuuuuuuucccccaagacaaaggcaaguuucccuaaguuugaguugauaguuauuaaaaagaaaacaaaacaaaaaaaaaaggcaaggcacaacaaaaaaauauccugggcaauaaaaaaaauauuuuaaaccagcuuuggagccacuuuuuugucuaagccuccuaauagcgucuuuuaauuuauaggaggcaaacuguauaaaugauagguaugaaauagaauaagaaguaaaauacaucagcagauuuucauacuaguauguuguaaugcugucuuuucuaugguguagaaucuuucuuucugauaaggaacgucucaggcuuagaaauauaugaaauugcuuuuugagauuuuugcguguguguuugauauuuuuuacgauaauuagcugcaugugaauuuuucaugaccuucuuuacauuuuuuauuuuuuauuucuuuauuuuuuuuucucuaagaagaggcuuuggaaugaguuccaauuugugauguuaauacaggcuucuuguuuuaggaagcaucaccuauacucugaagccuuuaaacucugaagagaauuguuucagaguuauuccaagcacuugugcaacuuggaaaaacagacuuggguugugggaacaguugacagcguucugaaaagaugccauuuguuuccuucugaucucucacugaauaauguuuacuguacagucuucccaaggugauuccugcgacugcaggcacuggucauuuucucauguagcugucuuuucaguuaugguaaacucuuaaaguucagaacacucaacagauuccuucagugauauacuuguucguucauuucuaaaaugugaagcuuuaggaccaaauuguuagaaagcaucaggaugaccaguuaucucgaguagauuuucuuggauuucagaacaucuagcaugacucugaaggauaccacauguuuuauauauaaauaauuacuguuuaugauauagacauugauauugacuauuuagagaaccguuguuaauuuuaaaacuagcaaucuauaaagugcaccaggucaacuugaauaaaaacacuaugacagacagguuugccaguuugcagaaacuaacucuuuucucacaucaacauuuguaaaauugauguguuauaguggaaaauaacauauagauuaaacaaaauuuuuaucuuuuuucaagaauauagcuggcuaucuuuaagaaagaugauauauccuaguuuugaaaguaauuuucuuuuuucuuucuagcauuugaugucuaaauaauuuuggacaucuuuuuccuagaccauguuucugucuuacucuuaaaccugguaacacuugauuugccuucuauaaccuauuuauuucaaguguucauauuugaauuucuuugggaagaaaguaaaucugauggcucacugauuuuugaaaagccugaauaaaauuggaaagacuggaaaguuaggagaacugacuagcuaaacugcuacaguaugcaauuucuauuacaauugguauuacaggggggaaaaguaaaauuacacuuuaccugaaagugacuucuuacagcuagugcauugugcucuuuccaaguucagcagcaguucuaucaguggugccacugaaacuggguauauuuaugauuucuuucagcguuaaaaagaaacauaguguugcccuuuuucuuaaagcaucagugaaauuauggaaaauuacuuaaaacgugaauacaucaucacaguagaauuuauuaugagagcauguaguauguaucuguagcccuaacacaugggaugaacguuuuacugcuacacccagauuuguguugaacgaaaacauugugguuuggaaaggagaauucaacaauuaauaguugaaauugugagguuaauguuuaaaaagcuuuacaccuguuuacaauuuggggacaaaaaggcaggcuucauuuuucauauguuugaugaaaacuggcucaagauguuuguaaauagaaucaagagcaaaacugcacaaacuugcacauuggaaagugcaacaaguucccgugauugcaguaaaaauauuuacuauucuaaaaaaaugagaauugaagacuuagccagucagauaaguuuuuucaugaacccguuguggaaauuauuggaauuaacugagccaaagugauuaugcauucuucaucuauuuuaguuagcacuuuguaucguuauauacaguuuacaauacauguauaacuuguagcuauaaacauuuugugccauuaaagcucucacaaaacuuuuccugucag

SEQ ID NO: 17635 - RNA, 655 nt, Homo sapiens
uuguguugacugugguaccccgaccccagagcucuggcuugguccucccuguuggacuggaaggggcgggagagccauacagggcgauugggaaauggaucggguggcuaguaaaagccaaguaagacaggaguguccaaaggaagaaggggguagggagggaaauuuguagggaugagauucacugcccuguuucaacucggcaauucucuguuacaugcagguuuuacggagaauuucggucccagcaaaaacugaucaccuggagucuucuacggucucucuuuauaaaucucuccgaaccucaagcaacucccccccacccccuucgucuggggucugcgcccagcggggccaaagccuugaguuccuuggcagagaguguggaacagccgugagcccuucaagacaugccuaugagcccggugauuuuuuuuucaagggggcuuugaucagcuguaccuccacguugccccggaaaggugcgcagggcacccggagaggccucuggucagcagugggccugggccaagccccaacaguuuaccccucaggcucagguuggcugggguuaaagggcaaagucagggucgagggcaccagcuuuucucggcgguaacagcugccacccaaauuaugcccccucaggaagcga

SEQ ID NO: 17636 - RNA, 12811 nt, Homo sapiens
guuuaugucguuuuccuuguuaccauuguuggagucauugguuuuuggaaaaccagguuggaacaugcuggggaaagcauccuucccaggccuaucccucuugucuuucucuugccaacacaguccuccaacaggcagaagcaaccuggugcuucugugagggaccuggagaacuuugccugaggcuuugcaucuucuuagcuccuucccaccuccuccagcugcugccugugccacaggcgccuucuccucugccgcucugaugaacaacaaggugcaguuccacuuucugcugucauuucucauggguggaugccaucaaucuugucuucuguguucuaaugaaccuauagcccccaaccacucccaacaucaaaauauguccuacagguuagaauuuuggugcuacuucugauuucucuuugacuguuccuuccugugcccaaggccucucagaauuccuuaacugaccuuuccaugguacucaguuccaugccagaauggacugccauacuaggaaaccuuucuucuguucucuguuggaagaucaaaucuaugccaugcccucucuucauuugaucucuucuuccacucucugacauuccuacuuaaaacaguaaaaacaaaaacaaagaauuaagaaagaguagggaagcuauccaugcaaauuagcacaggcucacaaacuuggggggccuugggccaugauucaacauagaagaaaaauuuagccugacacauaagcguuuccuuaggcgucuggacaaccucuucccucaucaacaagccaacccugccgagucuaaagaaggggucaguuuuguaaaaaccuuauuauacaggaagacauuucuauucaguuucccugcaaaggcagagguaaguuucccagaagagcuaguuaauuucuuugcucaccuccugcacacucagugaauuccaugaagugauagauucuugggccuccgcccacacauacagguauaaggacaauggauagaagaaccaguugcuuuaaguucuuaaaaauaagaaaaugaagacaccacagcaucgcuucauaggcgguuuuugugccuuaugccauagaaaucuguauguccuggauuuucuaggacaacuccaauuucagcuauauuuauacuugucaagucauaauuucuuauuauuggcuaacaaaauaugaucaccuugguuacaggugagccuguguuaugugagguuauugucauaacuaauuuuucuuggauggcgucaaacaugacugaguucuaccaaaguguauacuaaaugagucauauuauugagaugauacagugcaguuaccaggugguucugcuaauaauuagaaacacauuucuauauuucauaggaccaaggaaaggaaaacaucaccaggaaaauguuacauguggggacaauuauucuauaggcccuuggcugggauuuguggauaugaacauaauucagagguaaaagugaaauaccagaauaauacauggagauuucuucuauuggugcagaacuacagaauacaggaaucaacaugcagccaagucuugaguauucaaggaaugaugacccaauuugucgauuacuaagacuuuuccucccuuuuccuauucucacaguucagugauccucaaauuugaguaauauauuuccaaauuaagaauuuagaauuaagaaaaaaaauuuuaaaccuuuaaaaggcugugguguuucuuaaauuauuuguaaauuauuuggaauuauauuaaaauuugcacaaagcuaaaauuuaagauucgauucauaugcuuuuauauaugcuuguuuuaauaaaaauaauucacaaaguaaaaaccaucaaaaccacaaaaucaguaaguucaauauuaacaacauuaauuuacagugauggaugauguuuugcugaaacaacaugggaaaguguaauuuucgcaugugaucaggagcagaggagaaccaaauauuggaaaucaguguuggagauccacaacuuccagcuccuccacuagcacguaaugcuuuuuucucaggggucugucagccccagcuuggggaacacugcuuuugccauuuauguagaauugauuuucuucuucuaagaucugccagggaaagaagacaaugugaaaccaaaauccaccagauacccuuguuguugcuaaagggaauuuagggcuguuuguagguuucaauuagauaaaguuuugaccuccuuucugguuucucauuaccauggcuauuagagcagugguccccaaucccuaggccauggacugguaccaauccauggccuguuaggaacagggccacacagcuggaggugagcggcaggugagcaaguaaagcuucaccuguauuuacagccgcucccaucucuugcauugcugccugagcuccgucuccugucagaucagcgacaacauuagauucucaaaggagcacaaaccuuauugugaacugcaaaugugagggaucuaguuuggguguuccuuaugagaaucuaaugccugaugaucugucccugucuccaucacccccagaugggaccaucugguugcagggaaacaagcucagagcuccuacugauucuauauuauggugaguuguauaauuauuucauuauauacuauuaauacaauguaauaauaauagaaauaaagugcacaauaaguguaaugcgcuugaaucauccaaaaccaucccccucuucugguccguggaaaaacugccuuccacaaaacugguccuuggugccauaaagguuagggaucacuguguuagagcauuauccaucaauugccucuucaggauugcccuccuacugcauuggacuggcuauagcacagcaggcagacacaugccuuuuccagagacucccacauugauuuuugaaugacacgaacacauccauuaggccugccuuacauuguaaguggauccacuugaaggagcagccaacucauguauugugauguaaauggugcuguucugcacucagcacuuucaucuucuaaguguuucacaaacacugcuaauuaauaguccucuuuucugugcugccagggaggaguuguaaggaaagaaugauggguggcuuuccagauaaacacauguuaauuuuuaucucaggcuaaggggaaagaaacaaacauauagagccaaacacuuacugugucugccacuaugacauugauuauuguauuuaaaccucacaacaaucuuggcaggcaaagaaucuuggcauaaaggucuucuuaucaccauuuuuacagauggugaaacugcagcuuguaaggauaauuauagugagggauggaggcaggauuugaacucaugucuggugguuuccaaugcuaacacucauucugcuacuccacagggcaaagaguggaaguuuagcauuuccaauguauuagucauuaucauuauuauaaacaaguauuauuaauguuuaaugaccauaauacuucaaauuuauguagcccuaaucuuugagacacuuagaguucuaugcaacuauucugcucuugcucaguucaaaagugguaauauuuggauuuuguauuagaagucauuuuggucucauucuuguuuuaagagcaauuuuucauggguucaaacucuuggacuugugaaaaucugggauugaaaacaauguuugcuuuguccucaaaaguaguagccaugacauaccagauguucuaaucucugauaagaaaauucuuguuaaauuuuaauggaagaaaauggacuggcgguuaggacacauccuuuacucuuuuuuuuuuuuuuuuuuuuuuuuccuauuaucacuuacaaagaccugggacuaugguuucuccuggcuguaccacucacuuccaagcacacugagaccuugggaacuaauuccuggguaugcggcccauuguucuaaccuaauuuuuacuguuggaucaaaguauauccauggccaaauaaugguccuauugcuagucacucuuuuguccacaaaugaacuggagugaaacccguaucuugacugcuuuccuuuuuagcacccaucagauaagcaacccgggcuguugagaggacgauguuaacugacccccaaggcaggaccaggugcugaaguccugcucuuucaaagaugaugaaccagagaauacugugucacugcuuguuccauuccugugcugguacuggcaagugggaaagcugggauucaaauccaagucugugucuccaaaaguccauguugaagcuguucuuguugcugaauuuaaugaaccucuaacacauguagguauuuuacauuuucaauaaauuguuaauuuuuuauggagugccugcuuuucucaaguauuauacuaugcuaggugcuaggaauauaguagugaaugaaacagccagaaaaauacauucaaacuucauugagcuuacagucuuuaaaguacauauauuuuuaaauuuaauccuaauaacuauuuguguguaugcauguaguuauauguauacacacauaugcauguaucuacguauacauauaugccuguguaguuguccuuguccuuguuuuacacuugagaagaauaaugcagugauuuauucaggauugcauagcuaaggauuguagaacuugaauuugaauccagaucucugaauccuagauauuuccacauuaugacacugucuucuguucaugaaaugaauggaaaauaggguuuugcuguaaaaggugggcucaguuuuagggaaauaaccaaaaaaccaucuccuucaauacucccaauggugugacaguucgugugcccuucaacagauuuccaagagucaggcaaugaauuccuuucuguguauuauucaucauaauaaacuucagcuggaugaucacuuuuauuuguuauuugggaaauugccuguguuuuauuaucuguauuuggcaggauccaauggagaaagugauccaauggaaaggauccaauggagaaagugucacugagcugggccgcagagcugguuaucaaggguagucuacgaagucagagguaagcuugacacauggugguagaaugaaguucacggugcuguguaguugucccuuuuucuugaauuaccguggggcugacauccagacuaaagugcuauucuaugaccuuucuaccaguucccucucagaaucacucaaaagaaaauagagaaaugagaaagagaggcgugaauuuauuuuuugaugaaacuaggaaaacagguuaccccaaaucacaauguaugagaaagggguggcaauggcugugaaaauuaaacaggaauguggagagacugagaaaggcugcuucagcugcugacgucagagaaagcuggggggaaagaguaggacuaucucgaaggcccaaaccagcagccucuuguuuguaacgacugggaugagcauggaaucugacugcagacguuaucucuggaccucaucuggcagagagaugaagcucaguaggcagaacugaaugaggaaaucacccaaacaagccauagauguaagaagcggccaguuggcaaggaagaguggucuggcaggugcgguggcucacaccuauaaucucagcacucugggaggccgaggaggaucacuugaggccaggaguucgagaccagccuggccaacauggcaaacccugucccuauuaaaaaauauaaaaauuaggcagauguggugaugcaugccuguaaucccagcuaccugagaggcugaggcaugagacucacuugaacccaggagguagagguugcaguggcccgagaucacaccacugcacuccagccugggugacagaacaagacuccuucucaaaaaaaaaaaaaaacacgcacgcucucucucucucucucucucucucucucucucucucucucucucucucucucacauacacacacacacacacacacacaugcauguacacacguaagaauucugaaauaagaauuuuuguuaucuaauacauagcccugacccuccccucccaaacuucuggcaaauagcugguccaggaaaaauucacuucaaucaaagauaaaugcugucaaaaagguaucagaauaugauauauaugcauacacuaugggagaggggaaagaaaaaggaaaggaaaacaauggauaguugauggauagucaccagaaagaaaaagguucucauggagcuggugguaauucugaucaagcucauugccuuaaucauuuuaaaaaccaauauuucuaugaaacaauagcucaaugcagagaugcagcaguucuaugaaaaugggcaacacaauaaaaccgaugaaauauaaccuggcacaacucaugaaaauagugaaagaaaaaauaaaagccacugagaaauuagaaggaacacaaaggcagacaagagugagaaaggcaagcaaacagcaugcauuuagagaggaugugacggacacaaaugauggagacuagagagucucacuugugucuuuagaaagaccagaaaaggggaccagaaggaccagaaugaaggaacagagaauauauuuuaacaucguaauuaaaguuuccagaaauaaaagacuacuugaaucuacacauugaaagggaacacugggaaaaaaaugacucaggacaaucaacauccagcuauauccugguaaagggacuggcuucccauagaaagccucuggggcugacagacaaaaagaucaagucacuuguaaauaaagagaccaugagcuagucucaauuugcaucuguuuuccagccauaauuauguauuguguuucccucacucucaaaagugucaugacuuacacaaaaaaauuauaggauugccuugcuuaaauaaguaaaauaauagaggagaagaaagucauggcuuuagacaucgccacagcaacacagcaaauaaacaaaaacuccuaugaauccucaaaguauaacccccccaauuuuagauuuaauacuuaaccaauagccacucaaauagaaauaaucucuuuuuggugugcaugaaccaaggagcauaauucuccuaaguccuucuugauuaaacugcuagaaaacaaccuucagugaaccaagaaggaagaggaggaugugugccaggugugucccaauuuaaaauaauuuccuuccaaccuucccaagauauccccccucugcacucccuacuucaguuaaugauaucccgaaaucugauugucuaacuggcaaacugggauuuauccuagucaccucauucucuucauuccaacacuucacuagucgauaacuccugucaaacuguaaaacguucucuaaaaucuuuccuccgcuuuccaucucuauugucaugccuuguucaaauaugagucauuuguguuuagacuauuucaauaguaucuuaauugcaggagcaauuuuaaaacauuucacaacuggugccacacagaugcugagcaauuagaaaggacaccagucauaaacaauagcccagaacacuggugcucaucagcugucuuuggucuuugccuaauuggucuccuugcuucuaauaucuacauucuccaauccaucacauuguaguuauuaugauuuaucuaaagucuaaaguugaucaugucauucuguaaguuucuuugaguuccauuaccugcaguauagaucaguguaugaagucuaaagucuuuggcauugagaacagucuuuuaggacauaguccccaccuaauucuuaaaguuucaaaucuaaacacucucacauucagugcccaacagccacucuggacuucuugccauuugguaaaugcaccaaagacucuuugagauucaagugugugguuaacauuguccuaccuggagcaggaauggaauguacauuucucuaaaagauccagauucugguucuagaaucacauccgagugagagaauccacaugggauaaguuccagggcugagcaaccucuccaacaggcgaccagccagagguugcuuccuccucauuuccuucccauuuugaguuuucucuguuaaacauccagccacauuacauuauagacacacuucauaauuuuuuugauuaguugacugacaagagagucccuaaggaguggauucugccagugaugccauuuucugucguuuguaacaaaucaguggccucucccacaugacaaggcagggccaccucugggaguccgaacugagucugcugguucacucauccaacaagcauguugagaaccucggucacuuaugggguugagaccgauauggucccuguccuuaugagcuuucugucuaaaguggagggagacagccagcaggaaacaaacaaaugaaugcaaagugugaaaagggcacaaacagaguuuaauuacggagaauaagaaggggaaucugcaucuuagguggucaccagaggccucccucaguaggugauauuuaaacugcggccugaaggaugagaaggcaacagcuaugcacagaucaaaggggagaauauccuacuaggcagagagcuaguuuucauugagaaaagcaaaaacacagugacuuuuucaguguuuagaagcaggauugcauccacuuaugugaggagggcaaugcgugugguuugaagauaucuguacccuccuagagagaaaugaaauaauccaauuuuaauuacacuugugaauacucugguugaaaaaucacauguaggaucccguucuccuaagugugcuuugugaauuucccuuugcaugucuuuauguuauccuucccaucuggacugcucgcuacuaaccuccucuacugcaaaauuccugcugcucuuuggagcccugguccagcccugccucccucaaaggaacccucucugacagcuccaauccucugucugggugucuucuccgagcuucugcacccucucuaucuuccugagugagcuaucgucugcguauuauuuucuuccaugaguacacgucucacuccuuuccuacgauuuaaggagagacaucaagucuuuguguucuagccugcgauucuucacccagugucugacggcucaagauguaacauuugcucaacaagcaauuucaaaucaggggagacugcccaccuaccucaggaauacuauauagccaaaauccaacagagcaaacaggauucuuucaguuuugagggguuuuuuuaugaaugaauuugaacagauggauauauagaugaauauauacagaaaaaugaacaaaagucaugcucuccuuuaagggaguaacuuaguacacauuccauguaaacaaaaucuauaguaagauuuccucaaauagaacucagggaccagcaguuaugagaaaauugccaacauuaagaacaaauuccaaacuaccacuccaaaaaaauaaaaaauaaaaagcaaagguccacucauuuuuacaguacaaaaauuuuauuuuuuuguuaggauaauuuaaaguuuaaaacugaaguagacauauucauuuuacaaacaagauauucuuuaaguaagaccauuaaaaacaguaaacaaaaaagcugucuuuacaaaaagcucugugcauagcaacuuuauacuguauauaacugacaaagcaaaacaauaaaaugaaacuauacagugugaaaaugaaaccuuacuguacaaaagguagagaaguuaaugguuuuuaaaccaugcauauugaaaugugcaaagaaaaacugagaagaauuacaacgcuauaacaaaagaaagauaaauaaugaaguaaauugucccuuuaaaugaaaaaaaucuuacacagcuccucuuacaaacacaggauagaguuuguaguuaccaauagaaauacucauauuccaaguggcacaaaaauaacuugggacuggaaugauugaauagcaaugacuaacgaggacaggguagcuuuguuuuuaauuuauuaguacacuaaaaauaauccuuacacacauuuguacaauuaaauagcucuguugcugccaggguucuagcugaauggucaagaugucugguauuuaguuacacgcauuuuucgguguaaagcuaccaagaaauucuacaaucauuuugaagacaguacugcacucaucuucaugcaaaaggaaaauucacagguucuaaaagcaaugcuacuuaaaaaaaacaaaauuuccuuauguuggauuggcucaaauccagggcuaaacaugcuuaauuuugcucugccuucacuuuuggaagguaacauucauauuccacacauucuuccccuuccaucaaucagguuucucacugggggacuuuuucucuuauguuuccguguauuuuggcgcuuuaagcccugacuaugagggacugucagcaguaguuauaagcaugccagguuucuaaaaccuuggauucucaugugcauagaaauaauauaagucauacuggguaauuccagaauggguuaaaggcaaauaagacaguuggggcuggauagaugugggccugcaucaaugggucaaagagaagguaugcagaauuaaugaaaucaucuaaaauuggcucagaugcacucaugauguuuuuccaugagugcugcaucuauuucuaaugcugaaaucccaaccaagaaccccaaacuaagucuguguauagacucuauuguggugcucaugagucaauaaggagaaccccaacguggaaacaagugacaucuuuauuggcaaucccaauaugccuggauaugucucuaggauuacauaagcuuucaagaaucaaccacuguuagcagcuaaggcaagguucuuccccucuaagagcuagucacaaaacgaugaagagcccaucaaagggcuggguaacugugcugcauagaacgcagaugccccuaaucucuggaucucccaagaaucuggucuugccuuucuucgaacaucagaagaggggauuagggcuuuuaauaucccucucccacauuccgucucauucuugacuagaaacugucgaguggcauagcuauguuuuucaagagaguuuaaugccauaaaaggggaaauugacagggagaggaaaggacuuggauguucuaagacugacucuaaagaguccaucaaacagaguuaucuucuccaaaccguguugcugaaguucuauggggcuguguaccucuguacugaaccaggcacccaaagcggagggaguggugggguucuggugaggaggaauucccaaggggucccuugguuaagaaagucugugguuuuggcucugcuagaaggugaggugcuucuuuccuugggaugcugaaagccugagacagacucaaacaugggaauucucuggacugcucaggggagaacguugaaagcuaauaauaggaauuuuaaaaaguauucacaagaguguggacuauuuagaaaucagacggagcugggaaugaauugauggguuggaguauuugugcaugugcuagagugucuguuucugcauuaggguguucugugggaaucuacauguucuugcccuugggucaauaaagugauggaaaaggagggggugcaggacaggggauaagaaucuaguaaguaacugcaguaauaaucacacaccuuuaaaacuuguuacuacauguuugcaucauuuucauuuuacaucaggaagagaaaucccucucucuuccaaaaaaaggucuuaauuucuaccucuacuuacaauaaguuacacauuuauuuauuuaaauaauuguaaaacauuuuaaaauuuuucccuuuuuuuguucauuuuuuaaagagauuaagcuauaagcaaacacacauacaacauuucaucauucaauucagguugcguuuuaagaaagucuuccgugcugguacccuguuuuguucaauuuuuuucugcauaaacuaaauugguaucugaaaggcuucauagaaaauagaaacuuucaacuuuuuuuuccuacaaagaaaaacaaauaguauccaaaauauuaagcauuaauuguuugccaauuuuuucuuaaauauuuuacaaacauaggaaggugguuuucauaauguucauaacaaagaauugcauuucugcucuuagcacugacuacgucaaugacaucuuuuguccuugucccaagagggucaguuuguguagccaccaucagagcuauaggaggacgugggaccaaguaagaugcuggcuccuugcagacccaaggguguccaucauguucaugugggggcaccacuacacccccaaaagagcuccuagugcuuucuucauuauugguccaucagaguaaguaguuuugugcuauaagaaagcaguucuucuuuacaucggggguacaacaaguccggucauggcugcaaggaaagaguggcacaggaaugagacuuggggacuuuuuauguucaaggcuaugacacagaaugaggggcaggggaugggaaugauagagucugaugcuauucaaggagauggugcccucagcugauaugaggaccuguucuccagguuuggucuagcagacagcccauuaaaggcacugaagccuuauggaaucacugaaguacaaggaaaccuugaugaaguuuugccugggaggccaggaguuauguuuuguuuuauauggguuguauaaaugagacaacagauguaaacauguaaacuaaacuguaauauaugcauauuuuuuuauucaacuaagauaauuuccagauuauacugcuccaaaucacuuaguuggaacaggaaaggaaauuccaggugcugagccuguugauuuacuagggcaucguugauaacaaaucaagcuuuuuaucuauccuucacuucuuuggugagugcauuuuuuuuuuaauu

SEQ ID NO: 17637 - RNA, 2399 nt, Homo sapiens
ccuaaaaaaaaaaaaaaaaaucugaaaaaucaaagcaaguuagaugcaguuuuaucuaccaggucucauuuguacaagauguguaaaacauuaauaauuucuguauuuggucauucuuguuuuuuguuuuguuuuguuuuuuguuguuguuguuuucccauuuguuuucauucaugguuaaaucaaaagcuuggcuucaaaaugguuuuuuuuccugccauguuuuuucguugcaguaacuaacccuuguucuuccaucauguuucuguuccuguagauucuuguuuguuccagaagauggcagcacaaccucugaaguuuuuccuucucugugcauaaccuaauggcuguugccuguguggcccccuauuuuuacuuuuuucuuacauaaguaguauguaucaauugaaaaacacagaacuguacggaauuuaaaaguggaaauauggcaucuaucuuccuugcauuccacgcaggugucauccagccacacccuccucucugcagcucucucugcaagcacuuaacaccuggcaugcaccuuccagaccuuucuuguauaaacaugcaugcaucguuuuguuguuuucuaacaggaucacuauaugugccauucuaccacuugguuuuuuuaauucaacaaaaugccaugaguauccuuuagucuuuuuauggacagcccuagugcugcuacuucagucuuuuuuaaccccuucauauaccuugaacaucuguaaugaagguggucaucuccuuacuaauggaugaaugucaguuaucuccagcuuuugcaauuauagcaguaaauguagcaaauacaaagccauauugggcuuguugaaaauaucuguaagauaaauuccuugaaauuaaaaugauuacguucucuucuguggaucuuagcuggcacauuccccuuacacacauuuuggcauccuugccuucuuucugccucucauuuucuguuccuacuacuuaaugccauuuugcuuccaucuucugucacuacugccucuacuuccacuuaagcugcagaauugagggugggccuuagaccugguauguggaggagagaaugauuaauuauaccugguucaugcuuuagauugaaagagcuaccuuucaaagucaaguuuauugagguauaauuaaccuacggugaaguucgcguuuuuaaagcauccagaauuuuggcaaauuuauacagccauguaaccagugccacaaucaaguaauaggacauuucugucaccccaaaauuccucccaccucuuuguagucaauuuucuaccugccaaccccgggucuucacaacugcucaucugauuucuaguguuacaguucugucuucuccagaaugucauacaaaugagaucauauaauauauaccccuuugugucuuuagcuuagcguaaugcuuuugagauucacccaugcuugcaugcuguaaguaguugauacuuguuuauugcugauacuuguuuauuccauuuuauagauguaccaaaacuuguuuaucaguuuaccacuugauggauauuucgauuauuucugguuuggggcuaaugugaauaaagcugcuguaacaauucacauauggaucauuuuuuauagucacauguuuucauuuaucuugcauaaauaucuagugguaggguuccugggcuguauggugguaguauuaauauauguuuaccuuuuuaggaaacugcuaaacuuuuccauaguggcugcaugauuuugcauuuccacuggcaacacguuuuguuuguuccacaucuucaccagccucugguauuguuagccuuuuuucauuguagccauucuaggaugugugcaguaguuucucauggguuuugauuuauuucucuaaugacuaaugauauugaacaucuuuccuaugcuuauuugccaucuuuauaucuuccuuguugugaugucuauccaaauuucuugcccacguuuguuguugcuguuauugucuuacuguuauugaguuaaaagaaucuguacauuuggauacacauccuuuauuggauaugucucuuaaaauauuuuuucccauucuguggcuugucuuuuuauuugcuuagcagugucuuuugaagaacagauuuucauuuugaugaaguccaguuuaccuuguuuuuacuuuaaugguucaugcuuuuuguguccuagcuaagaaaucuuugucuaacucaaaggcacaaagauuuucuccuguguauucuuccaguucuauaguuuuagcucucacuuaaguguuagauccacauuaauuuucuugugugagaugaagguggguuauuuauuuuuaauggaaaucauucaacaccauuuguugaaaagauuaaccauuucucauugaauuacauuggcaccucuguuaaaauuau

SEQ ID NO: 17638 - RNA, 925 nt, Homo sapiens
cucccuucccauuaagagaggaucuucuccgguagccuuugaacugggaaguggcuuuaguauuugcaaguguagauauacaaaagcucuuccuccucuuaccagguucaucggaagaaccagcagcagggcccuggcuguuuucuggaucugagacgggaggugccaucugcgguuuuugucuggaggacacaguuucuuuuaugggagacauacuuucaaauccacugcugucaaauguacauauuguucuucuuuuggcuuuuugggaaguggaaggaaguggaagugaaauccauacaagaccuucguuuucuaaauccuucuguagccucgugcuacgucgcacuuugguuucacuauuucuccucugaaagguuugcucaauggcaucagacaaaucuuuaaacaguucagaauuuucuaaacuaauuucuacagagcugcccacacuggaggauggugugugauuuccauuuuuuuccaaauguaaacuucgaccaucagaauaacacauggaacgucuucuaucuuuccugucucugcaacucacaacacugcuacuuuccauggguuuucuucccaaauccucacucuggcuuuuagauucuuucguauuuucaauuaagacaucuccuaaacaaugacagucuuuuugugaauuaggcauuaaacgauugcauugcaguuuuccuucugcagcuccuaagaagucauccuuucuuucacacuuuauguuuaaaucuggugaaauuuuaaagaacugacaaagguuuucugcauuuugaccaccagcagaaaauucuugacccugcugcagggucagagcagguuugggacuaucugaugccacacguucuucaguuacagaagcacaagaaacaggacugucaguuccagcuuuugguucauuuucacuuucuga

SEQ ID NO: 17639 - RNA, 925 nt, Homo sapiens
ucagaaagugaaaaugaaccaaaagcuggaacugacaguccuguuucuugugcuucuguaacugaagaacguguggcaucagauagucccaaaccugcucugacccugcagcagggucaagaauuuucugcugguggucaaaaugcagaaaaccuuugucaguucuuuaaaauuucaccagauuuaaacauaaagugugaaagaaaggaugacuucuuaggagcugcagaaggaaaacugcaaugcaaucguuuaaugccuaauucacaaaaagacugucauuguuuaggagaugucuuaauugaaaauacgaaagaaucuaaaagccagagugaggauuugggaagaaaacccauggaaaguagcaguguugugaguugcagagacaggaaagauagaagacguuccauguguuauucugauggucgaaguuuacauuuggaaaaaaauggaaaucacacaccauccuccagugugggcagcucuguagaaauuaguuuagaaaauucugaacuguuuaaagauuugucugaugccauugagcaaaccuuucagaggagaaauagugaaaccaaagugcgacguagcacgaggcuacagaaggauuuagaaaacgaaggucuuguauggauuucacuuccacuuccuuccacuucccaaaaagccaaaagaagaacaauauguacauuugacagcaguggauuugaaaguaugucucccauaaaagaaacuguguccuccagacaaaaaccgcagauggcaccucccgucucagauccagaaaacagccagggcccugcugcugguucuuccgaugaaccugguaagaggaggaagagcuuuuguauaucuacacuugcaaauacuaaagccacuucccaguucaaaggcuaccggagaagauccucucuuaaugggaagggag

SEQ ID NO: 17640 - RNA, 323 nt, Homo sapiens
ggcggcaggugccauguccggccacgaagguggcaagaagaagccaccgaaacagcccaagaagcaggccaaggagauggacgaggaagacaaggcuuucaagcagaaacaaaaagaggagcagaagaaacucgaggagcuaaaagcgaaggccgcggggaaggggcccuuggccacagguggaauuaagaaaucuggcgaaaagcaagcuguuccuugugccugaggagauggugacccuuuauuucauccguauuuaaacuucucuauucccugccauaacaucuuuugccccguauagcuggaauaaaguguuaucuugg

SEQ ID NO: 17641 - RNA, 12793 nt, Homo sapiens
accagcaacaacaacaaaaaaaaauccucaucaaauccucaccuaagcuuucaguguauccagauccacaucuucacucaagccaggagagggaaagaggaaaggggggcaggaaaaaaaaaaaacccaacaacuuagcggaaacuucucagagaaugcuccaaaacucagcagugcuucuggugcuggugaucagugcuucugcaacccaugaggcggagcagaaugacucugugagccccaggaaaucccgaguggcggcucaaaacucagguaagcagcaaacccaagagcgguuucucccccaaagagcuguccucauuugccucucccuuuugcaacugugucugugacggcugaucuugauaauaaaugugcuucaugccugauggcaauaaacugccaguguaauccaauagccuuaggcaguggagcuccuuuguuuaauaaauugcaugcaacuaaacgaagaagcuggacgcucugcugaggguauuucauugcauaagccuagccugauugccugaaaucuggcacguacccucuuggagggggaggggugagaggggaggaaaggcuugaauguuggcaugcuucaaagcgcucucuauacuuuccagaagcugaucuaagguaagaccuggcuuguuugaugcugucccucuuccuuuccucuuaagacucuaccucuucacuucuugacuucucuaccuaagagaauacacagaaaagcucccucuucagacugauuuucagaaccauagcccucaagucugacaaauccagggcggauucagagaaaacccuauacaucccacccccaacccugcugccugucucccuccuggcucuguagggcuccauucagucgucccugcagcccguagccagagagccccuagaaaaaaaaaauugugaaacguagcagcuguuucuccaaggguaaggucucacuuucgucuugacucuuggagcaguuaauugugcauuaucuuggcuucugaaggaaaagaaucauuaggaagccugcauugacaccucugccucuugacuucucuggcuccacuuguuccccuuccaauacugcccucuguccuccaacugucagcaaagaccggaucacaggugucaaaaugcugcagaugaugauccccuuggaagagcacaggucccugccgagaggagggcuuuugcuucacuuccuuuuguacuuaguugcuauagagaugcagugauucacaauucgagcuugccuaaaacaauagcagcccuaaugcauauuaaaacugcuuaaagcaaaguuauaauuuaaacccguggaaauauauaauuagggaaaugacuuguaacauccuagaggcugcggguggugggaggggguggggaagacuaacugaaccaugcuuuugaucucagaggagaauccuauggcaugaaggcugcagaucauuccuugccuagcugccugccagaacaccccccuucugugggagaaaaauuacuuuuaugggagaucuuauccagaauguagaaagccucaugcaaguuuuuugcgguuuucuuccagucuugcauagggaggccuuggccugguuauuccacaccuguguuucuucuuucuuucuuucuuucuuucuuucuuuuuuaaaaggcuuuuaauaugaaagagauuaugcauaccucuaagcacuguccuaguggaggguuggggugaaacaugaacggaucagauuucuuuuugccaauaugacgguaaguuaaaagccugaaaucagaagggucuccaaguggacuccuggcacagucuucucugccauuuagacuaaaaucccaugcuuuuuacucgggagugcauuuuuccaaagcuagauggauucccuggcccuuuuaccucuuaaaccugaccacuagccacugucuccuuccuucccaugcuuucaagugcuaagcaaugaccuuugauucuauggaauggcuuaaaggcacugugcauuuccagacuugagccucacuucuccagacaccaaaauuguagguaauggugaaacagggagcgugugucugaaacagagaacucccucccuguccaucauguacuccagcaaucauaaacaaaaggagccugucuauccucucuuucucaaucaaaugggucuaucaauugccccucaugacagauuccuaggauaaguucuucugaccucauguccuugaaauucaccucugcacccacuugaucccacccagccauuccucacuguuugacccagaauggauggauuugucucuuucagcugaagugguucguugccucaacagugcucuacaggucggcugcggggcuuuugcaugccuggaaaacuccaccugugacacagaugggauguaugacaucuguaaauccuucuuguacagcgcugcuaaauuugacacucagguaauaaaaccuugaccccugcucccacuggcugcuugucuuuaacaguguguuagaccaugguucuuaggaaccagucuuguagggaaccagcccugcuucucagcuuccccacucuaaauucccaucucagcauguguaugcacaagugugugcaugcacacacacacacacacacacacacagaggcacucaucuggccaggaaauagguucuguauaagacacgccccacucacucuaaugcaugauucuaaggagcuaguagaggcugucuuauaaggccagggguaauaagccaaaaagauuuuccucuguaagaggacauaaaaacgugcauagagcaaggaaguucucucugcaugaccuagcauacuagcuuuugaucugaauucucaaagucucaaucucaagaauaugaagucagauuacgacuauuuuuaagcugcagaaugguugaucacgguucaucuuuuuuuucuguaauuucauuucgguagagcuuaauucucaagggaauccagggagauggggagagggcuuuuuuuuuuuucaauccuuagccgagacaugcaaucuucucauugcaaggauaugcagauggccaugauacguugcccagaugagcccccuuaaauuccuccauguauaugcccauccucuuugucaggucaagcuaaagaccucccucuuguccuuccuccauggcagggaaaagcauucgucaaagagagcuuaaaaugcaucgccaacggggucaccuccaaggucuuccucgccauucggaggugcuccacuuuccaaaggaugauugcugaggugcaggaagagugcuacagcaagcugaaugugugcagcaucgccaagcggaacccugaagccaucacugaggucguccagcugcccaaucacuucuccaacagguacaaacugagucuacuuuuucacaaucaggggacugggagcagguggcuggcuggcagagccagacugggagggaggguuaaauugccacagucaugcucuuauuuuagcuugcagucuucccagcuuuugcaggaaaaaaauauguuugugauugguugugacaguuuaagcagcuugggcuuuuuuuucccuacuguuauaggaaaagucuuuucaugcagcucauagaaagccagccucaucugcagcaucccugggugcuuucauugaccauuuuuugccauaagccugaagggaauggugaaguuucuggaaacaagcuuuuaagacaucagauuuggcugaaaccaugaccgugcaacaacacaauuggccaugauuaaaaaaaaaaaaaaaaaaaaaagcccucugguuaaaugucauaaugcagauuuuaagucuccaucuauuucaaaucagucccaaacacagucagagauuucacuggguagcccagagcaagccaucucacuucccuggggcucagauuuccuuuguaaaaagcaaaauggcuggacuggaccauuuucagguuuccuuccaggccuuauguuaucccauuccucuagcccaagauuuccuagaaugaguguguuuuauggcuguccagaucccauucucaucuuaguauucaaacaccacccaaggccacugagcuaguacaguaacaucugggcauuguacuuuucaguguuuuuaccagccaggagugaauuccuguuacaugagacagcuggcauccucaguucaugugcguggccuggaaagguucccagcaagaacuaagagaugccaaugggguuggcguggaggucuggcaggggcagugcagaccggucaaguuuagcccccugugauaucccucagccuaaaaacuugacucccagccuugaauuucuaugauucuuugacucuccacucaaaucugcacauauccacaaugaucagugcuuugcauguuacucugaccaccugagaguuaucacaggcuuaucugauuaauuuccuagccaggugccaccacccuucuuaagacaguggcaacagccaagucccucuggggcuuacaagugauuuagucauguacauacaugcaacaaaaaaguaguuccuccuuagggaaaggcuaaggugccuaacacaaacgcuguguaaaauuucuuuuucacccuuaacuacaggugagugcccuucagaaccacaaaucaauuuguaaaaaucacuucucuaguccuuggaagugacuuuaucaugggguucuaaaugguuuccucagaacagaaaaauccaaccauuuucucaagugggcugucucuauauaacucuugguuuuaaauuuccccuaggaagauucuuauugcacagaggaaacaggugcagaggguggggaggggagaucugauuaauuauuggagacuuccuucaccauuaggaaaagaaaugaagaauucuuagccagacaggggcuaaggacaaaguauguguuugugugguaguuagggguggggggagagguacauuagcaaagccacuauuacaauuuagauccuuaaggauucugugacaaaucaugaucuauaauacggcauauuuccaauuuugaggcgauacuaaucucccuauuucaucugaaguagcaucuuccauuagaaaggcagagaggucuuuaggcagaacuauauagcuacucgacuagaggucccaauuuaucuaagaagagacuaguaaauuuuuaaccaggcuauuauuucuucuaaucagugccuuauuuucaacaccuuuagaaaauggucacaaagaaagucuucuuaucucccucuuucaucuuagggacucauuaggaaaggucaauuggagaaaaaaaaaauguggccagcccuugaaaaccggaaucuuccaugcaaccuuucuccaaaaauuucacuuuaacaggcuauauuauuccugcucaggauuguagaaauguccgguuccaugcugggcuugcuuugcuccauugaagcugcucaccuuccugagacauccugcuuucccagccucuaucccaccauagacacacgcuaagucagugccaauuggcacagaauugcaagaggaaguaguuacagguucauuccaccuuccugugacuuaucuagcaugagauuuggggcugggagaauccaaaagccugugacuggaccaggagccagaacaaggggauuuuccaugacagaaaugcaccuagaggguaaagagguagcuggaguuuccaccugccugaauuugcagacuaugcuuucaacccugugggaagcaggcaaaauugaucaggccagcagggcggugcgaggcuugggaaccacuuagaccaacccagauccagagugggaaaacugacaaagcuuccaacucucuagggcauggauagggaacaggaaacagaagaauaauauugaucaagggaaacaaaggacuauuuauaaacccucacacagaacguuccuaggcaguauguguguauuuggguaagcauggcugaaacaguagcuauggagaauaucugaucuuauucuuuaucaaaaaaaaaaaggucagggauggaauuuucaaagugagaaaaaagaaacauaauuaaaaagguccuuucgggcugggugaucagaacacuuaguccaccaagucuuuccaacacaucuccuccauccuccauaaagauaaagaaaggaaucuucuucuucuuuuuuuuuuuuuuuuuuuuuuuuuuugacagaguaucgcucuguugcccaggcuggaguacaguggugagaucucaguucacugcaaccuccaucuccuggguucaagcaauucuccugccucagccuccagaguagcugggauuacaagcacucaccaccacgcccagcuaauuuuuguauuuuuaguagagacaggguuucaucauguuggccgggcuggucuugaacuccugaccucaggugauccacccaucuuggccucccaaagugcugggacugcaggcaugagccaccaugcccagccaagaaaggaaucuucuuaagcaguccuaacuaccacugcaaaggaggggauguaagcagagcugcucuauuuuuuguaaaauugagaagaaaaauguguauugaaucccuagaaacauagaaugucauaguuggagaugacugcugagguuaacuagacuaacugccucauuuuacugauuaaagaauaaaggcucagagaguggagugaccugcugaaggucacacagcuugugaauaacuaaguugggcuuagaacucauguggccuugagccaagcuauuugauuucuacuucaaaaauggcagccagcaaaaucugcaggaaauagccacaacccaaaaauagaauaccaagcacaauugaauauaugugcaccgugguaguccacaauuaaauuugcguccuuucucucccaaaaggauggacacauccuaccaauagcuauaggaacuauaagaccauagcacaagaaggugcucacuaaauaggugacgauugcuaagucaacucuugcuggagacacaaccucuuaaauaauccaucucacuuagugacacaggaaagggcuaugucauuggcaagcaugaucccagagguaaauggcuauuccagcccuuacuggacaggcacugguuaaccuauugcucauacugagaaacuggugacaucaaauaauccugacaaauuuuccagccuuugaagaacuacuaauggagacauggacuuuguuuuauauucuaaagagcuuucucagccugcccuugcugaguuaacaaaagccccaugagggaaauaggguagauuccagugggggugggugguucucacuaagagcccucaggcuggcaagggucacugucaagaaacaccaaggucaggugucauaucugagccagcagacaaagcaacaguaaagguagaaagguagaaacccuccaaaaaagagcaggcacucugacaaaguggggccugaaggaaauguauggcccugaagcugcaaagcuggcugcagaagcuuaauuaccuuaaggguacuagacuucuuuguccagacaagagcuuucaaguccuucuaaggaagaacuagcauuucuuuuuaucccuuucuagggaaagauuguauuuuccagccuaucuggggacucaucuggcaugaacagcucuuucuagaaauggaaggguuaacuucuaaguuauaaaguccuuauuggagggaugggagaucagaaaccacccaccaggaucuaaucacccucugaaauagacacagccauccaaagacccagguccuagcagagcccaagagccaggugaugccuggagaucuauauggguguguagaugucagaagcugcuggugcaaaguuguuuauucuauguuucuccaaaacugguuuucuccucauuuccccauccaaaggagaucuccuuugacucaugugcuuuguaauuccaaagaguuggacaauguuccucugugccagagagucccaguuuugaccacagcuggauauaauucucccuggagggaaggguuucaccaggccugugucagcaaccaagacacugcacuugccucucaguccccagcuuccuucugcugugccacagaagggugaccauaucaccucauuacccacguuccaugcuauuuaccacacaucuuugaaauaaccucucugggggauuaaguuauucuagaaagauguuugauccugugcacuguuuggugaguuaaaaauaaacagguuucuuuucacggaagaccugguggccccagagauccuugggcuccucugagaaaaaguucucuccauguaaauacugcaggucacugucacugagucucuuauuagcgaacacagagguaauggguuuugacaacucaacugcgacuacaaaauggaccaaaugcaucccagucuaaauuggauaauaccugaacugucuucccaaauaacaggacaagucauugauaugcccuaaauauuagacaguuuaauccuuucugagccacaaagcuuagcuacauugcuuggggguauuuaaagaauucgcugcaaagaugaagguaacugauaccaaacacaagggguuuugguaaaauuuacuaaaacuacagauaaguuuucuucugggaaucacuacuuauuggagagaauuauauucuuaaaacuccauuuccuuaguggcugcaaaauaaaucaacaaaugugcagugaucaggcaauguagcacgauggcaccgggccauaaggaauacaaagaaggacacaaauccugccuucaguaagcuuacagucuagucagcgaaagaaagccaucacaaaaccaucaaaugcuggccuaugugauggcaaacaaagaucuauaaauauccaaaaagggaagagguuagcaaacucugguauaguagaagaaggauucaugaauuauaguagcaugaacccuuaaaaaccaccaauauuuccauuuaaauagacuucuugccuaggauuuggccuucugacuacaauauaccuuugaaggagggcugaagauggagucagucaauaucuuuuaucagggcuguccaaguaugugauaagggcauuagauuuuguagaaaaaugcauggcacacagaagagggggccuuagacagaaguuucaucagaagaugcacagaucugcauacacacacacacacacacaccugugcccacacaccaccaaaaaaaggaaaauuacaaaaaagcaucaaaauaauuacacaugcauguacaauggcuacuaaucucagugaugagcauuggacucacuucauucuaauuugcuucaccucauccaccuuaguuucuucucuacaaaaugagaguugaacuagucaccaaauggucucuguggucccagcuagcucuguaauucuguuucuaaaaaugucagucaccacagucagccugcucuucaaagugugaucuaaaucuccucaacucuaaacaugaagaucugucuugcauugugugguaaacccuaggagcagaugcauugaaacuagggugacauggcacaaggguuagagagcaaaagccaccuucagcugaugaacuauugauguuugcauggucaggccauuagggacucguguuggcuagagcccgggugaaagccugggucucgccgggcucucacugggugaccaccauaugcacucucuuucuugaugcagauacuauaacagacuuguccgaagccugcuggaaugugaugaagacacagucagcacaaucagagacagccugauggagaaaauugggccuaacauggccagccucuuccacauccugcagacagaccacugugcccaaacacacccacgagcugacuucaacaggagacgcaccaaugagccgcagaagcugaaaguccuccucaggaaccuccgaggugaggaggacucucccucccacaucaaacgcacaucccaugagagugcauaaccagggagagguuauucacaaccucaccaaacuaguaucauuuuagggguguugacacaccaguuuugaguguacugugccugguuugauuuuuuuaaaguaguuccuauuuucuaucccccuuaaagaaaauugcaugaaacuaggcuucuguaaucaauaucccaacauucugcaauggcagcauucccaccaacaaaauccaugugaccauucugccucuccucaggagaaaguacccucuuuuaccaacuuccucugccauguuuuuccccugcuccccugagaccacccccaaacacaaaacauucauguaacucuccagccauuguaauuugaagauguggaucccuuuagaacgguugccccaguagaguuagcugauaaggaaacuuuauuuaaaugcaugucuuaaaugcucauaaagauguuaaauggaauucguguuaugaaucugugcuggccauggacgaauaugaaugucacauuugaauucuugaucucuaaugagcuagugucuuauggucuugauccuccaaugucuaauuuucuuuccgacacauuuaccaaauugcuugagccuggcuguccaaccagacuuugagccugcaucuucuugcaucuaaugaaaaacaaaaagcuaacaucuuuacguacuguaacugcucagagcuuuaaaaguaucuuuaacaauugucuuaaaaccagagaaucuuaaggucuaacuguggaauauaaauagcugaaaacuaauguacuguacauaaauuccagaggacucugcuuaaacaaagcaguauauaauaacuuuauugcauauagauuuaguuuuguaacuuagcuuuauuuuucuuuuccugggaauggaauaacuaucucacuuccagauauccacauaaaugcuccuuguggccuuuuuuauaacuaaggggguagaaguaguuuuaauucaacaucaaaacuuaagaugggccuguaugagacaggaaaaaccaacagguuuaucugaaggaccccagguaagauguuaaucucccagcccaccucaacccagaggcuacucuugacuuagaccuauacugaaagaucucugucacauccaacuggaaauuccaggaaccaaaaagagcaucccuaugggcuuggaccacuuacagugugauaaggccuacuauacauuaggaaguggcaguucuuuacucguccccuuucaucggugccugguacucuggcaaaugaugauggggugggagacuuuccauuaaaucaaucaggaaugagucaaucagccuuuaggucuuuaguccgggggacuuggggcugagagaguauaaauaacccugggcuguccagccuuaauagacuucucuuacauuuucguccuguagcacgcugccugccaaaguaguccuggcagcuggaccaucucuguaggaucguaaaaaaauagaaaaaaagaaaaaaaaaagaaagaaagagggaaaaagagcuggugguuugaucauuucugccaugauguuuacaagauggcgaccaccaaagucaaacgacuaaccuaucuaugaacaacaguaguuucucagggucacuguccuugaacccaacagucccuuaugagcgucacugcccaccaaaggucaaugucaagagaggaagagagggaggagggguaggacugcaggggccacuccaaacucgcuuagguagaaacuauuggugcuugacucucacuaggcuaaacucaagauuugaccaaaucgagugauagggauccuggugggaggagagagggcacaucuccagaaaaaugaaaagcaauacaacuuuaccauaaagccuuuaaaaccaguaacgugcugcucaaggaccaagagcaauugcagcagacccagcagcagcagcagcagcacaaacauugcugccuuuguccccacacagccucuaagcgugcugacaucagauuguuaagggcauuuuuauacucagaacugucccauccccagguccccaaacuuauggacacugccuuagccucuuggaaaucagguagaccauauucuaaguuagacucuuccccucccucccacacuucccacccccaggcaaggcugacuucucugaaucagaaaagcuauuaaaguuuguguguuguguccauuuugcaaacccaacuaagccaggaccccaaugcgacaaguaguucaugaguauuccuagcaaauuucucucuuucuucaguucaguagauuuccuuuuuucuuuucuuuuuuuuuuuuuuuuuuuuuggcugugaccucuucaaaccgugguacccccccuuuucuccccacgaugauaucuauauauguaucuacaauacauauaucuacacauacagaaagaagcaguucucacaauguugcuaguuuuuugcuucucuuucccccacccuacucccuccaauucccccuuaaacuuccaaagcuucgucuuguguuugcugcagagugauucgggggcugaccuagaccaguuugcaugauucuucucuugugauuugguugcacuuuagacauuuuugugccauuauauuugcauuauguauuuauaauuuaaaugauauuuagguuuuuggcugaguacuggaauaaacagugagcauaucugguauaugucauuauuuauuguuaaauuacauuuuuaagcuccaugugcauauaaagguuaugaaacauaucaugguaaugacagaugcaaguuauuuuauuugcuuauuuuuauaauuaaagaugccauagcauaauaugaagccuuuggugaauuccuucuaagauaaaaauaauaauaaaguguuacguuuuauugguuuccccccaugucuuucauuguuauucuugaaaaacuu

SEQ ID NO: 17642 - RNA, 12793 nt, Homo sapiens
aaguuuuucaagaauaacaaugaaagacauggggggaaaccaauaaaacguaacacuuuauuauuauuuuuaucuuagaaggaauucaccaaaggcuucauauuaugcuauggcaucuuuaauuauaaaaauaagcaaauaaaauaacuugcaucugucauuaccaugauauguuucauaaccuuuauaugcacauggagcuuaaaaauguaauuuaacaauaaauaaugacauauaccagauaugcucacuguuuauuccaguacucagccaaaaaccuaaauaucauuuaaauuauaaauacauaaugcaaauauaauggcacaaaaaugucuaaagugcaaccaaaucacaagagaagaaucaugcaaacuggucuaggucagcccccgaaucacucugcagcaaacacaagacgaagcuuuggaaguuuaagggggaauuggagggaguagggugggggaaagagaagcaaaaaacuagcaacauugugagaacugcuucuuucuguauguguagauauauguauuguagauacauauauagauaucaucguggggagaaaaggggggguaccacgguuugaagaggucacagccaaaaaaaaaaaaaaaaaaaaagaaaagaaaaaaggaaaucuacugaacugaagaaagagagaaauuugcuaggaauacucaugaacuacuugucgcauugggguccuggcuuaguuggguuugcaaaauggacacaacacacaaacuuuaauagcuuuucugauucagagaagucagccuugccugggggugggaagugugggagggaggggaagagucuaacuuagaauauggucuaccugauuuccaagaggcuaaggcaguguccauaaguuuggggaccuggggaugggacaguucugaguauaaaaaugcccuuaacaaucugaugucagcacgcuuagaggcuguguggggacaaaggcagcaauguuugugcugcugcugcugcugcugggucugcugcaauugcucuugguccuugagcagcacguuacugguuuuaaaggcuuuaugguaaaguuguauugcuuuucauuuuucuggagaugugcccucucuccucccaccaggaucccuaucacucgauuuggucaaaucuugaguuuagccuagugagagucaagcaccaauaguuucuaccuaagcgaguuuggaguggccccugcaguccuaccccuccucccucucuuccucucuugacauugaccuuuggugggcagugacgcucauaagggacuguuggguucaaggacagugacccugagaaacuacuguuguucauagauagguuagucguuugacuuugguggucgccaucuuguaaacaucauggcagaaaugaucaaaccaccagcucuuuuucccucuuucuuucuuuuuuuuuucuuuuuuucuauuuuuuuacgauccuacagagaugguccagcugccaggacuacuuuggcaggcagcgugcuacaggacgaaaauguaagagaagucuauuaaggcuggacagcccaggguuauuuauacucucucagccccaagucccccggacuaaagaccuaaaggcugauugacucauuccugauugauuuaauggaaagucucccaccccaucaucauuugccagaguaccaggcaccgaugaaaggggacgaguaaagaacugccacuuccuaauguauaguaggccuuaucacacuguaagugguccaagcccauagggaugcucuuuuugguuccuggaauuuccaguuggaugugacagagaucuuucaguauaggucuaagucaagaguagccucuggguugaggugggcugggagauuaacaucuuaccugggguccuucagauaaaccuguugguuuuuccugucucauacaggcccaucuuaaguuuugauguugaauuaaaacuacuucuacccccuuaguuauaaaaaaggccacaaggagcauuuauguggauaucuggaagugagauaguuauuccauucccaggaaaagaaaaauaaagcuaaguuacaaaacuaaaucuauaugcaauaaaguuauuauauacugcuuuguuuaagcagaguccucuggaauuuauguacaguacauuaguuuucagcuauuuauauuccacaguuagaccuuaagauucucugguuuuaagacaauuguuaaagauacuuuuaaagcucugagcaguuacaguacguaaagauguuagcuuuuuguuuuucauuagaugcaagaagaugcaggcucaaagucugguuggacagccaggcucaagcaauuugguaaaugugucggaaagaaaauuagacauuggaggaucaagaccauaagacacuagcucauuagagaucaagaauucaaaugugacauucauauucguccauggccagcacagauucauaacacgaauuccauuuaacaucuuuaugagcauuuaagacaugcauuuaaauaaaguuuccuuaucagcuaacucuacuggggcaaccguucuaaagggauccacaucuucaaauuacaauggcuggagaguuacaugaauguuuuguguuuggggguggucucaggggagcaggggaaaaacauggcagaggaaguugguaaaagaggguacuuucuccugaggagaggcagaauggucacauggauuuuguuggugggaaugcugccauugcagaauguugggauauugauuacagaagccuaguuucaugcaauuuucuuuaagggggauagaaaauaggaacuacuuuaaaaaaaucaaaccaggcacaguacacucaaaacuggugugucaacaccccuaaaaugauacuaguuuggugagguugugaauaaccucucccugguuaugcacucucaugggaugugcguuugaugugggagggagaguccuccucaccucggagguuccugaggaggacuuucagcuucugcggcucauuggugcgucuccuguugaagucagcucguggguguguuugggcacaguggucugucugcaggauguggaagaggcuggccauguuaggcccaauuuucuccaucaggcugucucugauugugcugacugugucuucaucacauuccagcaggcuucggacaagucuguuauaguaucugcaucaagaaagagagugcauaugguggucacccagugagagcccggcgagacccaggcuuucacccgggcucuagccaacacgagucccuaauggccugaccaugcaaacaucaauaguucaucagcugaagguggcuuuugcucucuaacccuugugccaugucacccuaguuucaaugcaucugcuccuaggguuuaccacacaaugcaagacagaucuucauguuuagaguugaggagauuuagaucacacuuugaagagcaggcugacuguggugacugacauuuuuagaaacagaauuacagagcuagcugggaccacagagaccauuuggugacuaguucaacucucauuuuguagagaagaaacuaagguggaugaggugaagcaaauuagaaugaagugaguccaaugcucaucacugagauuaguagccauuguacaugcauguguaauuauuuugaugcuuuuuuguaauuuuccuuuuuuugguggugugugggcacagguguguguguguguguguguaugcagaucugugcaucuucugaugaaacuucugucuaaggcccccucuucugugugccaugcauuuuucuacaaaaucuaaugcccuuaucacauacuuggacagcccugauaaaagauauugacugacuccaucuucagcccuccuucaaagguauauuguagucagaaggccaaauccuaggcaagaagucuauuuaaauggaaauauuggugguuuuuaaggguucaugcuacuauaauucaugaauccuucuucuacuauaccagaguuugcuaaccucuucccuuuuuggauauuuauagaucuuuguuugccaucacauaggccagcauuugaugguuuugugauggcuuucuuucgcugacuagacuguaagcuuacugaaggcaggauuuguguccuucuuuguauuccuuauggcccggugccaucgugcuacauugccugaucacugcacauuuguugauuuauuuugcagccacuaaggaaauggaguuuuaagaauauaauucucuccaauaaguagugauucccagaagaaaacuuaucuguaguuuuaguaaauuuuaccaaaaccccuuguguuugguaucaguuaccuucaucuuugcagcgaauucuuuaaauacccccaagcaauguagcuaagcuuuguggcucagaaaggauuaaacugucuaauauuuagggcauaucaaugacuuguccuguuauuugggaagacaguucagguauuauccaauuuagacugggaugcauuugguccauuuuguagucgcaguugaguugucaaaacccauuaccucuguguucgcuaauaagagacucagugacagugaccugcaguauuuacauggagagaacuuuuucucagaggagcccaaggaucucuggggccaccaggucuuccgugaaaagaaaccuguuuauuuuuaacucaccaaacagugcacaggaucaaacaucuuucuagaauaacuuaaucccccagagagguuauuucaaagaugugugguaaauagcauggaacguggguaaugaggugauauggucacccuucuguggcacagcagaaggaagcuggggacugagaggcaagugcagugucuugguugcugacacaggccuggugaaacccuucccuccagggagaauuauauccagcuguggucaaaacugggacucucuggcacagaggaacauuguccaacucuuuggaauuacaaagcacaugagucaaaggagaucuccuuuggauggggaaaugaggagaaaaccaguuuuggagaaacauagaauaaacaacuuugcaccagcagcuucugacaucuacacacccauauagaucuccaggcaucaccuggcucuugggcucugcuaggaccugggucuuuggauggcugugucuauuucagagggugauuagauccuggugggugguuucugaucucccaucccuccaauaaggacuuuauaacuuagaaguuaacccuuccauuucuagaaagagcuguucaugccagaugaguccccagauaggcuggaaaauacaaucuuucccuagaaagggauaaaaagaaaugcuaguucuuccuuagaaggacuugaaagcucuugucuggacaaagaagucuaguacccuuaagguaauuaagcuucugcagccagcuuugcagcuucagggccauacauuuccuucaggccccacuuugucagagugccugcucuuuuuuggaggguuucuaccuuucuaccuuuacuguugcuuugucugcuggcucagauaugacaccugaccuugguguuucuugacagugacccuugccagccugagggcucuuagugagaaccacccacccccacuggaaucuacccuauuucccucauggggcuuuuguuaacucagcaagggcaggcugagaaagcucuuuagaauauaaaacaaaguccaugucuccauuaguaguucuucaaaggcuggaaaauuugucaggauuauuugaugucaccaguuucucaguaugagcaauagguuaaccagugccuguccaguaagggcuggaauagccauuuaccucugggaucaugcuugccaaugacauagcccuuuccugugucacuaagugagauggauuauuuaagagguugugucuccagcaagaguugacuuagcaaucgucaccuauuuagugagcaccuucuugugcuauggucuuauaguuccuauagcuauugguaggauguguccauccuuuugggagagaaaggacgcaaauuuaauuguggacuaccacggugcacauauauucaauugugcuugguauucuauuuuuggguuguggcuauuuccugcagauuuugcuggcugccauuuuugaaguagaaaucaaauagcuuggcucaaggccacaugaguucuaagcccaacuuaguuauucacaagcugugugaccuucagcaggucacuccacucucugagccuuuauucuuuaaucaguaaaaugaggcaguuagucuaguuaaccucagcagucaucuccaacuaugacauucuauguuucuagggauucaauacacauuuuucuucucaauuuuacaaaaaauagagcagcucugcuuacauccccuccuuugcagugguaguuaggacugcuuaagaagauuccuuucuuggcugggcaugguggcucaugccugcagucccagcacuuugggaggccaagauggguggaucaccugaggucaggaguucaagaccagcccggccaacaugaugaaacccugucucuacuaaaaauacaaaaauuagcugggcgugguggugagugcuuguaaucccagcuacucuggaggcugaggcaggagaauugcuugaacccaggagauggagguugcagugaacugagaucucaccacuguacuccagccugggcaacagagcgauacucugucaaaaaaaaaaaaaaaaaaaaaaaaaaagaagaagaagauuccuuucuuuaucuuuauggaggauggaggagauguguuggaaagacuugguggacuaaguguucugaucacccagcccgaaaggaccuuuuuaauuauguuucuuuuuucucacuuugaaaauuccaucccugaccuuuuuuuuuuugauaaagaauaagaucagauauucuccauagcuacuguuucagccaugcuuacccaaauacacacauacugccuaggaacguucugugugaggguuuauaaauaguccuuuguuucccuugaucaauauuauucuucuguuuccuguucccuauccaugcccuagagaguuggaagcuuugucaguuuucccacucuggaucuggguuggucuaagugguucccaagccucgcaccgcccugcuggccugaucaauuuugccugcuucccacaggguugaaagcauagucugcaaauucaggcagguggaaacuccagcuaccucuuuacccucuaggugcauuucugucauggaaaauccccuuguucuggcuccugguccagucacaggcuuuuggauucucccagccccaaaucucaugcuagauaagucacaggaagguggaaugaaccuguaacuacuuccucuugcaauucugugccaauuggcacugacuuagcgugugucuauggugggauagaggcugggaaagcaggaugucucaggaaggugagcagcuucaauggagcaaagcaagcccagcauggaaccggacauuucuacaauccugagcaggaauaauauagccuguuaaagugaaauuuuuggagaaagguugcauggaagauuccgguuuucaagggcuggccacauuuuuuuuuucuccaauugaccuuuccuaaugagucccuaagaugaaagagggagauaagaagacuuucuuugugaccauuuucuaaagguguugaaaauaaggcacugauuagaagaaauaauagccugguuaaaaauuuacuagucucuucuuagauaaauugggaccucuagucgaguagcuauauaguucugccuaaagaccucucugccuuucuaauggaagaugcuacuucagaugaaauagggagauuaguaucgccucaaaauuggaaauaugccguauuauagaucaugauuugucacagaauccuuaaggaucuaaauuguaauaguggcuuugcuaauguaccucuccccccaccccuaacuaccacacaaacacauacuuuguccuuagccccugucuggcuaagaauucuucauuucuuuuccuaauggugaaggaagucuccaauaauuaaucagaucuccccuccccacccucugcaccuguuuccucugugcaauaagaaucuuccuaggggaaauuuaaaaccaagaguuauauagagacagcccacuugagaaaaugguuggauuuuucuguucugaggaaaccauuuagaaccccaugauaaagucacuuccaaggacuagagaagugauuuuuacaaauugauuugugguucugaagggcacucaccuguaguuaagggugaaaaagaaauuuuacacagcguuuguguuaggcaccuuagccuuucccuaaggaggaacuacuuuuuuguugcauguauguacaugacuaaaucacuuguaagccccagagggacuuggcuguugccacugucuuaagaagggugguggcaccuggcuaggaaauuaaucagauaagccugugauaacucucagguggucagaguaacaugcaaagcacugaucauuguggauaugugcagauuugaguggagagucaaagaaucauagaaauucaaggcugggagucaaguuuuuaggcugagggauaucacagggggcuaaacuugaccggucugcacugccccugccagaccuccacgccaaccccauuggcaucucuuaguucuugcugggaaccuuuccaggccacgcacaugaacugaggaugccagcugucucauguaacaggaauucacuccuggcugguaaaaacacugaaaaguacaaugcccagauguuacuguacuagcucaguggccuugggugguguuugaauacuaagaugagaaugggaucuggacagccauaaaacacacucauucuaggaaaucuugggcuagaggaaugggauaacauaaggccuggaaggaaaccugaaaaugguccaguccagccauuuugcuuuuuacaaaggaaaucugagccccagggaagugagauggcuugcucugggcuacccagugaaaucucugacuguguuugggacugauuugaaauagauggagacuuaaaaucugcauuaugacauuuaaccagagggcuuuuuuuuuuuuuuuuuuuuuuaaucauggccaauuguguuguugcacggucaugguuucagccaaaucugaugucuuaaaagcuuguuuccagaaacuucaccauucccuucaggcuuauggcaaaaaauggucaaugaaagcacccagggaugcugcagaugaggcuggcuuucuaugagcugcaugaaaagacuuuuccuauaacaguagggaaaaaaaagcccaagcugcuuaaacugucacaaccaaucacaaacauauuuuuuuccugcaaaagcugggaagacugcaagcuaaaauaagagcaugacuguggcaauuuaacccucccucccagucuggcucugccagccagccaccugcucccaguccccugauugugaaaaaguagacucaguuuguaccuguuggagaagugauugggcagcuggacgaccucagugauggcuucaggguuccgcuuggcgaugcugcacacauucagcuugcuguagcacucuuccugcaccucagcaaucauccuuuggaaaguggagcaccuccgaauggcgaggaagaccuuggaggugaccccguuggcgaugcauuuuaagcucucuuugacgaaugcuuuucccugccauggaggaaggacaagagggaggucuuuagcuugaccugacaaagaggaugggcauauacauggaggaauuuaagggggcucaucugggcaacguaucauggccaucugcauauccuugcaaugagaagauugcaugucucggcuaaggauugaaaaaaaaaaaagcccucuccccaucucccuggauucccuugagaauuaagcucuaccgaaaugaaauuacagaaaaaaaagaugaaccgugaucaaccauucugcagcuuaaaaauagucguaaucugacuucauauucuugagauugagacuuugagaauucagaucaaaagcuaguaugcuaggucaugcagagagaacuuccuugcucuaugcacguuuuuauguccucuuacagaggaaaaucuuuuuggcuuauuaccccuggccuuauaagacagccucuacuagcuccuuagaaucaugcauuagagugaguggggcgugucuuauacagaaccuauuuccuggccagaugagugccucugugugugugugugugugugugugugcaugcacacacuugugcauacacaugcugagaugggaauuuagaguggggaagcugagaagcagggcugguucccuacaagacugguuccuaagaaccauggucuaacacacuguuaaagacaagcagccagugggagcaggggucaagguuuuauuaccugagugucaaauuuagcagcgcuguacaagaaggauuuacagaugucauacaucccaucugugucacagguggaguuuuccaggcaugcaaaagccccgcagccgaccuguagagcacuguugaggcaacgaaccacuucagcugaaagagacaaauccauccauucugggucaaacagugaggaauggcugggugggaucaagugggugcagaggugaauuucaaggacaugaggucagaagaacuuauccuaggaaucugucaugaggggcaauugauagacccauuugauugagaaagagaggauagacaggcuccuuuuguuuaugauugcuggaguacaugauggacagggagggaguucucuguuucagacacacgcucccuguuucaccauuaccuacaauuuuggugucuggagaagugaggcucaagucuggaaaugcacagugccuuuaagccauuccauagaaucaaaggucauugcuuagcacuugaaagcaugggaaggaaggagacaguggcuaguggucagguuuaagagguaaaagggccagggaauccaucuagcuuuggaaaaaugcacucccgaguaaaaagcaugggauuuuagucuaaauggcagagaagacugugccaggaguccacuuggagacccuucugauuucaggcuuuuaacuuaccgucauauuggcaaaaagaaaucugauccguucauguuucaccccaacccuccacuaggacagugcuuagagguaugcauaaucucuuucauauuaaaagccuuuuaaaaaagaaagaaagaaagaaagaaagaaagaagaaacacagguguggaauaaccaggccaaggccucccuaugcaagacuggaagaaaaccgcaaaaaacuugcaugaggcuuucuacauucuggauaagaucucccauaaaaguaauuuuucucccacagaagggggguguucuggcaggcagcuaggcaaggaaugaucugcagccuucaugccauaggauucuccucugagaucaaaagcaugguucaguuagucuuccccacccccucccaccacccgcagccucuaggauguuacaagucauuucccuaauuauauauuuccacggguuuaaauuauaacuuugcuuuaagcaguuuuaauaugcauuagggcugcuauuguuuuaggcaagcucgaauugugaaucacugcaucucuauagcaacuaaguacaaaaggaagugaagcaaaagcccuccucucggcagggaccugugcucuuccaaggggaucaucaucugcagcauuuugacaccugugauccggucuuugcugacaguuggaggacagagggcaguauuggaaggggaacaaguggagccagagaagucaagaggcagaggugucaaugcaggcuuccuaaugauucuuuuccuucagaagccaagauaaugcacaauuaacugcuccaagagucaagacgaaagugagaccuuacccuuggagaaacagcugcuacguuucacaauuuuuuuuuucuaggggcucucuggcuacgggcugcagggacgacugaauggagcccuacagagccaggagggagacaggcagcaggguugggggugggauguauaggguuuucucugaauccgcccuggauuugucagacuugagggcuaugguucugaaaaucagucugaagagggagcuuuucuguguauucucuuagguagagaagucaagaagugaagagguagagucuuaagaggaaaggaagagggacagcaucaaacaagccaggucuuaccuuagaucagcuucuggaaaguauagagagcgcuuugaagcaugccaacauucaagccuuuccuccccucucaccccucccccuccaagaggguacgugccagauuucaggcaaucaggcuaggcuuaugcaaugaaauacccucagcagagcguccagcuucuucguuuaguugcaugcaauuuauuaaacaaaggagcuccacugccuaaggcuauuggauuacacuggcaguuuauugccaucaggcaugaagcacauuuauuaucaagaucagccgucacagacacaguugcaaaagggagaggcaaaugaggacagcucuuugggggagaaaccgcucuuggguuugcugcuuaccugaguuuugagccgccacucgggauuuccuggggcucacagagucauucugcuccgccucauggguugcagaagcacugaucaccagcaccagaagcacugcugaguuuuggagcauucucugagaaguuuccgcuaaguuguuggguuuuuuuuuuuuccugccccccuuuccucuuucccucuccuggcuugagugaagauguggaucuggauacacugaaagcuuaggugaggauuugaugaggauuuuuuuuuguuguuguugcuggu

SEQ ID NO: 17643 - RNA, 2303 nt, Homo sapiens
aagacccuguuaagaaggcaauuuggcaguaggaaucagagacuuaaaaacagacaaugcuuucuccuagcacuuucacuuacagagauauauucuaaagaaaaaaauaaguuauaugcacagauuuacuacaggguauuuaucacagcuuguaagugaaaaauuccaaacagccaauauaucuaaaaauaugagcuagagcuaggaauuaaaucuuauguagccaugaaaugaaugugcuguaauggauauaugucaaugugaaaauaugugaagauguauuuuaaggggaacuguauuagugcaccauaaauccacagacaauauuauacauguuggaaaauacaucauucccagaagcagcagaccaagguauuagagguguucuuucucucuggguagcacaaucacaucguuauuguuguuuuugcauuuuauuauggaaaacuugaagccacuugaaguagaauaauauaaucaacccccacgugcucaucacucacauucagugcuuaugaggcacaggaucuguuaacguaccaugaucugugcuucgcucguagccuaggaccaggugugugagauuuuaacaucucgcucaucugcaccgauaacugaagaguugucaaagaggacucacagcagaggaaaagaggaauucagggucuugcuaaacaagaagguaaccuugaggagcccuugagucauuccagaagguggcgguaggcaggagaggggguuugucccagcucaagaaucagaaguagaagcccuggggaggggucucuugccuuguugaccagcaugccauccuccgcagccgccccugaccugguccucaaugcggagauggugcagcagaccaccuaccuggaggaccggcccauguucaugcugcagugugccauggaggagaacugccucucggccucagccgcgcagaccgaccccaccacgggcuaccgccggcuccugcgcuucuccucccagauccacaacaauggccaguccgacuuccggcccaagaacggccgccacgcguggaucuggcacgacugucacagguaggccuggcuggccacccuccccacuaagcugcccggcggacauccugcaggccucagaugggaguugagaguugccagggucacuuagagccaagaggcugcauggccuggggauaggauccuccuaaguggggggcuugcaucugccacacuggcugucagauuucccgaagccauucuccacuccaaguuccccuggccugccacccuucuuccugccuccaaugcuucuaacaucaggaaacacacuuuguuuugagcgcccauacccuccucguugaccuucagcccaugguuuccaaguguguccacagguuugugugcugccagguacuccaggcugugcaguugcuggacucuaaauuccuuuagaaauauucccagccuggcgcgguggcucacgccuguaaucccagcacuuugggaggccgaggcgggcggaucacgaggucaggagaucaagcccauucuggcuaacacggugaaaccccgucucuacuaaaaauacgaaaauuagccgggcauggugguggaugccuauagccucagcuacuugggaggcugaggcaggagaauggcgugaacccaggaggcggagguugcugugagcugagaucacgccaccacacuccagcauaggcgacagagccaggcucugucucaaaaaaaaaaaauauauauauauauauauauuccacguacugguauguauuuuaaauaccucuaggaagacaauggguguggagacugaagucuaggcccaagaguccugagaccuggucucuaaacgcagccgugccucuagcgagcugcaugaugucaggucagcugggcggcaucaccugggaccucgccugucccuuccagcucugucagucuguggaccugaucccagcgcugcaaaucccagacaaggacagaagaacagggugaaauccuacagccagaccuggcuagagccaccacaagccaucugcucauccucuuaccuucccucuguuucuuuguuuucccuuuuuugccuggacucuuaaucuaauccagagccugcugucucuguauguccagggauuuuuuugcucagaccugaacuggguggguagagggaagagaagcaggcacacccuuggaaaggaagggagacaggccucuaccacuaaauaaagcaggaagcccccgaggggcuacaggcguggccuagucauugcccuucuccacacuuggaugggccaucua

SEQ ID NO: 17644 - RNA, 2303 nt, Homo sapiens
uagauggcccauccaaguguggagaagggcaaugacuaggccacgccuguagccccucgggggcuuccugcuuuauuuagugguagaggccugucucccuuccuuuccaagggugugccugcuucucuucccucuacccacccaguucaggucugagcaaaaaaaucccuggacauacagagacagcaggcucuggauuagauuaagaguccaggcaaaaaagggaaaacaaagaaacagagggaagguaagaggaugagcagauggcuugugguggcucuagccaggucuggcuguaggauuucacccuguucuucuguccuugucugggauuugcagcgcugggaucagguccacagacugacagagcuggaagggacaggcgaggucccaggugaugccgcccagcugaccugacaucaugcagcucgcuagaggcacggcugcguuuagagaccaggucucaggacucuugggccuagacuucagucuccacacccauugucuuccuagagguauuuaaaauacauaccaguacguggaauauauauauauauauauauuuuuuuuuuuugagacagagccuggcucugucgccuaugcuggagugugguggcgugaucucagcucacagcaaccuccgccuccuggguucacgccauucuccugccucagccucccaaguagcugaggcuauaggcauccaccaccaugcccggcuaauuuucguauuuuuaguagagacgggguuucaccguguuagccagaaugggcuugaucuccugaccucgugauccgcccgccucggccucccaaagugcugggauuacaggcgugagccaccgcgccaggcugggaauauuucuaaaggaauuuagaguccagcaacugcacagccuggaguaccuggcagcacacaaaccuguggacacacuuggaaaccaugggcugaaggucaacgaggaggguaugggcgcucaaaacaaaguguguuuccugauguuagaagcauuggaggcaggaagaaggguggcaggccaggggaacuuggaguggagaauggcuucgggaaaucugacagccaguguggcagaugcaagccccccacuuaggaggauccuauccccaggccaugcagccucuuggcucuaagugacccuggcaacucucaacucccaucugaggccugcaggauguccgccgggcagcuuaguggggaggguggccagccaggccuaccugugacagucgugccagauccacgcguggcggccguucuugggccggaagucggacuggccauuguuguggaucugggaggagaagcgcaggagccggcgguagcccgugguggggucggucugcgcggcugaggccgagaggcaguucuccuccauggcacacugcagcaugaacaugggccgguccuccagguagguggucugcugcaccaucuccgcauugaggaccaggucaggggcggcugcggaggauggcaugcuggucaacaaggcaagagaccccuccccagggcuucuacuucugauucuugagcugggacaaacccccucuccugccuaccgccaccuucuggaaugacucaagggcuccucaagguuaccuucuuguuuagcaagacccugaauuccucuuuuccucugcugugaguccucuuugacaacucuucaguuaucggugcagaugagcgagauguuaaaaucucacacaccugguccuaggcuacgagcgaagcacagaucaugguacguuaacagauccugugccucauaagcacugaaugugagugaugagcacguggggguugauuauauuauucuacuucaaguggcuucaaguuuuccauaauaaaaugcaaaaacaacaauaacgaugugauugugcuacccagagagaaagaacaccucuaauaccuuggucugcugcuucugggaaugauguauuuuccaacauguauaauauugucuguggauuuauggugcacuaauacaguuccccuuaaaauacaucuucacauauuuucacauugacauauauccauuacagcacauucauuucauggcuacauaagauuuaauuccuagcucuagcucauauuuuuagauauauuggcuguuuggaauuuuucacuuacaagcugugauaaauacccuguaguaaaucugugcauauaacuuauuuuuuucuuuagaauauaucucuguaagugaaagugcuaggagaaagcauugucuguuuuuaagucucugauuccuacugccaaauugccuucuuaacagggucuu

SEQ ID NO: 17645 - RNA, 1446 nt, Homo sapiens
auuguguguguuuauuugagguuugcguuaggagagcgcauuggggagaggugggcgguggggugggguuguuugcaaguggucuccaacaccccagcaguuagaaagagaguugaaaacaucuggcgaaaucccuuugcagcccgggaacugcuggggaacccggaaggcgugcguugcgccccugcuaccucagcggcuccagcguucgggauccuauccgagauuaagagaaagggagugcuucccuuuguggggggaaggaggggugcgcgcaggguuggggggguguuucaacuugucagaauuccuugguccaauaucccaagaacuuuugugccaacuucacucugauucgccgccccugccccucccugggccccugacccggcgcugacucuaggcugagcgcaguggcgaggagauucggagcaccccagcaguugcgccaaagacaagagccccauccauauggggucgaggaugugcgguuuucguggugaagaggaaagaaugaaguugaagggauagauaaacacgugcacugaauccccaguaaauucccuaacgguuccaagcagccucuguggccacaggauggcaggagggcccagcaggcccgggcgcagucgcugucuacugcugccugcgaagggcccgccagaguuccagaaggaggacgccgaacccacagucucugagccacugggggccuccccuagucucugcccucccccucgccuuccacagggcuguccccauugcugccugccggcgcuccgcagucaagggcggccugugugccgacccggagcgcuuucaccucccggagcggcagcagaucccgggggcggcugcugugcucccuggggccugcucccgaggcgcgcgcagccggcccgcgggcgagggggaggagagggcgggagcaugggggugcgaccccaaaucacaucggcuuggcgggggaggauucccuccucgguggccgcgugggcgcggugaaucccucguccccuccuggggagucgggguugggggaacgugcauuucucggggggagugggaguguugacaaggaagaagagaggauccccgggccucacgccgugggagggccacgcgggccggggacgugugggaggaacucccgagcugcacguugugguggagguggaugacaaccucgcuccccuccccuccccuccacucaguggagggcuggggaccggagggcccggccuccccccaucuucuccaguucuuaggaaaggagggauucccgccucccgcgagcccccucucuccacccccgccgccucucccgccaggcuccccacuccuauacuagggagccacagcgccccccgggcuguccuccgccagcgcggcucagggagggagagcgcugcagcggucccgcgcuccggucagaaucagggcagg

SEQ ID NO: 17646 - RNA, 5415 nt, Homo sapiens
aacaggccaaacuaaagcuuuaugcuauaaaaacaagaaauaaaauaaggagauuuauaggccggcugauugucagcaaacacaauauauuuacuguauuagcauuugcucacagugcaaaugguacaacauuacaccauuucaauauuucgguuuuuaaaaaugcuguuuucauuaacuauauuauauuggcauuacaauaugacaaaggagcaaaugaaauguuggugaagaauuucaccuuuucacaauaucaagcauauuuuuuuaaccuuaguauaagguacuauaaauccaagaaauaaaaacauccacaaaauauauuacaucugguuugucuuuuuucuaaguacucaacuuuauacaaaagucuuucaaaaaauaucauuccccauagguuuuccuguuuaaaaccugauuuuuuucucucaguucacauaaguuagagugcauuuucuuuuguugcuuuuuuuuuuuaaacaugcagacauauaaaaaaucuggauagcacaaccuuuuggcaacaaaguuauuuuucucuuaguuuagcuuaaugucugagaacaguuuuauuaaaacaaaggaaaacucaauuaucaugcagugacaugcauauaccagaaggagcgaggaaaaaauauuaaaggguaucugauuccuccuucuagcuuggaagugaccaaaauuuuugcuuuuuuaauaaucaucacauuauaaaaaguauucagcaaaauacugucucugcaaagaaagauuuuacccuucagcugaaaaaauaugggcccuccuggcaaacuucaucuucuucucucuccuucuacaaaaaguccaaguaccuggaaauucacaacccccugcucuucgauauccccccuuuccacuagaguccuuuuaguauuauuuauccaccaccaaaaaucaaaacaaaacaaaacaaaaaugguacuucuuuuucuuaaaaaagaaaaaaguggaaaacgcauaaagugacuuuaaaaacagacauucuguaaacuccagaccuuuguuccuucucucugggcaacuuacugaccacaggagaaguaacgcuaacaggaacaguacauucagucaagaccaugcugcaagcuguggcagagagcaaccuucccuauuacuccacuucaaaggagccacccuguacgagaagggcuggcaggacagcuggggaagaggggugccugagaagaggugagguaggguggggagaaggugagacuggguauggaaaggagacaccucauucauccacauggauucaugaaaaaauccccauaucuuugaggaaauuuuggacagagauguguauauguguauacacacauauccauacauagauguguauauguguauauauguacacucacauguauauguacagauaugugugcaucuauauccacacacauaacacacguauguagauauaaucucaucaguuaacauuuucauaaaaaauaaaucauuuaaagcuguauacgccuacaaauucucuuuauuccggugcacugcacuggauaaccaaguaccuuagagauuuuauuuugcuaggaauacauauuguguguauguuauguauauguacgcaugugcaucuuuauacacaugcaugcauauacauacacauacauacacacgcacaccauauacuuauauuuaaauucuaucuguuguguuggugaugacaaagggcaaaagcagagccagcuuccccaugauggugggaaggagaaauugcuauguaauugagagaagacacaaagcuggaguggcugguugaagccugccuuucugggaaaagauuuugaaagagaugggagaagguuuagaggggagaaggggaaggagugggagggcagggggcaaacucaggaacauagauuucuuagaguggggcuaaggaaauacacauauauuuuaaaaggcaggcucagcgauggcugcucuuucuccccacagaucaaacugcccugaggccuaagagggaagcgcucagaaaaggagggguucugaggggccaaacccgaagcggcggcagcagcaccgcgucggcggcauccgaggcauuucucuaagaaacaugauuucagagcggauggaagaccaccuccuccagccacgugcggacccccagcaugggacaucucccagcggcuuggggacccgagguggggaagaguuugggguaaacacagcccaguucagcucaagagucuuaaacacacacgcuugcgcgcgcgcacacacacacacucacacacacacauacacacacacgcgagcacgcacacacucgcgcgcauccccgcacgcaggcgcgcgugcgugcggcgggcagcaagcucugcgcuuuggugcgcuccuuacccccucccccucucgagucuucgaggggguauagagggagacgugggggaaacaaugagguguuugggucgggcgaggguuggaugggcuccgccuucagucccuugcagguccuuggcgcggcccggcggccccuggaucaaggcgauccgaacugaacaaagcgggcuagacgccaccuuuccgcccccacgccuuggcuaagugggggaccgcgaggggaaggcgccuccagcccuggccccugaccgcuggccggcgugaaagguugggaaccgggggcaucgaaggggaagcaaggggccgcacguccauggagaggccagggcgcggccccuacgccuccguggcuggcuuucccgcugcuuucaggcuagcagccgggaggcacuggaggggaaaaguggggaucugggggcccgauccucaggcgcagguggugaccacgggggccagcgacacggggggcgccgaggaugcagagggugcaccgcccuucuccgccuucuucuccuuuugcuugagguggaucuuggcguggcgcuugcgcucgucgcugcgcgcaaacuugcgcccgcagaacucgcaggcaaagggcuucucgcccguaugagugcggaugugaguggugagguggucgcugcggcugaagcuccgcaugcagauccggcacuggaagggcuuguggcccguguggaugcgcaggugccgggucagcucguccgaacggcugaaacggcggucgcagcccucggccgggcacgcguggggccguucguggagcggugucuugcuaggccgguugggguacuugcggggccggaugggcuugagggugagcggcggcuggggcaggcugccaaagcccggguggaucugcuugucuuugaaugccuugauggucuccagagggguaauagggggcggguugacccggaugggguccaugcccuggaagggcuugugcuccggaauggagcccaugucguugggguggugguagagguuguagucaggaaucauggggaagagauugcuguccaacgccggcuuggccgauugguaauccuggggggaauaggcgagcccgggauugcccugggggucguggaaagacacgggcucugaguagaggucgccgcaguuggaguagggggguagcgcgggauacauggccuccacgucacccugcgguggcugcaccaugcuggccguggacgucugcgugcugagcgccccugaagccgggggcacccccaagaugccggcgcucaugaggcuaaugauguuguccuggcaccaguuggaaggggagucgaaggcgaacuuucccaaguaggucacggucuuguugccgggggcuggcuggaaggagccggaguaagagaguuccggguugggcuucucguuggucagaccgauguccauuacauucucugcggagagcgggggagagaggggaggggugagugaagccgauccggcuccgggccgcggcgcccagguccuugcccaggugcggagggugcggccggguggagugcguagcgcaugggguaagaggaacgcugagccccgcgcaaagcgggcggugccgcgcucccgggcgcaaccuggauauagcaaaauacuacggaucgggguguggaguggcugcugcacacacagcgcacaagccgcgcacacacucacguaccacacacacacgcgcgcgcgcgcgagaagcauuguuguucuucccgagguggggcgggcagguagcugcagcuacagguaguuucagacccggagcgcgcugggcucucgcucuccaccgcacacaacucggccucuucccuuggcccuguccgcuccaggacgccgcgccuuucccuccccggcgaugccccccacgcgcgcugcucccgggucgccgacccagagcgcuccgacgcuuuguccucggagcguagaagggugucgcccucaaagggagcucucccuucaccuaccccggccccagccuccucgggcaugaaggagcuuuaggcucuugcuggaggggaaaauccuagccccagcuagggaggguggagagcggcggaaaaccggccggugucuccauggcgggagaggccgcccuuccccagcuccccggccccgggaucguuccccguggcaggcccucgccccgcgggugaacccccuccuucuccccgccguccccacacccccacggcuuugcugaacgccccggaaaggcagcgucgcaguaccucucccaccgcggggacuccacgccgcacauggcuccaucccgggugggaggcugagggaguaaggggggagagcgcgggugaaaaagacgccgggcuccucccgggaagagggcgacagcaccacgccuugcgcguagcccggcgaucgggcccccugcguggugagggagaaccccagagccgcucgcaccuaccucccuccggucggcggcugcccccacccgggagaaccgaagccucuaccguggcgucgccaaccuagccuucucgaucgaggagggcgggaggagugggugggaaaagcaacucgccccccgcaaaauucccagcgcgcccccaucucuccauccauuuaucuauccacccauccacccauccauccauccauccauccauccauccauccauccaucaccaggucguccccuccuccucuuccucuccccuuccuuccucgcugccucgccgccuccccgccgcccuuaccuguagccaucugauuguaauggacuaccgagucgcugcugccggagaagagguugagcgcgcuggggaucuccucgggguacagauugucaggcaguugguuuagcaaacugcucauggucaccggcagcuucucggcgaguuugccggucauagcacucccgagcugccgccgccgccgccaccgccgccaccgccgccgcucgcuccuaacgcagcuuccaggcaagcggcauccgagaggcgauccguggugcaggggaaaagcaugcgagagggaaag

SEQ ID NO: 17647 - RNA, 4795 nt, Homo sapiens
auagcggugauuuuuaucacucucccggugagcugcaggagagacuucaccuggcauccugaugccgcaggggcccccagagagcagguuggaucccaggcuuuccucucuguacccucuccccucucccugaagcuggauacaguccuacucccgcuuggggagcagcggaagagccuguggcucccuacuucugacucgggagaucgugggcugauccuaggugggaagcgcaggcgcaggccgucuaagggauugauggauguggccugccagggcuuugccuaccacacagcucagagcacggguucccugucgcuaacaaccguugcgaagggaaucccauccacacaucucccagacagcuggggccauauccgggcugcccguggcuguccagugaccgcccuuccucacugcuccgggacacuucucccuggggcagugcugccagccuucaggaaugcuggggguguuggggguggccugcccagccugacgcugacucuccaugcagauggggcuggcgagggccuggcacggggcugcauagugccuggagucaccagcaccuacagacggauccccgacgcugcccacgggugcucauccugggagagaggugacaaguucagaggugucggcagggaggcacucuuucucaaacuggccucccgggacucaggaguggagauggcaguuggggacagcccccuggccgccuuaccgggccuuucucaggacucccuggacuuugaauccucagggaguucugagccccccgcccagguaggccgacuccuggccagccagaagcugggggagguguuggagcggucccgccggcucccaacagcucccaccagcuugucaggacaacaccgcucccugcggcuggcaagcaagccugagcgugaagugccccuuggagcagggcaacaggaguccauggaggcagacacagaccuagaggcaggccuggaagaagaggcggugagugcucacucucaggcuggguuuaagagugggauggacagccuagcuccucugguucucccuggagcucucucuggguggggcacucccugccccuaauugauggguugugucauagguucuuucugcaccccaguuccauuugugcacggccaccucugcagaggaggugggcagcuacgggggcccuuccuggcacuaugccccgcugggcaguggggaagccggcugcguguguuccuccucggggcccacucugcucccaucugcuggcugagcccagccuggcugcuuaggguagggcaggagcccuacuggcugaaaucuccccuaucucacaaugucccacagguggggggccuggggccuggagccugggccugccuccccgggcagggucuucgcuaucuggaacaccugugccuggugcuggagcagauggcaaggcuccagcagcucuaccugcagcugcggauccagaggcccccaggggugagugagauucgagugggggagggagaggacagaugggacccugggaaccauggcugcccucagagcagcuucagcccucuagccaggcccugaucaccugucucuccugugcauaggaucccggcgaggaggagucgacccgagccccuuuaccguccccguuacacaccccaggcaaucgggggcaggggccaugggagcugcuaagccagacagagcacacaggugaggggccaucgugucucccuuuguccugccugccuggggucccaccagcagguccucugagccgaagcuugauggggugucuucuggcccuggccaaccugacugucuuucugaaggagcaaaggcugcuucacccccaaagguggaggugcccagugccaacccucccaggcugccagaaaccccaguggagccaacguaccacuugccauccucccagggacacaagguaggggacagguauauguggggcagguggugggcugggguggggggaggggaggugggggaugcaugggcacccugggggccagcaacucuggggaaaugacaggauugauuccuguuuggagcaggcgacuuguccuggcuguggcgacagcugucucugggagcuuggucgggggucugaguguggggagggcucugggugaccccucauccucugcucagcgggauaucucccacugggacaaggucaagguccugcucaaccggaucugccggagaagccaccaccacccugagcccccugccccuccugauggcucugaccccaggugagccccgugcccagcccagguuagggcacggagaggagacugauaagccaggaugcugagauugucaugccaguugucauuauuguccccgcaaaacuugagaggcagucugggaggggcugcuagaagaaacaguaguuaaaacaccccauuuacagauaaggaggcaggguucugggugggguuggggguaguugcuuuuccaaagccgcacggugagucagugacagcuaggaccagaaugugggaaaucugccuacccuagcucagcaaccccucacccucaaugcugacauuuaggccaccuuccagguucguggggagagcaagguggagcacaaaggauuucacagugggugaaggccaucaugcuucggggcuuguauugaaucguucuccaggaggaagaaauaccaagucauuuaacagccccgggcugcgcccacacccagcuacccaccagcagauaaaccacguucucucaacucuagggccauuguuaguuuuauuucccccuucuagccuaaugucuucuuuucauuccacaggaucgaguccagggaccucccugaaaggccucagugccgcccccaccggaagaccuuuaugccaucauuagugguuaagaagcaacgagcaaaaaaccuuucuguaggcugagaccucucggugcaccuggugacccuggguggaggggacuugcugugaagucuuccucgcccucugcccucuugcugcuucuccacauugccaggaaaagcugcugacgccugcccuccucucuugagucgagggcugaaucuuucuccucuaagcagucuggucaggaaccuugguuucuugagaggcccccaagaugccgcagcuccagggcucuuccuccucaccagaaaucccugggcuuccacaaugugaacucacucauugucagguguccguggaguguuuuuggcauggugaccugucugggcccagcauguugcagauguguauuuaugcgcaaugguaugcauaucucugugugacugucaguguugcaagcuggcuggauccaaccaucucuucugaaauaaugcauccaaaggguugauauucugggggaggucacugcagaaggauggaacugaccuuuauuccccagugggcaguuacugagcuuuccuccucagagccaugcuggcagcccugggacagagaacgguguggcuuuggcugccucugcauggaaucuugccccggacuccugaagacugcacaaggaaugaggaagaucagggacaaccugggaacugaauaacuuucaaagccagugcucagcuucucugcuccguacuagcguuuacaggucuuaauucaaaccagaugccuguacuaguuuuuagaccccaagucaaccuuucugagccacagcuucccgcugggaauaaugaugccugcccuaucuaccucacagacuuguuaugaggauaaagugagauuaaacugccucaaagugcuuuguaaaccucaggugaauaggaaaggggaaaguaaggcuggagugaugauggggaggucggaggauaagggggggcugggauugcuaauggggacuaaaauggccagucuccuggcaagauuuugagcaggucauuucauugaggccucuuagauuucauauuugagaauuagggcacugauuccugacuggcuaggcaugguggucacuggcuugagucagaccaggaaugucucuuagaaauggucacugauaggcauccuucuccuccagucaggaggggcugguuuccuuaucuguugcagucucgacugccagagggaggcgagcgugguaggcagucgggggucccuuguguuuggggggcccagcucccgcuuccuuugagcccggaaccaaugauccgaagccuucuuuccugaugggauucuuuagcgaggacacuaccgaggcgcgacuuccugacgcgcauccgauccgggaaggcgcacuuccgcuccccaguugccgcgggauggcaagccggcgugggggaagggagaggucggcggagacgagggagggaccauauccgggagagcggcagcuuccgaccaguggucgcgcuuccggagaggcgcuuccgguggcggcggcagcagcggcuguggugguuccgggugucuuuguccccccggugucgcugcccuggcccgcagguggguuggggggcccccugccgccccucugccccuucgccccuccgccccuccgcuggccgaggggcugcgagggccgggcggcgaagaugcguggggcgcggaaggggccgagccccucuuuggacugcaagucccgucucccuggcaacggccucggccuugggggcgggcgggaggaggagaaaccgcgcgccucaguccucccuugguggccucgccgcggcucugcugggagacccggcgcuggcggcugcugaggccggagcggagggcccgggagcgugggagcaggaggguggcgcgcagccgguuuc

SEQ ID NO: 17648 - RNA, 1176 nt, Homo sapiens
acuuucagacccguaagaaacagaaggaagauguggaaguuguaggaggcagugauggagaaggagccauugggcuuagcagugaucccaagagccgggaacaaaugaucaaugaucggauugguuauaaaccccaacccaagcccaauaaucguucaucucaauuuggaagucuugaauuuuagagauggauuaucuugcaugccagagcgcuggaauggaauaaaaugauggcagaaguacaaaccagauuuagagaauugagugcuugcagucaagcagaauguaccuccugcagagacaaaucuucugcaugagauuacugaugcuucacuugcacucuaagcuggaauccaaacucugguuugucucuugaaaauuugacucuauaaaacugaucugauuuucuguuuuuaaaaauaaauauauuuuuggaaaaaugugaggcauccuuaaugaaguauaacaguacuguuaauucccagacuuuaaaagauaauugcuacaagauuaacaucauucuuuccaucuuuauuaaaagacccuaagcacaggacacucuaguugaucccugccacuuucacuuaacccaucuauucaauaaguauuuauugagugucuaccaugugccacucaacaaagaucccugcccuuguagaaauuaaauucuaguggauauuguguaaaucugaagaaauuguagguacccgaucucuuuacagaauggcuuuguaacuaguuuggguauaauguugggaggacaggcaauggaggaaagaggaaugcuucuaacaguuuugccauuauuccaacuuuccuuccuuucucaacuugccuaaguguuuuucccagaaagaaccagagaggcagcucggaggauaauuuugaaucaugcccuauuguucugggcauuaaaaaaaaauuuuuuuuaaaaauuuuuauuguuuuauguagagacaggcaucuguguugcccaagcugggcuugagcuccugacauuaagcaguccucucaaagugcugggauuacugugccuggccuguuuucacuaauucaacacagggaaucaccagcugugaucauaagagccucuugaaucaucaguucuacggagacucuuagcaggacuuuagccuuuuugggguaguuuaagucugaguaauacgagggggagag

SEQ ID NO: 17649 - RNA, 48084 nt, Homo sapiens
ugggagagcaaagugggguuugccauucgcccucugucccagggcgcuggggcacuggguccaccucggcgggggagaggggcucgcagggagccauccacgggcuuucggcgcccuccagcggcgucuccggaggagggagagacaccaagacagcgagagagacagagcgcagagagcgagacgcgagagagcgaggguccaagaaggggagauagggagacgcgggcggagagaccgacccgaggcgggggcgcggggcaggggcggcgcgaggaccugacagcgugucccgcggcggggcgggggcucggccgcgcgcccgcgggggaggccgccgcuagagggcacuucaggagggacagcccucccggcaccccggggcccgagcuccagccccggccucgcggcccgcggcccgcggcccgggcggcccgagcccccuccccgggcgcgcggcucuccgccuuccccgccccggcuggcgcgcggcccggcccggccgagcacugucccggccccgaggggggcagagcucgggcgaaaacccgcccuccagcgagcucauuucccuaaaaaggggggggggagucggagggagggagggagggagagaaagaaagagagaaaaagaaggaaagggagagggagacggcuggagcccgaggacgagcgcggagccgcggaccgagcggggggcgggagacaggaaggagggaggcgagcagagggaaggggaagaggucggggagcgagggcgggagcggucgcggucgcgaucgagcaagcaagcgggcgagaggacgcccuccccuggccuccagugcgccgcuucccucgccgccgccccgccagcaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcgggugagcgccccccggccccccggcgacgggccaggcggggaggcgcgggcggguucgggcuugggguugggggaggacaguccagugugggaagccgggagcugccugguuggcaaugcaguggggaacaaaagaacgagggggagagggagggggauuugggggacuuuucggacugaaguuuugccgcuguugguggaagcugcugccgcugccucucaucuucccagaggauuccagaggaagucuccuugcgucccgggaaaaccggcgggcaaggcggcuuuuccuucuguaggaaacuuuucuggccaaacuccugugcgugcguguguguguguguguguguguguguguguguguguguguguguucuuuccccuucucccccaucucuccugcuccaggagcuggguguuuuccagccugucugggcugcccuggggcugcacaucugucuggcuuggaucugggaggccugagucuccaaggagcaggucccccagccaccacccagcccaaguggaagaagaaaguuuuuccagggauucccugagaucgugcucucuggguaucccguaguuuaaccaguagcugaagcuuucugggacuuaggagacagcugucaaagucagagaagccaacccagaagggggacuuaacuuugucccuaugugcccagagacccccgccaaggccaaguugggguggaaagagggaaaauacaaagagaacccagauauuguauaucagcucugucacccccgagacaccagaggcuaauuagcugaggucaggaccccggaguguguguuugccuguauguguguguguucuuugucucugaagacucuauguaaccccaucacuccugcugagcccagaaggguccugccccuggagugaccagauggccaggcacucgggccauuugccugauuggaugacccugggcaggcuguuuggggacacacagggacaagauaucagaacuuuuccuugacuuccugccucucugacuucagcucaucuccaaauagccagagccaggggaaguggcauaguugcuagaacuggacugccuguguggggcaccaggggcggaggggcagguugcucuaguccuggcucuggagacccuguucagggacucuccugggaggguggcccacaggcaggaauaagagaccauccaauggaggaaaucagggcaaaucccucagcccuuaccccucuacaccugcugggcugcggguaaaccaggacauuugcugucauuuuucucgcugggggcugggaguggguacagggcagaguggacugcgcauggacuuugaaggcaggcacaucuagcuuucaauccugacccugcuacucauuauagcuguaccaccucagaaugguaaugaucaugucugaacugccacuuucacaccuguaaaauggaacugaucaugcaucuucccauagaguuggugguaaggguuaaauaugaaaacauacauaaaacacuuaauagugcuuaacacacagucagcgcuaaauaaaugugggcucccuacucccuguuuucugugccucagacugucacuucauuuuuuugagaggugugggauugcuggugucuccuugugccucuuauccaucaauccaucaauaccuaauaugugcuagggccuggaauggauguugugggagguacugagacguacaagcuaggacccugccuucaaggagcuuacaguccaguagggacccaagacaccuacagacauaaccaauagcacaaaccaagccacacugagugccacauuggaggguaggaugccaaagacucagggaguuuccugccccucugcagccuggugguggcagagaaaagugaucacagcaggcugagaaggucugggggggucuucauggaggagguggggcuggggccuggccuuaaagaaugggugggaagccauucugaugucuuucccuucuuguuggaaaugggagugauuuucagagcagcaagaggcugagggcucuccccccagucucagguuucaugcuaggguggggcuggcugaguuggagcuucaaguaagggcucuggagaaagcacuccaacugggugaagugaggcugguggggcgcugggccagggcugggggcggcugagagggcccccgggccugacaaggccaggccuugggucagaucaggccucccucucgggugugacugaugcuugagaucugcugcccaccuccagaggaaacucacaugggcauuccuaaguacucacacccacaccccugugccacugccuuccagccacaggucccucagcucuguucuccacguuuccuucuccugccuggcuuugcuuccuguauccucugcagcccugaccuccagaugcuggaggugaugauggcaggcaugcugucucugcuucuuuucaagggcuggaacugaaagcuccuuugacucccacagcuuaccugugaccuuuccaguugcucugaggguagccacgccccuucguuggaccauuacuggccgaguuaugguugccguuguagugagggcaaaauuaauauccuugauacccuggagagguuccuggaccuucugggugagaccaggacguugggcaggaaggcaggcuggucuguuugugugcucagagcuggugccaccaagcccucacuagcccuugcccaggaagauuuugaggcaggccugauuuccuguaugucaggaaaucagccaaaccaugaaggggguccuucugcaagauucccagcacuguuuggcugccccaggugacuagccaacacccccccggagagaccuuggaggcaggaauugggacacaguugaucccaaaaucagagaagcccaggggccugaccccacagggguggggcuagaagcaugucacacccagagcuggguagugacccugugccagugaggccccugcuaccaccucaaccucaucugacagcccagagucugcaggagcgggaggggcagcacuuaccagcccacauccccaucccacccagggggacgccuggccaagguuuggacaucagagagccauagaggauuaggguacacccucugaggucgagaaguaaucucuccucucaccagaccacauucccccucuagacagcugagucaccccacccacccaggccccugccccugagucaccuucuuauuucagugccgcaaggggugaggaaaaaauuuguacucucccugggcccuacauggggcagggcggggcagugggguuccccaggaagaagggauucuuaagaagucuaggcagggggcaguggcucaugccuguaauccacuuugggaggcuaaagugggaggaucacuugaagccaggaguuuaagacuagccugggcaacacagcaagaugcccaucucuacaaaaaaauuuaaaaauuagcugggcauggugucaugcacccguagucccagcuacuugggaggcuuagcugggaggaguuggagcucgagaguucaaggcugaguccaggagcuggaggcuguagugagcuaugauugugccgcugcacucuagucugggugacaaagcaagacucugugaaaaaaaaaaaaaaaaaaaucuaguuucuccagagaucuggggagaagauauugcggucgggggaguagaagcgcuacuccucaguccacuaagaaccuccuaaggagauccaagggagucagcuaaucucucucucucccucccucgcucucuuugucucacacaagugcaucccuguccauuucuaagugcgcccuuguccuuuggggaguguggccugugaaacauggugcaugccugcaguuauguguguguuugaaaacacaagauccugcacggggaagugguugaguguguguuugugcauaugcgugggugugucgcugccuuguaggcaagcauguucaccugugaucggucuuccugaguacaugcaggcauggaggcaaacaugcaccucugcagaaguguucacaugugaugaaguccauccacauguuugcagggguuugagugugucaucccccagcuagaagcuugcguuugugcagugggacaugcaucaguccugcacauauagccuuggggcucauuacaccagccagccuccucuccccacuuccccagaaggggaggccuugccaugcccugggggaggagacgguggaguccagagguugaccugaaagagugagauucuucccaggcacaagcacacagaugggcucagccacagugcuccuggcagguuuacagcuggaaaacaacacaaaaaauuuuuaucuuguguugaaaauaacuacuacccugaccgugaccccagggcuuccucugaguaaggagagaccuccuagacuccuuagcauccagauucccucgcuuccccagagggcagcccaaaagcacagagccccaaggcccagcuccugccccuaaggcucuccugcccaucuccucucuccccacccccacuugguucccacgcauucuucagccaugacauccucacuccaggagcucagcagccagggccaugcccugcccugccuugcacuugcucugcccugguucuacacuggcccuggacccgcaggccagcacaguucuguggccucugcaccaggguuucacucaaggaggagugggggcagagagugugggugagccagcguucccugaggaggucuagagcugacuuugagcuuacggguuguguugggauaauauuaaaguggcuggugggugcguaccguguugcaugcucugugcuggggguucguguauaugucuuauuucaugcaguaauccuaggagacagauucuguuauguaggagaacacugaggcuuagaagaguuuacaugacuugucagcuaauaguagccaaccuggauuccaagacaggucugucugacuccaaagaccuugcccuuugcucuauguccaaaggugagucuaaauguccagccacaccuguaugcggugaugccuguggguuugggugugggagccugcagguacaaugccugugaaagguauaauauguguguacgggcacaguagcuuaugccuguaaucccagcacuuugggaggccaaggcaggaggaucaccuguggucaggaguucaagaacagccugaucaacaaggugaaaccucgucucuacuaaaaaaaaaauacaaaaauuagcugggcgaggcugagacaggagaauugcuugaacccaggaggcagagguugcagugagcugagauugcaccacugcacuccagccugggugacagagugagacuccauuucaaaaaaaaaaagaaagaaagguauaacacaagccuaaguguggaggcauucguguggcagaugcacaucuacgugaacuuuggugaguaugaacccacugcuucuuccuuggaguguaccucccaucccauguccuuguuaaggccacucuugcaugucaccugggaagcaucuucuguugccgucccaucaguugcugagccaaggccaccugccgaggauggcgauucaaguaagaguagcuuucucauggguuggaagagauuuggggucacuuacuggcuggugaccuugagugaguuaucgcccuucauaggcucaaguguucugaugucuaaagucagggaggugggcuggaaccuaaaccuagccacuuagguuaucucucucugagaguuucuaaugcucugcaagagcaugguguggaguguggcuuacugggcauguugugggcaggccaggauuaaauuaauuaaugggaaagcacuuugccaauuggaaagcaccacaaaaauuucaacauuuacauaaggugucauuaucacgacuauuauuugcuuaauggguccagagcuugcagcugguuuguguauguuggagcuugugcauguguguuuuuuaaaaaccgugugugacuguguguguauuuuguuguggauguguccgucugaguaucuauuuuuguauauauguauuuacaguagggguucuagagagugcagugguugcugcacugggaauggggaggccugaguuauacguccaguuuuccagugacuagcaguguagguucaguuaaguuguugcuuuugggaccucaguuuccucaucuauaaaauggaaguuuggccucgaugacugccacagucacucccacauucuguugauccugucuaggugagggugugucucugggcauguauuugcaagccagaagaauaucagcguggcaauucauucauucgaacaucccggagugccucccgccugaaagugcagugcuggcugcugcuuucaugcgcaaggaugugugucccuggcuuugauggcucugcacuggauggcaaggguguggacgccaccauaugucuguaggaacacuaaccuugggugucugauucuguaugugaugaagucaguguguguguguguucaccagugaggccaacuggggaggagaaaccuguguagaagucuucaagguuaaaacaauuuguguaacgcgaccgccaggccuguauagcacucugccuggaugagaagcagauguugcuguggguggagcugcagggaagcugcugugggucccaccuguagcccagccucccacuucccccagcccagcccagcucagcaugcagcucccaucugagcgccuuacaaagcggccaguucuauggccucugcuuccuuuucuccagacuucucaaaaggaagacagacaguucagccgggucucuggaaacaucccuccucagcuccagauacuggaaucggaauggcccuuuagggaggcucucuuccccucuggccuuucugcuugggcagccuaagacuuggaauaggaauuacuugagaacuguuaaacuuuuuccuccuagcugggaagcucccagaagguaucuucguuucccaaagaugcuuaucuguucuaaugaaaaaugguacaauuuuauuuccucuuuuuuuuuuuuuuuuuuuuuuugagacagggucucacucuguugcccaggcuggauugcaguggcaucaucucagcucacugcagccuugaccuccuggguucaauugauccaccugccucagccuccugagugaguagcuggaacuacaggcaugcaucaccaugucuggcuaauuuuuguauuuuuuauagagacgggguuucaccauguugcccaggcugaucuugaacuccugagcuuaagugauccacccaccucgaccucccaaaguguugggauuacaggugugagccacugcaccuggcuuauuuuaucucauagacacccccuuaguuaaauugaaacagcauuugcugagugaccaccacaugcucagcacacccuguuuuauuuucuucauagcucccauugcuaucuggaagacccuaggucaguauuuauuuacuugcauauuauggaagguuagcuccaccgaagcaggggccucuucugucuugcuaauaacuaggguauugucuggaccacaguaguauguuaacuaaguauuugcugaagaaugauggcucuguggcucacaccuguauucccagccacuggagaggcugaggaggcuggaggaucacuugaagccaggauuuugagaccagccugggcaacauagcaagacccugcuaauuuuaaauaauuagcugggcacaguggugagacccuaucugccccacacuccccaaagaaugaugagcuaacagacugguaggggcugagcaucagcuuuacugggauuuuaacugaaaaguaagcaugagcuucccaagaaauucuauaagcugaucccuaacugcccuucuccuucucguucagauggcauuugaggaucacagucgcuguggagguugggggcuggugcccacaggguuggggcuagaagcacggugcaccuagggcuggguaggaggauuaacucagcccuggcuucuucuuuucucuuuagcugccuuucuuggggacauugcccuggacgaagaggaccugagggccuuccagguacagcaggcuguggaucucagacggcacacagcucguaaguccuccaucaaagcugcagguaagccgggugccaaugggcccucuguguccuagaaauggguuccaggcuuagggaaacaaggaaucucccuguucccagccaggcccucccaggacagaggccaugaguuugaccccagcacaugggucuaucuucccucgggauaucuucaucccuuccccagaggaguaguaaauauagauauccccagcaacuaagaacugacauucuuuuuguuuacaguuuaaaaaccacuuucaaaaguauugucuagccugacuguccccaaccaccuuuaaagguggugucaggacaacuccuguuuuacaaguacagaaacuaagauucacagagguaaagugaccugcccaggaucacacaacuagugaguggcagagcugggacuggaacucaagcuuucucacuccagaccugagacucugcccaacacugcaaucccuccugggcucucuguucccacuuugcaaauuucugugcauccucugaggcccauuucaggagcuucuccuauucuucuuucccaguugcccccgaaacaugacugucccuucauuuucccuguuuucucccuccucugugaucacacuguuacccugucauuuaucacaccauauugaaaggauuugcuccuaugucucccuagcucuuuaaggucagggaugcuuucuucuuauccuugauugugguccaaacuccuaaaaacccaugugguacuugugcauggauacaggaaugggagggaugagggccugggcugugucuguucuuuccagucccuuacugcucuguagaagggugaaagcuccucacugccagugcugauguuugagacaugguccugagagcacacaaauagcccuccccuucccaaagggcaggggcagggauucuuucuucuuuuuuucugucuuuuuuuuuuuuuuuuuuuuuuugagacagggucucagucuguuaccuaggcuagaaugcaguggcaccauuucggcucacugcaaccucuaccuccugaguucaagcaauucucgugccucagccucccaaguagcugggaccacaggcaugcaacaccacgccuggccaauuuuuuauauuuuuaguagacacgggaugucacgguguuggccaggcuggucucgaacuccuggccucaagcgaacuauccucccuggccucccaaagugcuggaauuacaggcgugagccacuguaccaaagggcagggauucuuauugagggucugcucugggaacacuguggugugccugaaguuguccuguccagcuugagggaagauccugaugugggcaccuuauggaauaaaguaccccagagggcagguggcauuggagggugaccugguggccugcuaacaaguaaggcucaugugaccuuaguggggacuaguagguauggcacaacggaaagcugcauggagggguccccugcuaacccaccaggugacuuuggccaaaccuuuggccuuaguuuccucaucugucaaauacaauacgacacuuguccacaugccuuagagcuccuaugucaaaugcaaacaugaauuugggaaaucaaaagaaggcauagaguucugaaugcuccacaaaugucaagguuuauucaaugagaagggauauuuuccuaaucucagauccccacaauuccuagaaaaugaguacaccuuuguucucuuuuacgauuauugucaauucuugcuauuuauggaaguuauagaauaacuuuauaguuacucuguacagucacugaaaacauuagcaaauacugacccauugcuccuagggaaaauacagggucagguuccuucaagccucuggucacaacauuuuugucaacugaucagugcaucaccuuguuuuaugaguguuucuuuuuaaagacaccuuacuuaauauggagcugauucauuaacauugaacucaugaccaacagcacucuaacucaugccucgaagaagcuuaccuagcacacguauguucucugugaggcauaucacagccuucuugcccuugggaacaccagagagcacuucagcauuaugcucaggggcuguuuuaaacagcgaaacccucaacaaagcgcacaaaaacacaaaaaacagggcacuuuaacuagaccucaaaaaggacacuugguuacacaaugagagccgaaagcagaaagcggagcguugccuuauuccaccucagcugggaacaugcauguugggugacugaaauuuuucacugcucugcaaauguccacaaaugaccgugaaagcccugagaguauugauuuuggggacuacgaauaaauuuuagccaguagacaaauuugcaagcacagaauccaugaaaaaugagguuugacuaugcuuuugcuuuccuccucuuucucuccacucacuagucaccaugacuuccucucucaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacuggugagcgugcuauugugggucccagaguguaaccagcuuccgggccuggccuuguggcagcccugccaggcacggaggcgugggugccaccugcagcccgagugcccacacauuccuuuccaggcagucugcccucagaauggcugugacucuucagugguggguagggggugggacugccuggacaccguggcaaccuggcuuccuuccuccuggcagguagccagagggcagucuuccggcaggccaugaggcacugggagaagcacaccugugucaccuuccuggagcgcacugacgaggacagcuauauuguguucaccuaucgaccuugcgggugagcaggaagcccuaggcgcuguaccuuccgccauugccccaacccagguucugcccugggcccugccacugcccccagcugggcacagccuugggucccuuuauccccuccugcuauggggcaucuacccaggaacugcccccugugcggcugugaccuccagcacacagccugggcacucggugcucagggcccaccccuccccuucgcuccccugccgccccgcccccggcagccuggccccgccccugaguggaugcacucccccagcucgggaccgccccccugagcuggccccgcccuccaggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagguagguaccugccccucggugcggccuuggugggcggcucccgccccagcccccaccuccaggaccccugggggcaguggcagccgcuccagccagccgucaucgccugggcccgcagcgcugcccacagccuggguugagccagccccugcccuugaggcauuuccuccuccgugucagaucaaggacccgcauccauuguggagcuccucugggaggcugggccagguccugguccuggacagcgguagcccgggcagccucuaggguggggcaugggcauagugggccguccuggggacugcucaggccuuucuccccaccuuugcccacuaucugcccucugccuggucugcccuccgagggcuuuucucucauuuucucgaugucucugucccucccuucccgccuccucccucucucccaggcguucuccacucuucacugcuccuucucagcuguggcucuagaaauggugcuuccuucccauguucccuugaguccuccauucaccaggcccucugcuggacaggacucuuccugagacccuccccauuccccaggcuccccuuggcugcuccccggacccucagguagggggacucucucagauacaggaaggacuccauucccugcccuggaaagugagcguugcaucccaggcagacccacccccuccucuccccccacacccuuuuccugaucuuggcagggcaggaguauaacuuccugaagauggagccucaggagguggagucccugggggagaccuaugacuucgacagcaucaugcauuacgcucggaacacauucuccaggugggagacgggauuggggcugggccucugcucgggcagccccacccugcccucuguaggcuauucuccuccugccucccacuucuggggcagugacccaggaaaagaguggcccucuggggggcuguggccuccaagcagaggguccguggauguugccugcccuccuguccucuuccacgggugggucuguggcagggccuuaccaccgugugcacccagggcaccuggcggaggaggcugaacccagccacucugcaagcccagcagugugggguagccccaaacuaucagcccaaagggugcugagcuuuuauuugugggccauuuguuuguuuuuguuuuuguuugagacaggaucuugcucugucaccuaggcuggagugcaguggcacagucauggcucacugcagccucaaacuccuaggcucaaggaaucgucccgucucagccuacugaguagcuaggaugacaggcacacgccaccgugccuuuuuuuuuagagauggggucucacuauauugcccaggcuggucucgaacuccugggcugaagggauccucccaccucggccucccaaaacgcugagauuacaggcgcgagccaccaaugcccagccauuccuuuuuaauuagucugcuuuuuuuguaauuggccaguuugcacgaagccugaccccugcccuggacuagcccccaugcccagcuccgaagcacauccuccuuaucugaggcccagguccccagaagccacaaccagagcccucaaaggugguggcccagccuccccucccccaagauucuccuuagcagugugggaaauggcaccucccuccuccucaaacuccuuccuggccuggccauucccaggccuggugcuuugcucauccucugucugugucccagacaguggcccugcccccucuucucagugcuucuacccgaucugcucuuccugccugcagaccugcaggaacagagaccaaggaaggguggugaggucauucugccccccacacccacagacccggccuuacauuucccaccacaucccaccccacccccugcugcgauccacccagcugggugugagucaggggcccuggggagguggagggcugccugccuccccuucacucugcuccucccagugcaaacacccaggauucagcagggaggaauggccaggacaggagacacugauagauugggagcugguggggcuguccccggggcuuggucuggcugcaguggaaucugccuuuggccuuguuccaggugcuuucagaugcagccugugccagcagggugaggagcuggccuggggaguccugggagaaguuuaguuagggcuggagcagcaugaggggcugcagaagcaggggcccaguggggcuggagagagaugacccgcuaggggccuguagcuuuccuggggcugggaguuguggccagccugagcugggagcaccaguggguccaagggcacccuggaccugcaucccugaccucccaaaguguuccuggggcucccccgacuccugugguguggcugccacggagcaggguggcugcuggucaguggguagcauaaugacagggugagacgacuccacccggcccugacccugcugaggaaugucugagcuccagcagggucgugacuuguggguacagaugggcaugccacccacucccugcccacuguccaugagacgcucacccuuacuuuucucccucuucuucaggggcaucuuccuggauaccauuguccccaaguaugaggugaacggggugaaaccucccauuggccaaaggacacggcucagcaagggggacauugcccaagcccgcaagcuuuacaagugcccaggucagggcagagaagggaugggugagggcguggagggcagggccugagggaggcagaggccaggugccuggugccaccaagaaggcuuaggcugcaagucuuagagaaugguguggcgggggaggggaccccauaggaggggcaguguccaagugaaggaggccgcuggggguaggcucagguggguggucagaagccgagccgccaccuucugagggucuguaggggcggaaguggggagaacagcaauccuaggagagggagguggcacggagccccaccaagggagcuugaccuuagcucuggaacccauauugccuucacaaacagggcagcacugggcugggagguaggauggcgugugcuauaugugagguagggggguggaucuuauaggggcaggaccauugcagacacccucccacuccucaggcauucuccccucccccagaggaugccaagguucaggggugggugagccagaagauggggggauuuggcgccugcagcccugcccugucauuuccuuuccucacagccuguggagagacccugcaagacagcacaggcaacuucuccuccccugaauaccccaauggcuacucugcucacaugcacugcguguggcgcaucucugucacacccggggagaagguacgugugggcucagccucugagccucccccuccccugcggguccccauaccucagggacuucucccacagugggggucaauaugggugccagcgaccuaccuggcuaccguaaauguaucaaguccagagcgcugauggagcacggcuguaggaaggggcuccuggcauucaccgccuucccuggcaucucccaauaauuauaaauuaguguuaauuugcacauagcacuugcuguguaggucuauuuugauuaucuaguucuucuugggugauuuuccuacaucaccucuuuuaguuuuuacggcuaccuccaccuuuauuuuacagaugaggaaacugaggcacagggugguuaaguaacuugcccaaggucacacagcuaacaaggacugaggugggacuggagcucuucucaggucuggguucccuuggaugaacugcucagccugacgcucagcucucauccgucucaucagggcuugggccaggggcuccugaagggcucuucccgauucugacaggcucuaguccugggaacaauuaaggaaugaugcaggcgccuccagcaggaugcugccuggugggucucuccuucucacccauccuuccccuugcucaggccaggacccuccagucuuugcucugugggccugauuuucugugccuggcucuccacuggcacucuauuucuccucccucuaccugucaccugcuauaucaguucugauccauagagaaagcucagcuccaccuucugucuuaccuuguggggaaguacccaguucucauacuugcugccacguggggcuggcuucgggcauacuacgggaucgggucagagcugucuccaucuucacagucuagcucggaugugaccuccuucaggaagccuucccugcucguuacuaauugguggcaaguaggguggacaccgaguguggggagggcccccgagccuguccggucagguuucccacugcaugguugauuagcccuguuugaauaccuaaggugaugagaggcucacuacuuuucagaauaauucauucuguucucuagccagcucuuuuuuuuuuuuuuucuugagacagaaucucacuuuuucacccaagguggagugcaguggcgcgaucucagcucacugcaaccucugccgcccagggucaagcgauacucccaccucagccucuggaguagcugggacugcagaugugcgcuaccaugcccggcaauuuuuuuucuauuuuuggucgagacaggguuucgccauguugcacaggcuggucucgaacuccugaguucaagugauccuccuggcucaggcuuccaaagugcugggauuacaggcgugagccaccgcaucuggccuguagccagcucuuaauguuacaacgucucuucuucucccuuaagccccccaguugcuccaguacuuuccucaagagcaaugcaggauaacucacucccucuuucccaugucagcccuccuaauguggggaggcuacucccaucacuucuuagauccauucccggucuuuucacacagacucuggaccuccgcaccaaccccagaccuucuguguccauauuuuuauugcucccaagcuacaagacuuuauuuuccuugauuggggcaugguucuuaaugucauagugcagcguugagcuggauucaauucuauuauugauugcauuguucauuucgacaucucaagaucauuuugaaucagaauuucaccauccaucagguagcccuccucuuaccucugccaugagcuccuuugauaagcaugacuucuaggucuucguccuggccuuugaucaaaacauagaacagcacacaaaccaaagaagaaccaagauuucccuccaaauuggcauuaaucuuuuaaucuaggcuuugagcagaguuauuacaccaguuaugaugccacuuaaggucauuacuauccagccacaggugaccaccaguugaccgggauguacgcuccuucugagaccauaccuuggucaucuuucugucguuggcccaggaaguguuucauaaaugcugaauacguaagaugcaaugccuuaccaaauuaaaucuacuguuccacccguugacaaaaccccuuuuaaaaggaagacaaauguguucgaccugccuuguuuucagugaacccaaacuggcuccuaguaaucaaguguuucuuuucuaaauggucacagaccaucuguuucacuggggauugacguuuggcccagugguuugcaauucccagaauccgcuccuuacucuccucccagcacacacaccccuuugaagauugggaaagcuuuuacucugaguccugcagauuacacaugcuaaucacaucugcaaauuauuugagugucuccucugauuuaauugaugagcuuggagacaaaaaccaauguagagaggugcucaugggcucuccuccuucuauguuauugagcuucuauuuccuuuucaaacaaugcuuauuuucauuuguuguaauuugaagaucauucuuacguggacagauuuuuauugagaguugaguaauucuggcuucucucuugguugauauucuaccaucuucccuuaaaagugaacccauucuuccuuguucugaaucucacuuaaaaaauggcaguucuggccaguauauggcccaugccuguaaucccaacacuuugggaagcugaggcaggaggaucacuugaggccaggaguuugagaccagccuggcuaacauagcggaacuccaucucuacaaaaaauuuuaaaaauuagcugggugucugguggguguugguaguuccagcuacucgggaggcugaggugggaggauugcuugagccugggaguucaagguugcaguaagcuaugauuacgccacuacacucaugccaggggggcagagcgagaucuugucucaaaacaacaacaaaaaauuacauuccuuuuuugcuguuuucuaccagcuaugccuuggcuuccuuuguuucccucuagaggguucccauuacuccauccuugggaaaucucacccaccgauaauaauagcaauaacuaacaaugauugaauauuugauugagcagguauguguuaaauuauuauuauuauuauuauuauuauuauuauugagacguguuucauucuuguugcccaggcuggagugcaauggcacgaucucagcucaccgcaaccuccucagccuccugaguagcugggauuacaggcaugugccaccacacccggcuaauuuuguauuuuuaguagagacggguuucuccauguuggucaggcuggucucgaacucccgaccugaggugauucgccugccucggccucccagagugcugggauuacagacgugagccgccgcgccuggccauguuaaauucuuuauguguguuauguccaacauuaucguacagcaacacuaugggccagaugcuaacauuaucccuguuuuggauaugagaaaccaggcuuggaaaaauuuaguaacuucuccaaaauuacacaaaauuggauuaugacacaagaguuggugauuucaauacuauguguguucuaaagcccugcugcauuucaacaauuacuuuagugcucuucagcaaaccugugugccugcuaugugcccagcacugggucagccaccagggauguacagaugcacaagacggucccuggcccugagcaguggagucagguggcacgcuacuuaccuuccuguccgggaguuuuugcaaucggcugggguauggcauugggcuaggaucagcuuccuucccuguucuuccuggcuggccugggcuagcacuagucucucuaguggacgcacauggccuugccccaaaagcaucucucucugccuuggggcugcucccgcugcaauucccagaggacuccuguccuuuuuuucagaagcuugccuggagcugcagaaagagaaaagggcuaacuauaaaaauuccagauuaaucaacgcaugguuguagaaguacacgaaguaaaaaccagccacaguccugaaugaaauuggagaguuguaagggaagccaaguggcacccuggggacgugaacauugaaagggccugcagagccugguguaguagaauacuaacagccucucuacuguuuaacaaucagguaccacggaaagcauuaggcaccuuacaugccggaccucgcuauuccccauaacacuuuuacaaccuagguaccauuaucccuacuguacagccaagagaauggaggcuucaagcgcuugaguaaaucuacccaaguuuacacagguaguaguggugaaauuggcauuugguucuaggacuuucugacuccaaagucuauggccuuucaaagguaaaccugaaauaaugccgccugcuuuaguggauggacuuugccgucuauuuuggcuguggggaaguuguuuuucauuugccucccaauucucagcuuauugccagaaaugugaaugauagguaaaucuugccauauauaauugauucugccugucauggguaugucaaaguaaaagagccaccuggaaagccuucuuuuuggaucccccaagucuacacucuuguaauuagcagcuggcgcggagaggacugacaguguuuccccagcaacggaggagaaccuuuaugaggaggagacgguuuuaagaagggaaucagccgggugcggugacucaugccuguaaucccagcacuuugggaggucgaggcggguggaucacuugaggucagggguuugagaccagccuggccaacguggugaaacccuguuucuacuaaaaauacaaaaauuagcugggcaugguggugcaugccuguagucccagcuacucaggaggcugaggcaggagaaucgcucgcucaaacccgggagguggagguugcagugagccaagaucgugccacugcauuccagccugggcaacagaguaagacucagucucaaaaaaggaaaaaauaaaaauaaaaauaaaaaaaagaagggaaucauggucagaggaucaaacauuugcagaggagccaagaagauaagaacuuuuggagcuggcaauauccgcccucauucccaucccugccuccugauaugcuacguguucuucaagguccaacccaaauucuuuuuuuauugagacugagucucacucugucgcccaagcuggagugcaguggcacgaucucagcucaccuugaccucugccccccgaguucaagcaauucuucugccucagccucccgaguagcugggaucacaggcaccugcuaucgccccuggcuaauuuuuguauuuuuagcagagacaggguuucacugucuuucuuuuuuuuuuuuuuuuuuuuuuuugagacgaagucuugcucuugucccccaggcuggagugcaaugacacgaucuuggcucaauauaaccuccgccucccggguucaagugauucuccugccucagccuccccaguagcugggauuacaggcgccugccaccacgcccggcuaauuuuuguauuuuuaguagagacagggugucaccauguuggccaggcuggucucggacuccugaccucaggcgauccgccagccugggccucucaaagugcugggauuacaggcgugagccaccacgcccggcccaacccaaauucuuaauaccuuccccgacuuccacauccccagccaggccaaagggaucccucccuucucugcaaagccugugcuggauccuacccuaaguuccugcuucuugaaggguguggggcucugaggaugaaaauggacacuuguccuuagcacagcugcugagcagaguugcuuggcaggcccagggaggccauguggaggauuggaggaggguauaacuuuaagagccagagugccugaguuugacucgcagcugugccacguacuggcuguguggucuuggggaaguugcuuaaccucucugugccuuuguuuccccgucuaucuauauauauauuuuuuugagauggagucucacucuguugcccaggcuggagugcaguggcaugaucucggcuuacugcaaccucugccucuggguucaagcaauuuuucugccucagccucccaaguagcugggacuauaggcacgugccaccaugccuggcuaauuuuuguauuuuuaguagagacaggguuucgccauguuggccagucucgucuugaacuccugaccucaggugauccugccucagccucccuaagugcugggauuacaggcgugagcccccaugccuggccuguuuccccaacuauaaaaugagccuggcaauaguaccuaccacaagggggauacuaucaaguuugaucugcuaaccgugauucccuucuuaaaaccgucuccuccucauaaagguaugaggauuaaacaaauuaauauacauaaagucccuggaguaguaccuaucauguagugagaacccaaccaauguuaacugcugcuaucuuuccuauauuccuaaucuuuuaauuuuauuuaauuauuuuauuuuauuuuuuagagacagagucuuacucuguugcccaggcuggagugcagcucacugcaaccucugcaucucggguucaagugauucucaugccucagccucccaaguaaccgggacuacuggcacgugccaccacacccggcuaauuuuuauauuuuuaauaaagaugggguuuugccauguuggccaggcuagucucaaacuccugaccucaggugaucugcccgccugggccucccaaaguguugggauuauaggcgugagccaccacgcccaggccagccccuaaucuuuuauuuauuuuaauuaauuaauuaauuuauuuauuuauuuauuuugagauggagucucgcucuguugcccaggcuggagugcaguggcaugaucucggcucacugcaagcuccgccucccggguucagccauucuccugccucagccuccucaguagcugggacuacaggagcccgccaccacgcccggcuaauuuuuuuuuuuuuuuuuuuuuuuuuguauuuuuaguagagacaggguuucaccguguuagccagcauggucucgaucuccugaccucaugauacgcccaccucagccucccaaagugcugggauuacaggugugagccaccgugcccggcccccagccccuaaucuuuuuaaaugaggaaauccugguccacuuccccagggacgcuauuucucucuaauuccaggauucuagucugagccauuccaaauaccaaaaaaucuuaagcaaacuucauucuacuagcaaaguuaacauuuauugagugcuuacuguguguugggcacuuguaaauuuuacacguauaugaauugaacuccccuaagucuugggaggcagauaguaucaucauuacccucuuagaaauaaggacacggaggcacagaggaacugguugaugggccuaaagaucaugcggcaaggucagauugaagccagacagugagucaccaaggggcaacauguuuaacuggcacacuguggccagaagagagguguccuauuacuucuccccugccagcaugcagcaagcaugaggaguauuuccuauauucggggugcaccagaagacucuguaccccauaucucauugaauccucccaacuccccaguggagccauuaugaucauuuccaguuuuggguuuuuuuuuuuuuuuuuuuuucugagacagaguugcucuguugcccaguggugugaucauggcuuauuccagccuggaccucccuggcucaagugauccucccaccuccaucuccugaguagcugggaccacuggcaugcgccaucaugcccggcaaauuuuuaaauuuuuuuguagagauggggucucacuguauugcucaggcuggucucaaacuccugagcucaagcgauccuuccgccucagucacccaaagugcugggauuacaggcauaagccaccgcacccggccccaucucaauuucagacaaaaacacugagccuuaaggaagccgagccacaggcccaagucaccagcccggaagcgguggggcaggccagguuuucucuggcaaagggcauugccccugccaccagagcacagcuguuuccacacgacagaagccaguacaacucuuaauuugacaccucuggucucaguauagccaucacugggccucucuguaggaugccucucuuggccaaugcagguuucuuccuccugagcgaugugaccucugguuccuccuacuucuuuggagcucucgggugggcccucugggguucugccggcugggcgugguuucuuccucagcagcugugacgucauccuccccagacagagccaaggcugcuucuaaggaugaaggaaagcgggcgcuuguccucagcacagcugcugagcagaacugccuggcaggcccaggaaggccacguggaggagugguggagggugugagucaggagccagagcgcccucacucggcccucugcaucccuucuuccacccagcaacucuuguuuuuguuguuuguuagauauacaaauaacauaugcacacaguaaacuuuuugaacaaucuagcaaugcauaaaauaacaagugaaauuucuccccuugacccuccuccggaucccauuccucagaggugacuaagcauugguaacacuuucuggugucuccuuccagacccuucuagguauauaugugcauguaagcauggaugaguauauauguauguauauauauacaagacaaaaaggaauuguaugcacacguauauggucuuuugcaacauaccuugcacucagcaaugaauuguggucgccguuccaugccagcacucagucauuuuuauggcugcuuagaauacuaucgucuugauuucucucaauuuaauuauucaguugcccccugaggucucuauugauggagauacacacacacacacacacacacacacacauaucuuauauauuauauaauauauaauauaaauaauaaaaccaaauuuccauucagugagccagugcaaucccggcucacugaagccucagccuccuaggcucuggggauccucccacuucagccuuccugguagcuggaacuacagacacaugccaccauagcuggcuaauuuuuuaauuuuucuagagaugggggucucacuguguugcccaggcuggucucaaacuccuggacucaagcgauccucuugccucagccucucaaaaugcucaguuacagguaugagcuaccaugccugguccacauuugguaaugagaugccaucuacucccucgcaagagcuagaauggacuugcaucuucagaguuucaaaaugccaggacuuauaauaguaacaauaacuuuugaugaugauaauaauaaccaagaguaauauauagugugcuuuucuuuauuuuauuuuauauuuuuuucgagacagagucuuccucugucacccaggcuggagugcaguggcaugaucuaggcucacugcaaccucugccucccagguucaagcgauucuccugccucagccuccugaguagcuaggauuacagaugcccaccaucacaccuggcuaauuuuuuuuuguauuuuuaguagagaugagguuucaccauguuggccaggcuggucuugaacgccugaccucaagugauccaccugccuuggccucccaauguguugggauuacaggagugaacuaccgcgcuuggccuguagugugcuuuucaaaaacaugaucuuacucaauuauaucacagaauaccacaauuaauaaaaggucccccaaauaaauauaguuaaacucauauaugaauuuuuaaaaagaauagaagaaaaaggaugggcuguggagcuaagcuggguaaggagagagaguagaugggggugaccggcaguggcauugcccugggugcaguggguugaaagucgcagugaugagaacugacggaaaggcuggaaacugaauggagaguggggcccuugaaacugagauuauggaggggcagacaauuuucgaugaagccggccugcacggcgugacguguugguguguggccgggaagguauagagagguggagagaggaggucgcagaacugagcggccaagaagugggaaggguccucuaggcggacauuggaaucaccagguauucugauagggcccgugucagagugaccaggagccaggagcuccuccccgacuagcauugaugcuggcuacagacagccacugccagugcccaccuuggaaucuuuuucauccuggccuccacucugccucuaacucucuaagaagguacaagggaggcagacgguccccuucucuagcagagaacccagcucucccagagcaggacaccccugaaaccaucgaguguccgcugcacuggccucgcaggucacggugaacacaucccuggaaucccuacuuguuggaacucugaauacacagcaggcuuugggcccacucugggaccuaccgaggaagugguuuccccccggaaguggagggaagccauuaaacucucuaccuguuaaaaugcccaccugcuaaggaggauugguacuuaccaagauguaacauuccuccaguagcgagcgagcguuuccugagcuuggagccugaaaugaggugcucaggacagacagugccugugccuuggaagugugaugucaggguagggacucuucuccccauugcacgcaggacauagcagaggcucagagguugcgugguuugcuugaugacucacagcaggaaaugcagaguggagauucacacccaggcuguugugacuggggucugagcuuucucacgcguaugucucaucccucccuaagccuggagcuucuugaggacagggacggauucagaucugguguccuuucagcaguuagugugucccccugcccagaaucaguacucaauaaaugaugauggggccgggcacagugacgcacuccuguaaucccagcacuuugggaggcucagaucggaggauggcuuaagccugggagguggaggcugcagugagcugugauuguaccauugcacuccagccugggugacaaagcaagacccugacucaaaacaaacaaacaaacaaaaaagugaugauuggcgacucagcccuucuuuccucuugccucuccucuugggacccuucgucgcuacuucagacccuccaguacccucacgcggcccuuggcccuuccuaccacuguagagaccaguuccucuugaagauauuguggguuguguuaucuaauugacuaugaagagagcuggagccagggguucuacccaaagugacgucuccuuccccuccugggccuucuaggaagaaagcugaccauacacagacaacuguggaggaggggcgguucugugccaggagcuccuuuugggagccccuuaacucucgcccagggggaccugccucgcguaaggcgggcgguggucaucauggggcuggcagagggcuggugcaauguucgggacagcuuaacccucuuccuccccuguugcccuagaucauccugaacuucacgucccuggaccuguaccgcagccgccugugcugguacgacuauguggagguccgagauggcuucuggaggaaggcgccccuccgagguaacggcaccagccacccccugcccccuccaugcugauucccucucugagccacccucaucacacucuucaucccccuccagggcccaacacuggccagggaugacaaccugguaugggagccaggaguccuggcaucauuagucccagauagcugcauuacucacuugcugcgagacuucaggcaaguccuguccucaaucuggacuucagaguacccaguccagacuucugggccucccugugaaguuggcugucacccuacgggugcaaggagucaucagaauugacugagagagacagacaggcuguucugcgcauccccauggccccaggcucucuuccucaucugggcacuuucagaggauccacuauuuuuuucuaucugcccuucugguuuuugagugcccacagugcagccuggcucaaaagagagucaucauaaccugccagcccaucuccuaacucacugccgagggcugcacacugggcgccguggcccgaccuugucugcauaggauacuuugucccgaggaggguagggggcaggaggugagucagugggaguaagugggucagaagcacagaacagaaggugcuuuaaugaaccuagaauuagggcaaagggaggcaggugauccuagaggguauugcagcaagcccgaggagccgugugaaucuccuccuagcuggacgugaucguaaggagcucaggaccacucuuuggcaacagaaccucuucuccucagccuaugccuaaaacagccagacggauauugcuaaccucuauuuuccccccaguuuccgauauuuaaauauuucuuuuuggucacucaaagcagcuguccuuacaacacuuccucucguagacguguuaguguuuuuccaagaugggaguuucuuuuucauaacuuacauuccugggccagcacccucugucccuugcugaauguugggaaacaccggccuuauuaggaacacacaacucauuccuaguugauucuugacuacaaagaauuccacagauggccgaccucauucacuuauguugauucuuauucauuuuuauuucaaaguggacauuuugugagcuaguccccagauucugugauuuauuuaggguccuggggcaucccuugcauuugaccaaauaaaaacaugucugugagggcaguuuguaauguguaaagaaagccauguuuauuucugauuauauuucugauuuuauuucuuauuuggucucuucuuugcauagagaccaaauaagaaaagguaaauaaugaugguaauaugcucuuuagaaagguaaauagaacacauauauaguuggacauuauaaagaucuaccuuggccaggcacgguggcucacaccugaaaucccagaacucugggaggccaagguggguggaucaccugaggucaggaguucgacaccagccuggccaacauggcaaaaccucaucucuacuaaaaauacgaaaauuagcugggugugguggcagaugccuguagccccggcuacuugggaggcugaggcaggagaauugcuugaacccaggaggcagagguugcagugagccaagagcgugccacugcacuccagccugggugacagagcgagacuccaucucaaaaaaauaaaauaagauaaaaugaaaaauaaagaucuaccuuuccuccuagaaauagacucauauccuaucccucaaguggucucuggcucuccaaagccaaguuggaccuuggaccagacagaagccaaccagaggguauacagucuugggaaugugugaaguaggguggccacagaucagggcccaagcacccaagccuccuggagagguggggccucuauaggggguguccucaggguucaccacucuuccauccacacugucugugcaggccgcuucugcggguccaaacucccugagccuaucgucuccacugacagccgccucuggguugaauuccgcagcagcagcaauuggguuggaaagggcuucuuugcagucuacgaagguacugaggaaggcggcgggcgggaggagucagauaggaggucucugggcaugguaaaacaacucccuccuggcaccugaggggcaagauuguggguucccaagggaagaagcagagagaaugaugggauugccugggacuggggguuugguggggaacugaaaagcugggggacaugggagggacuggaggaguggggaaaagagcucccuagcagggcaaagcaugcugacucaccaccccuucccaccccauccuguguccccacagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagguaggucaguggcccugugaucugaccuuugaauccagcaguugcucccugggacagcugccucucuuugggcucccaggggugggucucuggcagccagagccccuuccacugaugaagccucgaccccuagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaaggugccuccucuguuacucuccccugccccaaggugccucgugaccuucaucccuucuucacucacucauucaacacggagacuccaggaggcauauugauaccagugagaccccagggcugugcccuuaaggagcucugggcuagcuggggagaagaggucccccaauguggauuagaggcaggaccugcuguaugauucagggaggaaaaaaggcaguuggagguuuuuuuuaccugugugaccuugggcaggauauucucccugaaccucaguuucucaucuguaaaaugggcacaguaacagucccuccgccacaggcuucacaugaggauugaaggagaaaugaaagagggguccuuagucagggaacagcacgugagagacaccagcccaguccaugugcucugaaggaaggcucugugggguuccagccaucggggagcugggugggucuuggggcugaguggacaagugaggcucacagccagcuucuucccuugaaugccuggagucugugacacccuuuccuucccaccacagagguggacgagugcucucggcccaaccgcgggggcugugagcagcggugccucaacacccugggcagcuacaagugcagcugugaccccggguacgagcuggccccagacaagcgccgcugugagggugagugcccccagacugccucugacccuguucuuucccuggcaccagcccaccugcccagaauuuuuuuuuuuuuuagacaggcuuuugcucugucacccaggcuggaaguacaguggcucaaucuuagcucaccauagccucccauuccugggcucaagcaauccucccaccucagccucccaaguagcugggacuacaggugcacaucaccuugccuggcuaauuuuaaaauuuuuuuuguagcaaugaggucuuacuuuguugccgaggcuugucucaaacuccuggccucaaguacuccuccugccucggccucccaaagugcugggaucacaggcuugagucacugccaagauuucuuaugcccuuggacagaccccuucuuggaaaagcuagauggauaccccaacacucuuuucauagcucauggauaagaaacacaugucacauugcaaccccgagaacacacuguccccccguaggccgcauucuggcuuuggguuuguuuuguuuuuucauucuugggguguuuucggguuuuuuuuguaaaugaccaucuugacuugcuaacugauaucaccacccaccaggguguuaugaucuacagguugggaaaccccuguugugggacagacacuguuuccgccucuccacgcauggucccgagaugcuggggacagcacuccgaggcuaauggcuccagcucacuaggccgauccugcugugcccccgagcugcucccuuuccugcaccucccaggaccgccccucccugaacugcuuucccugagccccuuauucccgcucacucccucuuggaggaccuuggccuguucauuugcagagaagauagaaauggccacacuuaugaccccuuagcucccccacuccucccuacaggcccaccccugaggacacccaggccacccugccuccucccguccgccccagagggaccagacacaggucccugagccuuggggaguccacaggcuccccaucuucuccuuacugcaucccagcccacaucucagcccuuccccauggcaggggcuccccgcagacgaugccaccuuccuuguccccgcagcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugauguaagugcccaccaggggcugagguggggcaggaagcugugaggcgugggcauucagcucagugccugcuuccuguccucugagagggggcccggcagaaacacucugcaaauaucgaggagagacugcucccagcucacgaagcacaggaggcccagcagggagggccccaaagggggcggggggacauguagcaagugggaggaaggacauggaguuagggaggcguguggagcaagggaaggcuuagggcuggcuuggcgaguacaggaggauccagugagggggcguagcuaagucaaggcuaaaggaugugcagaacagagagcuucccgagggcaggaguagucaagagaggcuuccuggaggaggcgggccuggagcugggcuucccugcaggugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagguaucccuggacugcccagcuccuagccccaccucuccucggagaacagggcucccuuucucccugccccugcaccccuguacuccccagcccucccuggugccaggcaggcagagucugcccccugcuccccaccacuucacucucccaucaagccagcccuuccaguauccaaaucucauuauuccugagcccucaggacuguaaugacuggggccugaggaugggcagaacauaagcauucagaaaucagcacccagaagugaagaaggggauauuccaggugucaggagcuaugcaagccaaggccugggagagggcagguccuaggaacaggcaguucaagaacguggguggauggaggagagacagguguuugccuuggacuguguggagcagagucucuggcaguggcggacuucuaaucagacccugcacacgccaaauagguucacacuggggccuucagaaagaugagucguggccgggcgcgguggcucacgccuguaaucccagcacucaggaaggccgaggcaggaggaucacuugagcccaggaguucaagaccagccuagacaacauagcgagaccccaucucuauaaaaaaguuuaaaauuagcaggguguagucgugugugccuguagucucaacuacuuaggaggcugagguaggaggauugcuugagcccaggaguuugaggcuguagugaacgaugaucucgucacucacuccagacccuguuucuaaaaauuuuuuuaaaaaggagaaagaugagucaccugcuuccuucaauaccaaagccuuggggcuccccugaaccggugggcgggaacucagauccaauuagcacaugcugauugacagcugccccaccuaaggccugggcuccagucccuuggccucauuugagccuuugauggccccaucuucagguggucucaauggugaucagcagccccuggcccagccucucucagcugauccuccggguccaggagaucuccccuucuuugugaaucacucagcccuucacccuggggugaggcuguaagguagcugguggucuccagagguaacaggacccaggcccaugcagugaagggcaggaguggaguugagcaggggagacagggaggucagagucuggcuggagcaggcccauggauccucacucccggccugccugcugggccggacaggggauaggcaggaaggcaggaugcccacggccgaguccaugcugccuuccuucuccccuccuucgcccaggguccugcauccucaagcccccucuguggcugcccugcaccccugccugacccccggaugccaugcaccugccccugcacuggcucccugcuuggcacugccagccacccugcucugcuuacaguggcccguugaccuccugcccccaacccccgcuugcugagacccuccccaugccaggccaauuucuuccuucccugugcccaccugggacuccuaagaggugcucaccagaggguugagaggauguaacacccacucggggcaggcucugccccgggaaaccauuaccugcuuacucucgucucuuccugcccuucuguugcuccagucuuggagggggcaggggaccgacacucacaucuaucaggccuggaguuacugcucugcccccaugcccuggucgacacugugcccgccccacccucagcccugcacggagacacacacgcccacacgcacacacaugugcacacacauugccccaucgcacaagaaaccugcagaggacccccacugggggcaucgaggcucagcccucagggcccggggcaucugacucuggccccccaggaggggagcuauuuggacuuuugggacacccaccgaggagacccuaagccaagaaggagaagaaagagccugaagaccuucagucugaccccugccaccuuccggggcauuugggcacuguagggugagugccaucuccuugccugggcccaugcccaccuccuccaccccaccccccugcaaccugcuccccccagcucccaggugaggcugcccacuccugccccggacacugaagcagccuuccucaggacucacuuucccccacucauucauccagccauucacuuacgcguucacucgcauuuggcagguguaauuuuaccccugcuguguaccaggcacuggacuagguuucuagggcacaaaugugaggaagggguggagcgaaggcuuugcucaguccguaagcugggccccccaaagcuucuagcacagucacuggagauguuguccuuagugaaccccaggauggcucauagggugcccuucacccccacauuuucugcagggcugauucaaaggcagcucauggagggcucucgaucaggcccccucugauguguuaacugagcaagaaaccuugggaaggacuuggggacuccaccucuuggccugguucccauggccccuaggggucuaaccuaccugauccuggguuggagaagcaggaccuucuggaagcccauguuccagcgcuugggccccaguccugauggggaucaggaauaggcccccuugcacagacccccaccuggccagcucagugccagcagacaucuuucuaccucaugguucaucuauggaauucuggggguccacuggaucccucaucuucccuggcuaugccugcuucuaugccaggcacaccauccuccaagugaccacagacagaccugaguguauguggcugcggcacacacaccccugugaccaagugcacuucugugcauuggggcacagauuguguguucaucgugugagugcaugugugggucugugacacguggccguugcuccucugugagccaucugcugaugagcuacaucucugccuuuacgcgugacuuuguauccauguccagguguccaugcgccugugugugcagauguguccugucccugggugugucugugccugugugugcguugauaucugugccugccucuucacacauaggugggaaugcagaguguguauucuuuguaugcaccuguacacaggcugggcgggcaagugaggaugcguaugugguuggcugugucuguaucugcauuugcaugguguauuggagauuggagcugugugucugugcguguguggguaguguguaccgugugcacauguaugugugugccuguggaccagcaccuguguugccacauuugggugacgguacauccaugcacugggucugcagguguauuugcgagugcgugugucugucuaacacacucuguagaugucgccgccugaaugagagccagagcagagcucuccccagcccuucccaaguacuguuccccucuaccgacgacuccccaguucucuccuucccugaugcaaugcacgccuagugggcuacgugugccaacccuccaggccuucuccugccacaggcucugucucugucccgucgcugugccuccugccccugcuaacccagcccuccgugcccuggaugcgcccggacauggccacccugcauguguguccgccugcccucccgccccacccugccccucagauccaccucagaggcccugggucugguuuucacugcugucccucccuggucccugcccuccacccccaccccuuggucccuuuucuccuucucucucucguuucagaaaagaggccagcucugcagcccccucggggacgcccccaccagcucaaauuccgagugcagaaaagaaaccggaccccccagugaggccugccaggccucccggaccccuuguuacucaggaaccucaccuuggacggaaugggaugggggcuucggugcccaccaaccccccaccuccacucugccauuccggcccaccucccucuggccggacagaacuggugcucucuucuccccacugugcccguccgcggaccggggacccuuccccgugcccuacccccucccauuuugauggugucugugacauuuccuguugugaaguaaaagagggaccccugcguccugcuccuuucucuugcagucugcuuguccaugugucuauuuuuccacuuguccaucuguccaguaagcagguaauggugacccaugcugguccgcucggacccccauccuccucuccccacagcugggcccugcucagcugguccugcuggaugcagugccccuuuggacccccuugucgccuggccucccacucccggccaccuggccuggccagcucugccagcuguugcucugucccggugggagaaaguccagccaggccuccacuuccccuggggcaucccaaccucagcccugcacagacccagcgucugcccuuauuugcuccccugcagacaaggacgagugcuccaaggauaacggcggcugccagcaggacugcgucaacacguucggcaguuaugagugccaaugccgcaguggcuucguccuccaugacaacaagcacgacugcaaagaagguacgggcugcaugccaggggcaucugggcuugaaggaccugcugcugggaguggaagcccagaggaucaucuccaucagccuccguuuagauucuggggccuguaugaucucuaaggcccccucauucccccacccaccugguacauagauccuccucccgcagugucggagccacacgcucacuucuguugcccacauuaggagaggaggagcucacggcugcucugaggcuucauuuucagacuuuucuaguuugugcuucuuaaaaccauguccaagucucuuugugacuuccuaccggcacagaggcgagaaaggauaguggguaagagcacagccuccagagccagguggccuggcccagcccugccgcuucacuagcugugugccuuugagugacuccuugacccucucugugccuugguuugcuccuggguaaaauguagauaauaauaauaguacccaccucagagaggcauugggagcuugaagggccccaagcagggccuggcucaccgcaagcacaauggcaucuguuaccacuaucagucacacuuauaaccccuggggauggucagaacagggccacugccuuccuggcagugaagcccugcacacauuuaaaaauagcucuaggccgggcacgguggcucaugccuguaaucccagcacuuugggaggccgaggcaggaggaucgcuugagcucaggcauucaagaccagccugagcaacauagugagacucugucucuauuuuacuuuuaaacagguuuuuaaacuagaaauaaaguaaaauaggccagugcggugguucacaccuguaaucccagcacuuugggaggcugaggugggcagauugcgucagcccaggaguuuaagaccaaccugggcaacauggcgaaaccccaucucuacaauaaauacaaaaaauuagcuggaugugguggugcaugccuauagucccagcuacccuggaggcugaggugggagaaucaccugagucuggggaggcugaggcugcaugagccgagaucacaccacuguacuccagccugggugacagagugggaaaaaacaaauaaaaauauaaauaaauaaauaaagcaaaauaaaaacagcucucauggcaucaccaguauccccuaauaccuccugggacuugauaccucacaggcccgcucuaagucagggauuccacuguggcccuugccugcuggguguguccaaucccagcagcacaacacagacuugccucuaccauugaacaucugugugacuuugggugagucacucaaccucucuguguuucaguuuccucauccaugaaacgauaaaaaaugauaggccaggugcaguggcucacgccuguaaucccaguacuuugggaggccaaggcgaucggaucacuugaggucaggaauucaagaccagccuggccagcgugaugaaaacccgucucuacuagaaauacaaaaaauuagccaggcguggugggacgcaccuguaaucccagcuacucaggagguugaggcaggagaauugcuugaaccuggaaggcggagguugcagugagccgagaucaugccauugcacuccagccugggcaacagagcaagacuccguuucaaaaaauaaaaaauaauaaaaaugauaccuaccuugcaggguacuaagcuuuauagacauggcucugagccauuagcaccaugcuuggcaagugacucuucccacccugguuagguugacaacccagguuuaaacagaugagcugcucacaagcagaaacagaaccgaagcccucaacagugaaccaguggacagucgagggcuuccaacccugugaccucaggcuucccaaauacacaguuccugagucauggaacuagcuagaggggaccuuauacugauauugucuaaacugcauucugucucuguacuccccuguguaaaaagaugguuugauaaagaacagaauccacaagauagccaggacaggggugaagcuccuggagaagauggccuguuuaccuuuccaucugcugauucaccuuagaagcaugugugguuucuuacucaggugauagguuaauuacagaucuguaagcauuuccugauuccuauggaggacccagcacuaugcaaagaucuguaggggauucaagacaggaaccccucuguucccacggagauugcagccuagcuggggagagacaugggcgugcaaggaacacagggggcguggaaggccagagcgcaaagagggagggcagggggcugugugaacccaccgauggguaauggugacagcucacgguucaaguguggguagacgggagcuucaccugccucuaccagggacuugagagggcccuguuuuccgggcccucgugcuguaucuugcccauccuucuccccaccagucauagugccuggccgccuguuucccccagugaaagcuguccaauaaugucaucaugaauaaugaucaucagcuuguaaaucugagucggggcagggcgugguggcucaugccuguaaucccagcacuuugggaagcugaugggggcagauugccugagcucaggagcucaagaccagccugggcaacauggcaacacccgucuccacuaaaaauacaaaaaauuagccaggcgugguggcgcaagccuauagucccaacugcuugggaggcugaggcacaagaaucgcuugaaccugggaggcagagguugcagugagccaggaucgcgccacuucacuccagccugggcaacagagcaagacccuguccccccccaccccgcccgcccccgcaaaaagaaauugaguuggggaagccaugcuuuucagaggcagaagucagauugccguggauugaggagaccugccgugagaguguggccauagcgaguguucucgaaggcuagcuggaaacaaaaggagagcgaugggcuguagcuggaggggccugggagagcucuuucaggaugugugaagguuccgaggcugcagagcugagugagagcgugaggcuggaucauuuguggugugaggguucccacgcgugggcagcaaugagcugcaccucccagaagggcaguccauccugacggggaggagggacacuugcucugaggcuucagggcagcaggguagcaggguagguggguuugcaggucggaguccagagguugaagccauucaugguggaaggcccuggcuuugucaggagguaggagagagguggucugccacugggagcugacacaguggcuugaggagggggcuggauguuugcagcaguuacuaaggaggugagagauggagcugguaaaggccaauccaaagaguaucaaguggucugggggcccaggugaggcuggagccacagguggaguuuucuaagauagugcugugcagagccggggaugcagggccacgcagggugcagaggagcaggcuggguggucagcccugcagucaguuaagucaaucgaggaggaaauagugggagagaauagaaagaucaagacccuggaggucucucuaaaauuaagaggccagccaggcacaguggcucaugccugugacccuagcacuuugggaagcugaggcaggaggaucgcuugaauccaggaguuugacaucagccugggcaacauagugagaccccaucucuacaacaagcaaaaaugaaaaaaauuacccagguggcaugccuguagucccagcuacuugggaggcugaggcgggaggaucaauugagccuaggagcucaaggcuauggugagcuaugaucgcacuacuguacuccagccuggguagcaaagugaggacccauuuuuguuuuuguuuuuuaauuuuaauaaagccaaaugaccaugaucaggaaggugagguccugagcaccccgaaggaacaggagguggccacagaggggugauguguuugugaugugaagaaacaguggaugaugacaaagcccucaaggaaccgagaggccgucuuggguggaccguuauaugucuguugacuucaccugggaggguagcaggaguggggguggggagaacugagucaggugucaaaguccccugugacuguccaggcugcuggagaucaguggaugacagcuucaaggaggggcacaggucagccgggugcaguggcucacgccuguaaucccagcacuuuggaaggccuaggcagguggaucacuuggggccaggaguucgagaccagccuggccaacauggugaaacucugucucuacuaaaaauacaaaaauuagccaggcauaguggcucacgccuguaaucccagcacuuugggaggccaagguggguagaucuccugaggucgggaguuugagacuagccuggccaacauggcgaaaccccgucucuacuaaaaauacaaaaauuagccagagaugguggcgcacgucuguaauccaagauacugaggaggcuaaggcaggagaaucacuuaaaccugggagguggagguugcagugagccgagaucacaccacugcacuccagccugggcaacagagcgagacuccaucucaaaaaaaaaaaaaagaaagaaagaaaagaaaaauggagaggcacaggugauaugaccccuguggcccaacaccuacaaaggucuggggguuguccagggagccugcgauggcugcuucaugagugcugccaugugaggccucacucaaggcuuuuguaggaaucgggcagcuagauuuuccccagacgcaguaaccucaugaaaaagaaacgaugccugccugccauccaguucauaagugggacaagagauggaagaaaggagggggggcaggagggaagggccuuccccacaggaggcaucggagcuuggggucccucucuauccccuuccgucacucgcuucccugcagccggcugugaccacaaggugacauccaccagugguaccaucaccagccccaacuggccugacaaguaucccagcaagaaggagugcacgugggccaucuccagcacccccgggcaccgggucaagcugguaagggguccccuccccacuccuuaugcgguguggcugcccccggucagaggcacugcccagagccacacaggcugcaggcugagcccagaggucugccauccccaggagaccccaagucuggccuggacagaggccccuuucccaguauaaauuaggggcgucccugccuucgcccuauuccugggcccuccuucacugucauccccagcuguggcugcucccauggguaucugugaggccuagguuuggggcccucauccuugccccaccugccuuccagccaaauuuuuaaucugugcuccuuccucaucccccuagaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagguacuguccccgguugugggaguguucacugagccuggucuccaagacugggguagagucggggguuucaaugcggguaugaagguacagagggacugagcccugcgacccagggccaggguugugggugaugcaaacauuguguccugagaaccaggccuggggggcagggauaggagggugugguuagggguuaggauggcagugaugacgauggacaggagaggugagggaacucagggacagagaggaaagcccccagaggucccccugagcguacgcgggccaccgcagcagcccagccacacaccaacccugaaauauacucuauucauucucugauauuuauuuuuuuauuuuuauuuuuauuuauuuuuuauuuuuugagauggagucuugcucugucgcccaggcuggagugcagugguucgaucuugguucacugcaaccuccacuuccuggguucaagcgauuccccugccucagccucccguguagcugggauuacaggagccugccaccaugcccagcuaauuuuuguauuuuuaguagagacaggguuucgccauguuggccaggccagucucaaacuccugaccucaggugauccgcccgccuuggccucccaaagugcugagauuacaggcgugagccaccgugcccagcccauucuccugauacuuauugacauguaacauggaugaggcggcauccuaaaugcaggucccagaaacagaccaagcaaagaucccagcccuugaggggcuugcucggcuuucacuugcuuguuuauuuagcagccaugaacugagcuccgcucugcgagaggacuaaggggcacguggccugaaucaggcaugagcccuucacuccugccccccaccccauacuaggaacucgcaguccaggagagagacaaggcaggcaccgcccgugacagcaugagcccaagcgggagccaggcaggaagaaaggcaccccggccuaacugggcauguguugguagaggcauucgaggcagggggaggugcccaggcagagacacaaccccagcccagcccagagugugcccaggugacagcaggucauuuacuuuggccgaagcaaugggugugugaggacagcagguugugggaaugauguggcugcagagaaaggcuggaguccagggggaugccuugagugccagaccaaggaugccacgagggagcuuugcagucuccuccuggguccuaagccaccugucagggcauccccagagcugaugguccacagccuccccucuuccccuucaacucagucccugacccagccccguccuucccucuccccaccuccucuagcgagaccugagugccaggugcacaaaagccagagggccuggggaggaggguggccccaugcacuguccucugcccuucccagcacagggucacaaaccggaggcccggaacuccaucuggcccucagaccugcuauguuuggcccacacuguguuuuuuuuaaaaaugugagccaacacuuaaaaguuaggaguuuucacauaaaacccagauguacggcuucucucuugaaaauggaagcuguggcgacacugggcccacauucuuccaugacagccaucagcuggagaaaaugagcaaugcccucuuuagacaaaguguguggugccucgugccaccgcuccaugcugucuuccucucggugagccucacugccuguuccccucagccuagggccaaggucccucuauuuagagauggggcagcacagcaauguucugggccaggcccccacccacccaucacuggccucguggccuucacccaggccuccauccugccgugagggcacgccauggcauagugugccauggggccuggcaccugcggugcucagggcugguuggccccucuuguccccuacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcucuucgacggcuacgacagcacagcccccaggcuggggcgcuacuguggcucaggggugaggcccccaccccucgcccuccuggccccaugccccacgccccacacuguccuccacccuucucagcccagucuccaagaccuagcgcccacacaggccccggaaguugagugcagcacgcguguggcccugugugggagcccagaagcccagccuuguuggggcuacucagagacacugccccauccccgacguaggaaaccaaguccuuucugggcaaccuagaaguuccugcggccucugacccaggccugccucagaaccaguuggccacggccuggagcggauggagcuuccucugucccuccuuuccuuaccccucccccaaggcagcccaccagggccuggaauggggggcagagguuggcaccagagccggggacagggcgccugagcggaguggcccucaccaguccuuuugccggaggcauaaacacucuugucauuuccucuaccaguuucuccuccugaugaaaggccagcuugucccaaagcucuugcugcugcugucccaguggccccugggcacugcuucuugguccauaaaauggcacguuaagagucaaugagcaaaaguaggcuugaugggcuuuucccuaaggacaugggcuagccucguggggaggauuuauuuuccucccuguaagagcuugcagcugccucuucuucuuuuuuuuuuuuuuuuuuuguccuuuccugagggcuucaaagagacagacugucuuccuacccaucucucucucuuucccucucucucucucucucucucucacacacauacacacacacuggcacacccacuugcaugcacuuucaaauacacuggcccuccugucaccucccuguccccuugccuaucucauggcuguaucccaggcagccugggugccccaggaaggguuaaagcuccuggaagcugcagcagcugcuggacccagcauuggcugaaccucccccaggagcagagcuucagcccucguguggcuggcaggggcugggacaagguggagccugaagcagcuuggcugcccugguguccccuggcugccaggcuaguguccccuccccucuuugcucuuucuucugaaucacacaccaaaucggauguccccaggugucuucuuccagagaccucccccaggcugaguugaccggaaggaacuuggggaaggaucagggccuccuggcacaacuacucggaauguccucaagguucucagaaaugauuucuucugugccuggaaggccagggcguugacguccgaugcucugagggcugaccucacucaguaggcuugcaggaggcaccuaagaagggcucgggagcagaccuuggccaggugccagaggagaggcggggcaagggguagggauggcagaguccaggccuggggggcacugugcuucucuccaaaacuuccuccacacuccagcagagaaguggcugugccgucuucccuaagaguccacugggacagcaggaagugaugccauucaaagaacucccucccuuugcaaaauacuuugacaucggugcaguccuuuguuuuuccccagcaccccuccuaggcauggagagcagagaccuuuugcuccuguuuguggcugagggaagugaggcccagagaugggagguggcuugccugagacuacacaacucauuuaguaguuauagcagagcuggguuuacgggaacuuaguucucuucggcccacgccuccuccccuccccagguuccucauuaaaccagcaagaagcccuaugcuucaaggggcggggagaaucugguggcugccugggagccuccugcccuucaaagcuggggaucuuggggaggcaggacagcagccccagccccucuuccuccaccuuaccccaucucuuuucucugccagccuccugaggagguguacucggcgggagauucuguccuggugaaguuccacucggaugacaccaucaccaaaaaagguuuccaccugcgauacaccagcaccaaguuccaggacacacuccacagcaggaagugaccacugccugagcaggggcggggacuggagccugcugcccuuggucgccuagacuggauagugggggugggcggaaggcaacgcaccaucccucucccccaggccccaggaccugcagggccaauggccuggugagacuguccauaggaggugggggaacuggacuccggcauaagccacuuccccacaaacccccaccagcaaggggcuggggccagggagcagagcuuccacaagacauuucgaagucaucauuccucucuuagggggcccugccugguggcaagagggaaugucagcaggaccccaucgccaucccugugucucuacacgcuguauuguguaucaccgggggcauuauuuucauuguaauguucauuucccaccccugcuccagccucgauuugguuuuauuuugagcccccauuccaccaccccaguuuccuggggcacaagugucugugcaugucccccaggagccaccguggggagccgauggggaggggauggagaaacaagacagggcuucucucaggcccaguggccggucagccacaccagggcaccgcagccaauaaaccgaaaguguuacagccaauauccugugccagaugcugucugggccaugggggcggggccaucauguuccagauguaugggcuugcuguggaggcuggcacguagccagggcaccuggcaucacgggcugcccuucccuccccugaucccaggcugccaaggguguaauuucacacucaggcacagauacucgcaggcacccaucacagcgcgcacacacaccacacgcacugcucgcgguccucccacaugaggggagggguggaacauuccauaaaguggcuguuugguggggagggaagaaggaugugaaaggggucaggggu

SEQ ID NO: 17650 - RNA, 10095 nt, Homo sapiens
cacacgcggauggccccagagaccgcccgguagagcacacagcggccacgccuccccuuccgugacucccaggccccgcgccgccccgcgcgcgcccccgccgcccgcgccgcaguccgcagccacccggcgcggucagccccggcugcggcuccagcuccgcgcuccgcucuucucucccgagccggaucgcgggagcgagcaggggaggggaccgcagccggcgcccgagggcaggaggaguccgcaggcgggccccuggcugcgguagcagcugccgguggcagggaggugccagcccgcgcgggguggcccagccgcgggagcgguggggcgggggccgcggccgccggccccagggagagaucgcgggcagcauggcggggcugcgggccagggggggcccggggccggggcugcuggcgcucuccgcgcucggcuucugccucaugcugcaagucagcgcuaagaggccccccaagacgccccccugcccgcccagcugcucuugcaccagggacaccgccuucugcguggacucaaaggcggugcccaggaaccugcccucggaggucaucucccugugaguguccagcccuggccuuggggguuggggagggagaggaggccgaggacagcucugggagaggacaggagaacccccgcucccccucuucagagugcggggaccagggggacugcagggguccucagggcuggagauuccaggcaccagucgggcagggaguucugcaguuuugcaggcucagcggccauggguggggaaagcaggaguucaccaccaagaaugaaucaucaucaccacgagcgacagugagaccuacugugugcugugcuccagacuuggggggguugcuuacacgagcaugugggccccugccugugaugucacaccaagggcaggagaguggcggccagagcaggaugagaaugagcuaugcccucccagcacccuggcauggggcacaugcccgccacugaccagccacuuggcacucagcucggccagccugucacucacaacagccagccucaggggcucccccuugucugugggaccagagagguugugagguccuuggggaccaggaugccagcccccacccccaugccccaucucucaacagcacccagcccauuguggguguuuggaugaugaugacaacggugugggugauggaaccuuuucuugccugagagggaagcugagccuggggccaugggugccccaagaggcaauaggggaggacccuggugaaggcaggcagugaauuugggaggagaagggaaagacacacagaugggggcuaaauuaggugaaauggggcauuuccagggcaagugaguacaaaagcuacugcccuccguguucaccucucccugccucagcacagcccuugcagaccccacaguacugacucggguguccccgcaggacccuggugaaugccgccuucucagagauccaggauggagcguucucccaccucccgcugcugcaguucuuguauggauagggccuuguggaaggguugggggaacuauggggugguagcaggggacaaauccugggcuggggagagggagaguggacagaggcagccucugcagacgaagaugcaggugucccuugcuuuuguucugauaggauguacccaaaagacggggcagccuugagucaggggagucggggcagcaggaggacagcuagggauggcacagagaagccaagcaagugggaugcggggaugggcuuggcugcucuggaaaccccagagaauugggugcgauagccugggcuagugcccaaggugggcacuguggggccaucuuagagacaggugaucccaggaaucagaguucccagaaagagcugggggcugaaagaaagggauggcaggagugucuccaacccuacaagaugccguccaugagggacaguuguccaugaggggcuggaaugggacagaaugagggugggggagagggagaggagaugccacccgggaggaccaggagcuggcuugacaagagagcucugccuuggcccauguuuaggauccaacagggacccugggagcuucuggggccagaacaggcuccugccuggccuuguugcccagguggcccagggauuccccaugggguccccagggguagcagcagggcagucaugucuuggggaagcccagggcugaggcagcgggcugggggcuggggcagcaggcacacccuuggaagcucuaauuccaccuuugucucugcagguuacucaacuccaacaaguuuacacugauuggagacaacgccuucacaggacugucgcaccugcaguaucugugugugggagggaaaggggcaaugggaaagcagaagggagggggaccccaggccugggaggccgagggacuggguagggaguggaugagaaugccgcaggaagggaaggugaugggaggcgagagcccuugcaucccgugauggcaggaccugagcagaaggucguuucauucauuuugccucuacccuaccugaugcucuaucucuauggcuuggugaugccagacuccauuuggaaaccugucucggggacacgggcugaaaucuaggcuggggcguagggcgagugcugcugggggucuggcauccugugugagcacugaggcaaguucccgcuuuccccagcuucauugagaacaaugacaucugggcacuauccaaguucaccuuccgaggacucaaguccuugacucaccugugaguacgucacacauacacacacugcaccaaagccccaccucuccuguggccuuuggccuugcucaugaucuucagaugaccuggcggucucuuuugcagcucgcuggccaacaauaaccugcagacacugcccagagacaucuuccggccccuggacauccugaaugacuuguaaggccugaguccugccucuuccaacagugccgcagagggcgcaucccuggagggaguggugugggagucagaauugggauggucauaaggucuugagaggcugggaaggcuuggguggggggacccugaggaggugaggagguggaguuagauauagaugguagccuuccaaauuggaguuucucucaaagugcaccugagacaccauguguguauguuuucaaaauguguguguguguuuuuuuuuuuuuuuaauuauagacggagucucacucugucacccaggcuggaguacaguggcacaaucucggcucacugcaaccuccaccucucagguucaagcgauucuuccucagccucuggaguagcugggacuaagggacuauaggugugcgccaccacgcccggcuaauuuuuuguauuuuuaguauagacgggguuucaccauguuggccagacuggucucgagcuccuaaccuugugaucugccaacuucagccucccaaagugcugggaguacaggugugagccaccgcgcucagccaaaaaugugcugagccaccgugcucagccaaaaaaaggcugggugugguggcucacgccuguaaucccagcacuuugggaggccaaggagggcgaaucaccugaggucaggaguuccagaccagccuggccaacauggugaaacgccgucuguacuaaaaauacaauaauuaucugggugugguggcgggcgccuguaauccuggcuacuuggaagguugaggcaggagaaucacuucaaccugggaggcagagguugcaguaagccaagaucaugccauugcacuccagccugggcgacaagagcaaaacucagucucaaaauauuaaaaaaaaaaaaaaaaaaguacuuuaaaaaauuuuuuuuuuuuuuagacagagucucgcucugucacccaggcugaagugcaguggugccaucucaggucgcggcaaccucugccucccagguucaagcaauucuccugccucagccuccugaguagcugggauuacaggcaugcaccaccacaccuggcuaauuuuauauuuuuaauagagaugggguuucuccauguuggucaggcuggucuugaacucccgaccucaguugauccacucgccucugccucccaaagugcugagauuacaggccugagccacugugcgcggccaacaugugcuuuuuuuuuuuuuuuuuuugagacggagucucacucuguugcccaggcuggagugcaauggcgugaucuccgcucacugcaaccucugccucccggguucaagcgauucuccugccuaagccucccaagugcugggaccacaggugugcgccaccaugccuggguaauuuuuguauuuuuaguagagaugggauuucaccacguugcccaggcuggucucaaacucuugaccuugugaucugcccaccucagccucccaaaguguugggauuacaggugugagccaccaugcccagccugugcuuuuuaaauguauguuugauuggacucuacauuaaaguccaaucagcgggaggggauuuugaaaguuucgaguaaggaauauauagcauauaguaguauauagcagagccacacucauuuauuguuauuuauaagaaaauaaaagccuuggauugugggaggcuuagaggagcagggaugcaacauacagcugugcaggaugcacacugcaaaagccaaccuagccaaagaagucagcaaggacugaaacugauuccauacucugcuggccaagccugugucuguggggcuacauccagccagagggaaacuuuucucuaaucuuacaaagaugcaugugagcaacuugcagcagccuugaccagcucuauuucugaaaaccuggagggccuggguaggcagagcccugagagcaugucuuucucugugccccccuccucugcccucaugaugcagggaccugcggggcaacucacucaacugugacugcaaggugaagugguugguggaguggcuggcacacaccaacaccacgguggcacccaucuacugcgccagcccgccccgcuuccaggagcacaaggugcaggaccugccgcugcgggaguucgauugcaucaccacagguaggaggugccccugccuugggugucaguccacgccuaccccaaggcagcuuuacagacacgaaaccccccacccugccccacaacacccagcggcagcaguaaagcaaccaccaucacccaagcagcccuucccuucucccucuggucuucaguaacgcaccucucaucuugcagauuuuguguuguaccagacccuggccuucccagcagugucggcugagcccuuccucuacuccagugaccucuauuuggcucuggcccagccaggagucagugccugcaccauccugaagugggacuauguugagcggcagcuucgagacuaugauagaaucccagguaccugcgcccaaucugguucugcuggcccuugcuagggggaggggggagugggcuccaucguucaaccccauugaguuccuguagguagagggauagaugagacauacccucugcccacaagaacuuuccagucuuugggaagaggccaauguauacaccgauaacauccauaugauaggcagguguuaagagggagauaugaacaugaugcucuagcagcacaaaggacaagccuacccugggcaaucagggaaggcuuccugguggaggggggauacccaagcugagucuugaagaauagaggaaagggagaacucagaggugauccccagguuucuggcuuacguaauuagauggaccgggaaaugaggaggagacaggagugacuguugagcaguuuuggaucuacugaguuugaucugagucuugaaagcugaaggagacuuagcuaggagcaaaaaaguggaaagaguguuuuggcagagggaacagcaugaacgaagucaaggaggugugcaguaacuuaguaugugaguguguauaugugugcaaaucauaagcagcuuguaugaaaagggauaagguucaagguggggaguggcaacgagauauugaugaguaccaggucauugacaggguuuaagcagaaugugugauccagucugcauuuuagaaagcuucuugcauggaaaaaggcuagguguggggccauacaugagggcagaacaguagggggauaugugccugucugcuagaggggugcuggagccuggacacgagacaguagcaguggggauggagggagauauuuagaaaggaggguuaaaccgccaggugcgguggcucacgccuguaaucccagcacuuugggaggccgaggcggguggaucacgaggucaggagauugagaccauccuggcuaacacggugaaacccugucucuacuaaaaauacaaaaaauuagcugggcgugguggcaggugccuguagucccagcuacucgggagguugaggcaggagaaugucaugaaccugggaggcagagcuugcagcgagccaagaucacaccacugcgguccagccugggugacagagcgagacuccaucucaaaaaaaaaaaaaaaaaaaaaaaaauagaaggcuuaaacugacacaagaugaaauagaaaacuuacauugcccugucuccauuaaggaacuugaagucaguauuaaagaaaaaaacaaaaacaaaaacaaaacaccuucuccuaaaaaaaccuccuggcccagaguguuucccuggugaaugcuaucaaacauuuaaggaggaacuaacaccaaucuacauacacacuauuagaaaguagaagggaagguuguugggacuuggggacugaucagggaagggugaguggaggagacaaagguguuagggaugacugccagguuucuggauugggagacuaguggagccacagcugaaaucaagaacagaggaggagcagggcaggcucagcgauggguauggagcugaauugugaguugugaguccugacugaguuuuaggugcuugugugggugugugggccaggagagucugagggaagaucaggagcugggguguggcaugggggucauuagcaucugggcagggcagaccaaaccccaaagaagguauuuaggcagugacugccagagccugaggcucugcauaaauuucucuugggggaaagguggggucauagugagaaggaaagaggggugaacuggggaugucaaaguggagaugccgggcagcagcugaagacccugggacaggugagcaguguaugguuucaugugcuuggugcccgagaagggcuccaaugaagcugauugugaguauaggugcacaugggcaugcauucuuguauauaaaagcccuuucaaaagugagaacucuugggaggauguguuuucaugcacugugaugcaaacagcaaggugucuuggguauaccuaagauuucucuccccgcuguggauccacucaaauucucccucccuucccugccuugccacugccagugggguagcuuugggcaagucacuugcucucucugagccucaguuucuuucugugugaaauggacaaaaucacaggguccuuuccagcgugaugaauuccucaucgauguaacaugugcuuacauucagcacagugacugcacgcaauaaaaauucaauuacugacauuaugguuaagcaacgagucacuaucgagggacacuuauuuugugcuaugucagcuuauauuugaacccuaggguuauggguggaacaagggugauauuaaaacugguuauuagcugugaaacaacuggaaagcauugagcgcuuaguggaugaacuucaguguggguggaaugguauagcgcagagucuuaguccuggcccaaguuuggaagggacuggccuucuccaaggggguuggauggagugggagccgccggccugccugaugcugucugccucuguccuggcacagcccccucugcagugcacugcaagccgauggugguggacagccagcuguacguggucguggcccagcuguuuggcggcucuuacauuuaccacugggaucccaacaccacgcgcuucaccaggcugcaagacauugacccgcagcgcgugcgcaagccuaacgaccuagaagccuuccgcaucgacggugacugguacuuugccguggcugacagcuccaaggcaggcgccaccagccucuaccgcuggcaccagaauggcuucuacucccaccaggcacugcaccccuggcaccgugacaccgaccuggaguuuguggacggcgagggcaagccacggcugauuguguccagcagcucccaggcacccgucaucuaucaguggagucgcacccagaagcaguuuguggcccagggugaggugacccaggugccugaugcccaagcugugaaacacuuucgugccggccgcgacagcuaccugugccucagccgcuacauuggcgacuccaagauccugcgcugggaggguacccgcuucucggaggugcaggcccugcccucccggggcucgcuggcccugcagcccuuccuuguggguggccgccgcuaccuggcacugggcagugauuucuccuucacccagaucuaccagugggaugagggacgacagaaguuuguacgguuccaggagcuggcugugcaggcuccucgggccuucugcuacaugccugcuggggacgcccagcuacuccuggcccccagcuucaagggacagacgcugguguauagacacauugugguggaucucagugccuagggggugccgaggccucuggucuccucaggguggccacuggaggaugggugggggccucugugagcaccacguaugccugugugaagacaagcgaccaaccugcauucaugcccuuguauccgcacacgcccaguguguacaggcgcaccccguggacuggcccaggaggacgugcaucaucacugcaaucagcaugaacaccaggcaccccugggacaccuaacgcccaguucccgugaccccaacugcaggcccccccuacucugcagccuuucccaugcucugcccccugucucaugcacgaguggugcggggugcugggagcgaggggggccgcauccuccuguccuugugcuucuccuucugccccucuggucuuuccuguuggugcuccaggcauuguuuaccugcucuugcuccccgcuguagcccacagccauaucugucaugcuuccccggggccacucaccccugccccaccccgucugcaugcucacauggacgcggacggacacacucauuacacacucacacgccccgacugcacccgguguccaucuauaaacaugucagggcacgugugcauacaagcagauucagcacugccuaccaggcucuccuguuaccuugccucucugcuuggagggggcccccucugcucacccccagcgugccccccccggaacugauaaggaugagaaugguggugccagcuucugagggccugcuuggccuccugggggcaaagccccucugcccgaagcaauaacaacagcagcagaagcaaucccggggagcugccaggggugucugucucuguucuccuuggcguuuccuucauggccgugaaucccagcucacccauggacagaagaccuccccucaucugaaagccuuucugccuuccuuccuguagcugucgcuuucucaggcuuggacuguccccugguucacccugucuuugggauguggcccuugagcugggcgggcuccuuggguggauuagagagcuggccgagcugcaagcaccugaguuaccugcgagggugcccagaguggagcuuggccugagggcguguugcagcccuggccccaccaguccacagaggcccccaggagcacugccuuucaguggaccggguggggccuggugggaggggccccacuagcugagcuucugcugcccucugcugucugcugagaugccaggcuaguggagagggcacaccaugugcccaaauggugugaugcuccuuguagcaggauaccaggguacuggggggcaaugcuaugauuaacuugcuucaaauaaaaaguucccgccccauaaccggc

SEQ ID NO: 17651 - RNA, 3933 nt, Homo sapiens
aagccggagcccugggguugggcagcacucgguuccgugcaacuuucaagugaguugcgaacuccgcccuguaggccggugcugguggcccggcgcgcuggaaccgcggcgacccgcuccagcgcgggaccagcagcaagggccgagcgccagguucuccgcggcagaaagggcgggugggagcuguaacugccccggccgcggggcgcgcccgcucccaagucggcuuccuccccgccggggccgcuuugccucgggucuccccauucuccagguccccugaacugcacagucggaggccgugggcggcgggcucugccuccgccgagggacagccggaucgccccucugcuucccgcaacugcccugaucaccccccgucccagcccuugagugaacguccuucugagcggcuuccugggguccuccccacgucccaaaggccggcaagaugguguccuggaugaucugucgccugguggugugaguauggccgcccucagaccuccucuaccccggggugccgucccgccccugugguggaagcuguggacgucuagugggaggaggaacuuucugagcuccacccuccagcacuccaugcaaggguuaacggaccugugggcuugcacgcggugucuggggcaccgcaggcuacccgccccaccaagccucguuggcugagaacgaccccugccgcacgccacacacacugcaaacagaugcguggagccgagggccacaggccuaccuugcugccccuuggcaaacacaaggugauauggcacguugugggcggagaauccaggugccugcuugccaucugagcagucacaugacucaccauccuauuccucaccuuugaguaugccaacaucuggcucacauagcccuaucugcaacccagcagugucaggucuggugacccugggccugauugcaugcccaugggaggggacagucugguguucucacccacuucguggaguggcuguccucucacuccaucaugcacccaugggccaccggugcaggccugggcaggcuugggauguuuguaaacagcaggguggggagguggccuccagggcucugacucaggcacggguuguacaagccaagcgagaaaaacagggcggguacugccaccuugcaccccaguggggggaaauggccacuuggcaaggugggaguggggcauggugccccucacacuccccauggcugcucuuccaggcugguguuugggaugcuguguccagcuuaugcuuccuauaaggcugugaagaccaagaacauucgugaauaugugagcguggggguuuggguguguuuaauaggacuuggugagguggggagggucucaguuggccucucccuccuccaggggcaaggcuguguggcacauccugaguggaguggggagggagagagaaugggcccuguucaagaggguguagauagagggcaggccaucggggugccuguggaagaucuggugggugaagcuuguuggaggcgggcauaggaaugagcagcaguuucucagagcuccuguccagccaugugugggggaaagcagcuaugcagccggacaggcucccuggaaucucugggcugggcuggccuggguugggaguuggugcugcaggccccaugcugaccucugggcgcucaccccacaggugcgguggaugauguacuggauuguuuuugcacucuucauggcagcagagaucguuacagacauuuuuaucuccugguauggacgcaggguccgcaagccaugggucagggguggcccccccagcccugcuccuuggcucacccugccccuugugcugugacagguucccuuucuacuaugagaucaagauggccuucgugcuguggcugcucucacccuacaccaagggcgccagccugcuuuaccgcaaguuuguccacccgucccugucccgccaugagaagguaccccagggggaagcgggaagggaggcuuagggguggguaugagggaaagagcccuggaccugggauuuaggaugcuggggacaccgggguucuaucccaguccugcugcuauugaggggcaggaccuugacagggcccagccuaccucaucuucugggauaaucagguggggguacacaugaaugaccuuugaggauggaaauugguuuggggguagugguggcggcagcuggagcauggccacucauggaggugugagcggguggcagcccugcucuuggucuguguuuguggcccggauuuguggcucugggcaccagguggggcugggcugggcuggguggcgccacaaccaguggcuucucagaaucugcagaggaagagggacucuggcuguccaccugagcucuccuccccauuggguccacaggagaucgacgcguacaucgugcaggccaaggagcgcagcuacgagaccgugcucagcuucgggaagcggggccucaacauugccgccuccgcugcugugcaggcugccaccaaggugcucugggcccccagcccuccagcagcccccaucccaccccuaaggcccuuugggcucauucagcuccucugccagggagcccagagauggcagccggggagcaggggugagaaggugacggggggguauuggcagaagcguggagcuggagucagaccuuccuuccuggcucuggcacugagcguaagcagcggcuccugcucucugacuuugguuuccuguuggugccacauuggcgcggggccagaagcuugcugagcaguuuucacuucugcgucucagcuccggugauuagcugguuggccaauaucccugggcagccuccccgcugaagccucuucccccucgcagagucagggggcgcuggccggcaggcugcggagcuucuccaugcaggaccugcgcuccaucucugacgcaccugccccugccuaccaugacccccucuaccuggaggaccaggugucccaccggaggccacccauuggugagcgggcagaggggcccagagccaugccaggagggauggcuuccuucacucacaccauggcuucccccaaggcucgaggaagggcuggccuggucgcaggcuuucagcuucaccuccuccuccacacaggguaccgggccgggggccugcaggacagcgacaccgaggaugaguguuggucagauacugaggcagucccccgggcgccagcccggccccgagagaagccccuaauccgcagccagagccugcguguggucaagaggaagccaccggugcgggaggucagugugggaggacgacaggagggaggagggcucugcuggcuggugcuccccacacccucaugcugugccuccccuuuccccagggcaccucgcgcucccugaagguucggacgaggaaaaagacugugcccucagacguggacagcuagggucugcugcaucugcccccuucuuaccucgugcccugcagggcuccagggcuauuuggagggaccuugggcugcacaucuggccugccugcaccagcugccugggccccacccuccugacuccugcugaugguuaagggccgggagcagaugcugccaaggccacaugcagggaugcacccacaauguaccaaagcaggcugggcccaggguucuauuuauugccuugcucugcccucucccuuccccgguugugggacaagagcccucccugaaccccugcaacccucccugaaccccugcaaaugaaaccaaacguccaccuggguguguucauuccuuccuguccuucaaaguacuugauagccuuucauaaggccuggcacauguguccugguuguguguguguguguuggugagugaggucagguuugcgaguguuuugauaaauaaauacauaaaggggcucuguuucuccugauucuu

SEQ ID NO: 17652 - RNA, 3933 nt, Homo sapiens
aagaaucaggagaaacagagccccuuuauguauuuauuuaucaaaacacucgcaaaccugaccucacucaccaacacacacacacacaaccaggacacaugugccaggccuuaugaaaggcuaucaaguacuuugaaggacaggaaggaaugaacacacccagguggacguuugguuucauuugcagggguucagggaggguugcagggguucagggagggcucuugucccacaaccggggaagggagagggcagagcaaggcaauaaauagaacccugggcccagccugcuuugguacauugugggugcaucccugcauguggccuuggcagcaucugcucccggcccuuaaccaucagcaggagucaggaggguggggcccaggcagcuggugcaggcaggccagaugugcagcccaaggucccuccaaauagcccuggagcccugcagggcacgagguaagaagggggcagaugcagcagacccuagcuguccacgucugagggcacagucuuuuuccucguccgaaccuucagggagcgcgaggugcccuggggaaaggggaggcacagcaugaggguguggggagcaccagccagcagagcccuccucccuccugucguccucccacacugaccucccgcaccgguggcuuccucuugaccacacgcaggcucuggcugcggauuaggggcuucucucggggccgggcuggcgcccgggggacugccucaguaucugaccaacacucauccucggugucgcuguccugcaggcccccggcccgguacccuguguggaggaggaggugaagcugaaagccugcgaccaggccagcccuuccucgagccuugggggaagccauggugugagugaaggaagccaucccuccuggcauggcucugggccccucugcccgcucaccaauggguggccuccggugggacaccugguccuccagguagagggggucaugguaggcaggggcaggugcgucagagauggagcgcagguccugcauggagaagcuccgcagccugccggccagcgcccccugacucugcgagggggaagaggcuucagcggggaggcugcccagggauauuggccaaccagcuaaucaccggagcugagacgcagaagugaaaacugcucagcaagcuucuggccccgcgccaauguggcaccaacaggaaaccaaagucagagagcaggagccgcugcuuacgcucagugccagagccaggaaggaaggucugacuccagcuccacgcuucugccaauacccccccgucaccuucucaccccugcuccccggcugccaucucugggcucccuggcagaggagcugaaugagcccaaagggccuuaggggugggaugggggcugcuggagggcugggggcccagagcaccuugguggcagccugcacagcagcggaggcggcaauguugaggccccgcuucccgaagcugagcacggucucguagcugcgcuccuuggccugcacgauguacgcgucgaucuccuguggacccaauggggaggagagcucagguggacagccagagucccucuuccucugcagauucugagaagccacugguuguggcgccacccagcccagcccagccccaccuggugcccagagccacaaauccgggccacaaacacagaccaagagcagggcugccacccgcucacaccuccaugaguggccaugcuccagcugccgccaccacuacccccaaaccaauuuccauccucaaaggucauucauguguacccccaccugauuaucccagaagaugagguaggcugggcccugucaagguccugccccucaauagcagcaggacugggauagaaccccgguguccccagcauccuaaaucccagguccagggcucuuucccucauacccaccccuaagccucccuucccgcuucccccugggguaccuucucauggcgggacagggacggguggacaaacuugcgguaaagcaggcuggcgcccuugguguagggugagagcagccacagcacgaaggccaucuugaucucauaguagaaagggaaccugucacagcacaaggggcagggugagccaaggagcagggcugggggggccaccccugacccauggcuugcggacccugcguccauaccaggagauaaaaaugucuguaacgaucucugcugccaugaagagugcaaaaacaauccaguacaucauccaccgcaccuguggggugagcgcccagaggucagcauggggccugcagcaccaacucccaacccaggccagcccagcccagagauuccagggagccuguccggcugcauagcugcuuucccccacacauggcuggacaggagcucugagaaacugcugcucauuccuaugcccgccuccaacaagcuucacccaccagaucuuccacaggcaccccgauggccugcccucuaucuacacccucuugaacagggcccauucucucucccuccccacuccacucaggaugugccacacagccuugccccuggaggagggagaggccaacugagacccuccccaccucaccaaguccuauuaaacacacccaaacccccacgcucacauauucacgaauguucuuggucuucacagccuuauaggaagcauaagcuggacacagcaucccaaacaccagccuggaagagcagccauggggagugugaggggcaccaugccccacucccaccuugccaaguggccauuuccccccacuggggugcaagguggcaguacccgcccuguuuuucucgcuuggcuuguacaacccgugccugagucagagcccuggaggccaccuccccacccugcuguuuacaaacaucccaagccugcccaggccugcaccgguggcccaugggugcaugauggagugagaggacagccacuccacgaagugggugagaacaccagacuguccccucccaugggcaugcaaucaggcccagggucaccagaccugacacugcuggguugcagauagggcuaugugagccagauguuggcauacucaaaggugaggaauaggauggugagucaugugacugcucagauggcaagcaggcaccuggauucuccgcccacaacgugccauaucaccuuguguuugccaaggggcagcaagguaggccuguggcccucggcuccacgcaucuguuugcaguguguguggcgugcggcaggggucguucucagccaacgaggcuugguggggcggguagccugcggugccccagacaccgcgugcaagcccacagguccguuaacccuugcauggagugcuggaggguggagcucagaaaguuccuccucccacuagacguccacagcuuccaccacaggggcgggacggcaccccgggguagaggaggucugagggcggccauacucacaccaccaggcgacagaucauccaggacaccaucuugccggccuuugggacguggggaggaccccaggaagccgcucagaaggacguucacucaagggcugggacggggggugaucagggcaguugcgggaagcagaggggcgauccggcugucccucggcggaggcagagcccgccgcccacggccuccgacugugcaguucaggggaccuggagaauggggagacccgaggcaaagcggccccggcggggaggaagccgacuugggagcgggcgcgccccgcggccggggcaguuacagcucccacccgcccuuucugccgcggagaaccuggcgcucggcccuugcugcuggucccgcgcuggagcgggucgccgcgguuccagcgcgccgggccaccagcaccggccuacagggcggaguucgcaacucacuugaaaguugcacggaaccgagugcugcccaaccccagggcuccggcuu

SEQ ID NO: 17653 - RNA, 4651 nt, Homo sapiens
ccagugcgcgcucggggaguuggcgagcggguggcggcugggagacgucccgagcgcacgggacugacaggcggcagaagccgggcgggguccgcugggcuccggacccgugcccccccaguuccagggcggccccgggcggccccgcccccucggugaaugccgcgggccggccaauccgggcaggccgcggcgccgcgcagccuaucagcggccagagcucgcgugcgcuuccgcguucgcgugcgcuuccgcguucucgugagcucccggcccgcugccgcagggacugggagcgggcuccgcagcgcacucuagcccgcggcucggcucagucggucugcgaggauccggcccgccgccccccgggggacccgauggccucggagggccuggcgggggcgcuggcuuccgugcuggcuggccagggguccagcgugcacagcugcgacucggcgccggccggggagccgccggcgccccgugcgggcugcggaagaacgugugcuacguggugcuggccguguuccucagcgagcaggugagcggccgcccccgggcccgccgggccucgggagcgcgcagccagcccagguggggacagaagacccaacggccacagccagcgcugccgcgugcguggcgcuucccaguuuugcaaagcacucccacucccacucgcaucuguguccugcguucgucccgauaugcagaagaggaaacugaggcccggggccuguuugucucauccgacuaggccucauuccuucccuuccccagagucuagcggagugcccagggccccucagauagcaguggcucaaucccggcuuaccuucaggccuuuggugcugaugccuguagugggcgauguaaugacaacuagacggggccagggccauagggcgggguuguacagagcggaggugggggucguguuucaagccagaccccagugugaggacccaucacaguuuguaaaccacgccguuggaggcgagagauacacaguggcagguacagacgcaaaucaauccaagacagacagacacauggugacccucacucuggggccucaucuccagccccugaagcggcuuccaggaaucucagcccuuccugaaauggaagucuuccuaaauccagagagagacgaauugcagagaggagagggcugcagcccccagcgacacgagggcaggucuccuggagcgcuagcuggguugagaguguccacccagaggggagucuugggcgacuguguuugagaugcccccuggucccggggcgagggaaggcuguggcaggaagugaggauccucucuccucucaggaugaggugcuacugauccaggaggccaagagggagugccgggggucgugguaccugccugcggggagaauggagccaggggagaccaucguggaggcgcugcagcgggaggugaaggaggaggcggggcugcacugugagcccgagacacugcuguccguggaggagcggggccccuccuggguccgcuucguguuccucgcucgccccacagguauggcccaccuggaggcagugugaacagggccaguugacaccuuucccccagcuccucggugaggugagccccucuacagccaguccuguuauggcuggcacagccuggcaugggcagauuccagccuuugggcugggggccucucuccugggucagggaugucuguugacucugccagagcugcacuucucuccacacagacccucccugccccaucccccacaucucccccagguggaauucucaagacuuccaaggaggccgaugcggagucccugcaggcugccugguacccacggaccucccugcccacuccgcugcgagcccaugacauccugcaccugguugaacuagccgcccaguaucgccagcaagccaggcacccucucauucugccccaagagcuacccugugaucuggucugccagcggcucguggcuaccuuuaccagcgcccagacaguguggguguuagugggcacaguggggaugccucacuugccugucacugccuguggccucgacccuauggagcagagggguggcaugaagauggccguccugcggcugcugcaggagugucugacccugcaccacuuggugguggagaucaagggguugcuuggacugcagcaccugggccgagaucacagugauggcaucuguuugaaugugcuggugaccguggcuuuucggagcccagggauccaggaugaacccccaaaaguucggggugagaacuucucuugguggaaggugauggaggaagaccugcaaagccagcuccuccagcggcuucagggauccucuguugucccagugaacagauagagaggugggggaggugacagggagcuaggcagccgugcucccuccagugcggacuugucucccucugagggaggcaagaggcuggcgaucagggaucuuguugcauugggagcaggggcggcucuccugguccccaggagagaugcuuugaggagcauuccucuagauugcacaagggacagugccuuuaaccaagcgaggaguccaaagcucaggaccugacuacccugagggcacgcugacgccucuucccagggggauggggagcuuucugcacccccaguggcaucuccucaucacguucugugccguccuugggaaaggccugcauucugauccuuccaggcccuucgagcauggaggggcacuggggaaggucccccgagggaggagcacguugcugaguaaagagguguuacucaccuugccucccugccuacacgucucuguggggagaaagugauggggacuacuguccaggagcugcugcuccccucguguuacccacaggcacccaugccuuucccagugcacugacagugcgggccagucugcuguccagcacggccccuggggcucccuccaguuggccugcuggcccgggaugugacucugaggggacccaucccuaaugaaacacagcucugagcccuccaaggguugggcagugggcggccccagaggaacuucaagugggacaggagcugcaggugcugccucugcucucuccuugagccucccuggcgcagaccacucccccuggcucuccugccucugccuuuucacaacuucagcccaugccagaccaaaccuuuucuucauuuccccucagccucgcugaaucaugguaggauuuuuuuuuuuuuuuuuuuuuuuuuuugcuaaguggccgggcacaguggcucacaccuguaaucccaacacuuugguaggcugacacagguggaucacuugaggucagggaguucgagaccagccuggccaacauggcaaaaccccaucucuacuaaaaauacaaaaaacuagccgggcauguuggcagaugccuguaaucucagauacuuaggaggcugaggcaggagaaucgcuugaaccccggaggcaaagguugcagugagccgagcuccagccugggugauagacuucgucugaaaaaaaaaaaaaaaaaaaaagaacuuuggccaggcacgguggcucacaccuuuaaccccagugcuuugggaggcugaggcaggaggaucgcuugaaggccagaguuugaagccagccugggcaacauagugagacccugugucuacaggaaaaaaaaaaggccaggcaagguggugcacaccuguaaaucccagcuauucaggaggcugaggcaggaggauggcuugagcccgggagguugaggcugcagugagccaugcucaggccacugcacuccagucugggugagacagcaagacccucucucaaaagaaaaaagaaaagaaagaggaaaaaaagaacuuuacugaaauuuaagcaaaaucaaaggaaaugaacaaauaaaauauaucaaguguucuacgguagagauuucugauucugagcaaggaaacacuagcacaggcuccccuucugagggccaagaugaccuccaaggccccuuucccagcccccucccugccucucuuggcugcccuccuuucugggcccuggagggugguaggaauccuuguacccucugaggacaaauaccucacaaaugauggaaccaaaccccuuuguuucaguucacuucucucagugucuaagggacccacuggcccauauccagucagccgggcaaugacauuuggcuauuugcccccauuauuuagccuaguaguuuccaacccugggcacacguuagggucaccuggguuuuuuuuuuuuucccucaaacagggucuugcucugucacccaggcuggaguggaguggugugauccuggcucacugcagccuugaccucccaggcucaagugacaagugauucuccugccucagccucccaaguagcuggaaccacaggcgcauuuuuaagcuuuuaguagagaugggguucucacuauguugccaaggcuggucuugaacuucuguccucaagugauccucccgccucagccucccaagguacuaggauuauaggcgugagccaccaugcacaaccaccuggagagcuugaacucuggguguacccccagcaacaauaauuuaacuggugauggggcacugggcauugggauuuuaaaaagccacccag

SEQ ID NO: 17654 - RNA, 15178 nt, Homo sapiens
guguccacgcaaucacaccauuuauugcugugcuguccggggaagacaccgugcaaaugccaaagugcacugaggagaggggagggucugugacucccaaacccucgaauauuuuaugaaucuaagaguccagacgcaguucauccacggagaucugcgccccguccacaccaacacccacguuugugcacccacaugugcacggugcucuucagagcggcgagguccucccccgcggggaggaaugugggagaggcagaggucacugaguuuccuccuguuucgugucaccucuuggcaaccugugccuggcuucuagaagcggcaugggcaagaaaaggaagcaaaagaggcucuggccugcuccuccuugcccaggagcaaagccagcaacuguguagucccgcugugagguaaugccuggcgccgcccguguauuccugcaggucaagacagauucgggccgggugggguggcagcccagccacggagggcaugcagggagaacaccaccaggacuggcugccugggccgcagccacuucccgccaggcucaggggccuggagucagggggcguccuucccuuaucuguccccugagcucccuggcuccccagaagggucuucuaucaagaacacugggcccugggcagaagggagggcaaggcccggccuccccuggucucugaccucugcccaggugcuguggaccugcugagacggguucagaaggcgccagagaggaaccagcuggaccugagccuggcuccugggcccgcuccccuccuggcugcagcugcaccaagguucucauuagcaggggcccccgccugggugcggaacaugcuuugggcauuugccaugaggcggcugggaguuuugcaacaguuuccaggggagcagagcaggaagaggggcuuccccgacgaucccauucacugcuccuucuccaugggccaagccauguaggcaggggacaaaaugucaggucucagcagcucccaugguaccuaaugugacacagacaaggcuccaggccccaucucacuggccugggcuccugaccagucucggagccaucagcucacuccccaucuugccccuggaguugagucacaggcuuggcccuggccacaaauggccaguacagaaggggccaggcacacagcacaugagggucuggggucugggugcucaccuggcugucacccaagcuccuccaagaaggccccaaggaccuugcugccuggaaagccaucuguuuggcuccuuggcaccuggcaugcccauucccugaaacccagucugguguggucaacaugccgcagucuccuugagugagcccgggagcagaagccccaucccaggaggggaguguggcggcagugccaggcaggaggcagcucuggggcagagguguggacaggagucucccaccgcccuggugcuggcucagaccugcccuuccggggcuggggagacguucuggcgaggaucaugugggggaaacuugacgaaggcaauggcagccagcuccuugcagaacuccuccagcaccaccacgcccuggaggagggucuggugguccagccugaggggagauggcacagggggcauggcugggugggggcaggacugugcccagcaugacagcccagcauccacgaggcuugacccuguggccagccaccucuccuccagaggcgcuuuccacucucccaccccaaggcuucaccuggcacccuugguacucacugcuccccaggagccuggcccgucaacugcuugcgcaccaggagcagcuugccugggaacugggguacccucuggauucucugcaucaaguccccgaucaccuacagcgggaaucacaggggacucagauggggccagcaacaccagugaguccccuggcccugccacaccaugcagagcaugggagacugugcuuucccuggcacuggcaagggugcccaccccuccagcccccaaccaccugccccguucccuuucccugauguccccuccaccucacuaggcacacucccuugggccgaggcguccucacccucaccaacacggagaauaggcuccugcagccgggggccaggcugauguacggauccagcagguacucaugaauaugggggugggggaagagggcaagccgggacaggaccgaggucaccugcagguucaggcuguauggcuguaggaacaugguggacagagccgagggcuggcagggcuggugaguauuuuugcacucccccagcaaggugccuggccacugugaacgugugugggggugggaggcucacgugaugugugugugucauggauuccauggggcugagggccagaacguguuaggacguguggagcaggggugagacggggcuucccaccuggggaaaggacagggguggcaccaaagaaccgaagcagaggcaacccuguggccaaccucugcucuugaaggaccccagaggcaccagccuggaguucuccuggcccaggcccacuagcuaccugauccagaauccgggacaugcggucaaacagcacucggaggaaguggcccucgaagaaaggucgcucgggcucauggggguccaaaggugugggggucagaggccagccccaggaggcgacgcgggagcugcacuccuggaacugagacaggcgggaaaguagaggcagugggccuggggacugggaaccagcagacagggccccacgcaggagggaugggcugggguccuugggcagaugagagaggcggaacccagagcuuaugacccagcuguucugaaggacaggaagugggagcugguagcaggagccacucaccaggccauaagcaucguggacguaugugucauagccugucuccuccaggaaggcagaggucuuggcuuccucggggaccaggcacaggaaacugagagauagaagccgguguggaggcgcucccggcucacccugcucuccccugcuugugggaccccaucucccucccugacuggaccccagggcuguggccaaagaguaaaacucagggcaggcacgguggcucaugucuguaaucccagcacuuugggaggcugaggugggcggaucaccugaggucaggaguucgagaccugccuggccaacauggggaaacccagucucuacuaaaacuauaaaaauuagcugggugugguggugcaugucuguaaucccagguacucgggaggcugaggcacaggaaucgcuuggauccggaacccgggagguggagguugcagugagccgagauuguaccacugcacuccauccugggugacggagcgagacucuaucucaaaaaauaaaauaaaauaaaauaaaacucaagugguucagacugccuaacuugcuccccaccuguugacgaucucggucacugcuguuuugccaucguaacugguagcaggagcuaggcgaggcuuugcgggaguuugaaagccggaauccaggaagcugucggugaaguaggggucuuccuccaggucucuguggccagggcagagcaguacggcaccagugaaugaauggacagagugagcgugcgagugcuaagggcugggcugaguccaaagggcgccgguuucacuuacaggguguccucauagcucucaggcucuggugagccccaggccacguaagggcggcccucaagguugcgcaggaccaggcuguggaugauccccucguggggcuucugcagcagcuccucaaacagccggaguguggugaugcugaucuggagcaggaagggggucggcaggauagccccuuccccacccagcucccaggggugccuuggcauggcuaacccagauaagaaaagaccucugaggcagagucaccucccuuggcuggaugcuaagguggcagguuuuggggguaguuggggggugugggccuaggaauccagaagucuggguggucccugguaugugacuaauuugaugugcaauuucaggcaagccaauucgcuucuccgugccuuacuuuccaugucugagaaaugggaguaucaaccucgccuaccucacgaaguaguacguguuagccuuccagcgagccaagugugcaaaauauaaaauacuguaaaaaaauaagcugggaacaguggcucaugccugcagucccagcacuuuaggaggcugaggugagaggaucgcuugaggccaggaguuggagacugcagugaguuaugaucacaccucugcacuccagggccugggugauagagcaauacccugucucuuuaaaaaaaaaaaaaaaaaguauaugaucauagaaaauuagugugugauaaaaguggcucggcaguguuuugcaguucagugucucaaagguggagucaacugggaacacuaaugaaaugggaagaguguucaggaaaucccucuggcagggguggugagaggaacagagauggaggucccccacuguaccucaucagagagguggucacaaugcccgaugagaugagcauacaggguguggggguuguccccgggggcuucaggcugccggucugugcccaggaggaaagccacggccucccgcagcagcgcaggggagcgaagcuggcgcagcauggcugugaggagggcgguggaggucaagaugcucugcucggaccuacgggaagagggcaccuuagccaggcccggugugugcagacagcacaugagugcggguggccgaacccuuccugcuugccucgcauguuuggcugguaugucuguggucacuugcccaucccugcugagguccugcagggaaggguaggaggccuucguuuagcccacguagcucagagccacgugcacaucauggggcaggccuggcaaacaucacccaaugggguccacaaaugggauucuggucaagaaggugucuggccuuagggacaggacgaggcugggugggguaggugguuuacuguagaccacagucaugccugagggaacuagacacuuacacgugcaggagcuggggcugcagggucuccacgaagaaguucucagccacagccuucgccaaggcguccgcaaccaccugggugccagagagcgccaauguguuuugcccucauuacaauuccagcugagaaauaaccguguucuugcgcggcgccugaugccacaggagagggucccggcccgccuggggccccgcuuagcuccuggaccccauguuuccaugucccugcuccacuugguccucgagauggagaugguacagggaacagcaugagagcccggccuccgcccgccccugcucaccgugugugccucugugaugagguggucgcaguaaucaaaccagcccaagaaggcagccaaggccuccuugccagggaaggaagccucaucagacggggcacuggguaaccugaaggaagaggggagugaagucucagagaguggagaaggagcuucaaggucuuccucaauguguccugaaacugggcccuuccccucuccuguggaaccucuguggcuggggaucaguuaucuuggggguuuuauggacagaggcagcaaaaccaguacuucccuggagggcaagaaguccccuggggaucagcugcagccuuggggagaggguggccagcaggggucccuagcaacguggaaccccaggggagcuggccaccaaagacaggcagggcugccagcaacugaagaugcuggccggccuucccgggcugggcacccaccuccagcugaugcccucuaagguggcaaugucugcgggguccaggaagacaggcauggaccgguacaacuggcaaaggugccggacgaucgcagggcagcaggcgcugcucuguaccagguagguggcagcugcuggggaggccaugcucaccaggagcagcagguucuccugggccuucaaggccacccgacucuucuaggggaugaggauacaacuucagggacaugcaugugagcccccaaaucaccccccagccgucaacccacccuucccccacccccaaccucuccaucucugcugccagcaccuugcucuggcacagcccaagcagggagguaaucagguugcucucuguggucccaccguccagcuccucggucucagcaggcauguggcuguucaaggccugggccccacaggacuccccguccagcuggggccuggcaggagcaccaucgugggagcaguccuuguccccguggcugguuguguccuuaggcagggcaguggguucuccgcaugcuuucuuccuaccuacaaucuuuuuacccugaaaagagggugagaugaggccagaccugguggggaccacuucccagggucccccacugggaccgcagggugggcugccagcagggcgucggccuggagcuggaggggaagcugccugcgugccucccggguaccugaucucugcuucugccuccucaggagggcagagggggcuugcccugggguucugggcccucccccuccuguucccgaucagagugcucacuuccaggauguaggcgagcagcucuggguccugcuggaucuuggagcagaggacgguggugaacugcaccuccuccuuuucuguaacggauccggaagcagucccaccaagucggaggaguuucuggaagagcaccaggacagaaacagaggggagagggguggcaggggagagagggggccucacacccagacaccccuuggcuuccgggccccucaccugcacaggccuguggacgcugagguaaugcagcagggggugcugcaccugcgccagaaccuugcugaagaacuggaacaccugcugccgcaugccugggggguacugaggccagggacagagcgccugucagagccguguccccugccugccgcaugccuggcggguacugaggccagggacagagcgccugucagagccguguccccugccugccgcaugccugggggguacugaggccagggacagagcgccugucagagccguguccccugccugccgcaugccugggggguacugaggccagggacagagcgccugucagagcugugucccccaccuggaacacugcacccccagagagccccaggcucaacuccucccucaguuccggcucagagggcccguucucacaggccugcuucccuugccacguuguucgaaacuagccuuccuggcacucacaaccccuuuuccugcaucacugugcuccaugacugggucauuauugacccaucacaggaugguccugccucucccacuaggauucuugucgaguuuucuuuccuuuuuuuaagagacagugucuugcucugccuccuaggcaggagugcggucucacgauaacaguucacugcagccuccaucuccugggcucaagcaauccacccaccucggccucccacguagcuggggcuacaggcacgcaucaccaugccuggcucuugucaguaugaaucccugcuguguccccagcaucuagagcagagccuggcacauggcaggcccaucuuuguggagugaacugggaacaggagcgcugggaugguggaguguucuaagugagacagccacagugcccguccuguuugcuccucucgcccgaacugccacuuucagugucaggacugggaagagcauaggcagaaaggccuggaauccagggagccccaggcugcccacugcccaccgcccaccucagccuggcccagcacucagagggucucccaccucggccuggcccagcgcacagaggccucccaccucggccuggccaagcgcgcagaggccucccaccucggccuggcccagcgcgcagagggccucccaccucggccuugcccagcgugcagagagucuccaggaucuugugcugcagcagguacuccaggcagggcccugccucacccgcggccgccugcugcugcucuucauacaccaggauauccagcaucugcuucagccgccagggaaugucugucuucuuggcgggggugcuuucaucuaaugauguuugggaaacaagggugaguaggguaaagaggggcaccccggcuugaaaacuucacccucuccugccaaagcccagaaaggggagguccugucugggagaggugggggaagacagcugcuggcaacugggaaauggaaguuuacagugaaugcuucaauauuuaagaagacaaaaguccuuccaggcucaggacacaguccucugagaacgcaugcaugcccagcccuuuaucagggggcagcagcaucgguuuccuucaaacccuaggauggguacagagacagggacacaugguccugggcccacagaaggcugcugucagcucugggccugaguggacacugugggcucagggcucuugucacauaacuuagaagcuguaauuccagcagcugccugagagagaaccuccuggggccucccccacugacacucagagaaggcaagccucuguuuuucacaaagcagaaaaaaacaucugugccaccaccuucaggucugacccaguccugcucccuguaccaacgcccugacggggaagcuacuuagugggggcuuuugcagucagagucucaguguguguuuuaaagaaaguucuggugcuucagggcuagacuuggagcacccccuagcuuuccuuuaaggaacaggagcuugaguagggcggccugccccacgcacuuccaacccuucuggucuagggaccauucuggaaaugaaagggcuggaugggggaagccccaggugaauuucagccaguucugaucugaucuuacugagcugguggacugaggcucuccuucaagagaucuuuaaccugaagagauagguucagaaccaggggugcgcuuuucccccccagggaacaugaggcaaugucuggagaccuuccugguugucccaauucggggguggggugugcuacuggcaccuaguggguagaggccagaauuacugcugcacaucccacaccgcccaggacagccccgcgcagggaaggcuccagguccaaugccaacugugccaagauugagaaaccuggucuagcagaacccucagagggucccacagauuucugaauuuccugggcuggcccgggcuggaaagaaagccuguaggaaaggugugggcugggaucaagccccaguaugaacuccaggaagggaaaagugagggaugcaggauaugguuaccuggcaaccaguccguauccacccauggcagccucaugacugcagagcagccacucagaugccauccccucagugagcgguccugaugggaccaggugccaaggcuuuggcucuuuggggugucagcuuggagagagggacccaggcauguuacccaccuugguuuucguucuccuccuaccccagaucucuacaaggacauugccccuaagcuggcucaggggaaaggggaauuuauuaaauucuuuucuuuugaucauuaaauccuaggcacaagcaccuggggccugaaggucuggagcuggaagcugggggaagugcagccaccucuuccuugcagagucaggccagugagacccccaaccaggcuacuccuuccucacacagccucuuuccaaaaggucagagugggaccggcagcuaaaucaucaggaguggaguggcccagggcucugggucuucugucugucugguucucugucuccgugaacucggcuccaauucugaacgacugggcagguuaccuuucccaggacaccugaauggugacacucugcacacuccuuccuccccgcucccuccagggucccugggcuggggagggccaggccgcaccugugcucucgauguaguagugcgugaugcccuuccagugcuccacgaaggccugcagcaggucaaugcugggcucgcgcugcggagggcagacacacaaccucagugggggccacaaaggccagggagccccugcccgcaugggaacagauauucugagugucagguucaugcuaggccuccucaugaggaggcacccugcucccuggcuuucaaagggaggaauaacacauuuccuccaggacacacugucaucuugccaaggaucuccugacaggcacuucucccuagauaccccucccuccuggaaaugcuguuuucuugcuguaugucacaauccuguccugucucuguccuggaggugcuaagaauguugcugggggaaacagacacagauuauuucaacacagcaugguuacgcuacaguagaggcacauagaggaacacgggagcgcagucccccaaagaaaagcaaaaugauacagaucgaaaauguggcaaaggucaggugcaguggcucacgccuguaagcccaacaguuugugaggcaaaggugggcagacggcucgaguccaggaguuuaaaccagccucggcaacaugaugaagcucugucucuauaaacaauuuaaaaacuagcaggacgugguggugucugccuauagucccagcuacuugggaggcuggggugcgaggaucaccugagcccagggaggucaaggcuucagugaauugugaucgcagcgcugcacuccagccuaggugacaaggugagacccuaucucaaaaaaaaaaaaaaaaaaaaaaaaaagacaaagcuuuuccauuccucucaaucugagagucuaugaaaaucuguucaagaccaccacaggcucuguucagccggaaggguagguaacauuagcaugauauuaacaaugugccuuccuuauaacaugcuuacaugcuuucaucuuguguccaaagccugagccugcacaaccccaacuccucagccagugcuguucucguuuccuccucuaccggcuccuucuaucaagcccuggaaaauucugguucugcucugggcaagccccuaaccucccccuuuuccaugagugcucucuccaucucuacaccauggcugauacuggccuugcacugagaacaaucacuuucccugaaaacuucucaaaaacaacaacaacaacaacaacaacaccauuccuucgcuuuucuugcagaguaaauguuuucaggaaaaaaagaauucuaaucaucccuccccacagcugugcauuucugccucuaggucuuugcuggggccacuccucugcccaaggugcucuguaucccacuaacugucuggaucgugaaaguccccagugagguucaguccccagcagcuccaccaagcccucuccagugucccugccugcccacaccucucugaccucacacuuuacugcaccacagaacugaguagccacucaugaaaucauuuguucauucuaagugcccacuauguacaagacacuaugcuagaugccacaagcaacaugaggaugacuaacaccuaguccucaagaaaugugucauggagaagacgauauaaaaccgcauugaauaacgaagcuacaaggaaguagugugaggccgcaggagagguggaaaguagugaccucucagaaaaacagggguaacuucuaacaggcuggaacagggaaggcuuuaccaagaucacaucucaacuaaaacuugaagaaccaggucaauaucaacaagagaaggaagacagucccugcagaaggaacucugcaaagugugccuggggaaggggugggcuggcgagacuucggagucucuaaugccaagccaagaagucucagucauuuuuugcaggcagcagggagcaggucaaugacaacuuuuuuuuuuucuucugagacagagucucaaaaaaaaaaaaaaagagucucaccgucacugaggcuagagugcaguggcaccaucucagcucacuguaaccuccgcuuccuggguucaagugauucuccugccucccaaguugcugggauuacagacaugugccaccacgccuggcugauuuuuguauuuuuaguagagacgggguuucaccauguuggccaggcuggucucaaacuccugaccucaagugguccgcccaccugggccucccaaagugcugggauuacaggcaugagccaccacacccggccauuggcaccuucugagcaguguuuucggaagacucaucuggcaguuggccuugggagaggagguaaaggcaggaagaauaugcuuagaaggccacugcaacauggggagggagggaugacauucacagaacuggaaacuccccucaguccgcagggcaucuugucuucuugcaaagcuaguugguaggggcugcaacccuucucaaaaguagcaccacccacaguuauuccaaauauuccaucccugugcagugaccgcaucucacuacauucuaugugacagugccugcugugcugagcaaucaucucuucugcuagaugaugagcucccugagagccaggguucuguguuuuacagcuagccugcccucaaugggcucagcacauagugaauacccaugaauauuuaccagauaucucaggaaacuccuggagagauucuuucccuaguuccuuguuuuagaaaguccucuggcccuucaccagcccuacaauuaucucauaauuucugugauggggucuccuuuagccucaaaauuggcuuauagucuuugaaaaccuugagcugggcuuuaaccaaaaagaauacuccaguacggcaggagacacgggagaggcagguuaaccagcacaggccauuagagagcuggugacacaggugugugaucuuuaccuaacuccaccaccagcuaugauaacuccaaaccaaaggcacuagacccaacaauuucucuuuaacgauauuauuaguggccagacauggugguggcucacaccuguaauccuagcacuuugggaggccaaggcagguggaucacuuaaggucaggaguucgagaccagccuggccaacauggcgaaaccucaucucuacuaaaauuacaaauauuagcugggcgugguggcgcagcccuguagucccagcuacucaggaggcugaggcaggagaaccacuugagguggagguugcagucagcugagaucgccccacugcacuccagccugggugacaguggaagacuccaucuuaaaaaaaaaaaaaaaaaaaaaaaaaaaaagcuguaaugauuccuaaucuguuagaucagaagagggcgggaaggagcagucuuccuacucaaugaguaaucaguugacuuacuaggaucacacuuggugaccaaggcuugggaaagaccuagacuggcgaccugaggguagagcacaaaagaggaauucccgucucccuguagggccaaccacaccgcccggacauagccuauauggucaauacuaaagggcccggaagaucaccugccuaaaaagaucucccuccacugccaaaaucuccugccacugaugccuguacuucugucauuggaagccuuagaauuugacuccuagccgggugcgguggcucaugccuguaaucccaccacuuugggaggcuaaggaucgcuugaggccaggagcucaagaccagccugggcaacauguugaaacccugucucuacaaaaaauacaaaaauuagccuggcguggugccgcaugccuguagucccagcuacucaggaggcugaggugggaggauugcuugagcccaggagguggaggcugcaaugagcggagaucgcaccacuguagucuagccugggcucagaaauaaauaaauaaauaauaaaaagaaaagaaaaagaaagaaauucacuccucaggacugaggaacugucuggccugucucaccuccuguaaauggaguguuccccagagguaugaauugguuuaucagaucacuuuugaagaucacagcuguuuugacuggggaugggggaaggggaagaaaaaucauuuuggaacccucucuaccuggaugccccaaggcccuggcccugggucaacagcagggcugggaagguggaggaagucauaguuucugacuuucuucccaacuuugccuaaggcaaacuucuuucaacaggagcucccaugaggguuggggaggaggugguggggaggaaggagggugaaacccaagacuuucucuccugagaaaaucugauacucaacucaucaauugggggaagauuuauacuaggaggcagaaguauugcugacuuuacagacagcuucuuggcagaguuacuuucaacagcgggcaccccccccacccuaccgggaauacccccacccuuccuacacagcgcuacaucuugcugaacgaacccuaguaguaggcugccugccagccugcagccccaacaaaaaauggcaaaaacacaaacugacggcacgugaaacaucaauggacucuccuccccgcacagggccacccaggccccaccacgggcggcaugucccuaacucaauuuggcuugugaggggucacagccacgcuggaaacaucugcacccaauagaaggcgauuuccccggcugggggcccaccagccugccccgggucuuuacccuucguggggacuuggaccggcagggccugcacuucccacgucccggggugacgggaagggcguccugcaccccaacaagguccuggaguugucugggagaucagaccgaggggaagggacggcgauuuuuucaagcccaggcgaggcggugggguggagcggaggaaggaggcaggcccaccgggacuggggggaggcggccuagggccccggggggcaggaaacaccccaagcggugacagggagcgucccggcggaggcgaguucgggaauugggagagacuccggggccaggacgcacagacaggaagcgacgcgggagcaggccggggagguggggcggucgggaggagucugggagcgggacugggaagagcgaggggaagcggggcgcggccggggaggcagaggaaggggcgccgcggcccgggggucccugcccgagggggcccgcgcccgcccgcccuccugcgggccgcgcccggcuccgcgcccgcccagcccggccuaggcccgcgacucccggcggcccggcccggcccugccggccucaccgcccccacggcuuccugcagcagcgccccgagccggcucagcaugauggcgcccggcccccggcucccgggcgaaagcggcggcggcagcgc

SEQ ID NO: 17655 - RNA, 1131 nt, Homo sapiens
cggggccaggacgcacagacaggaagcgacgcgggagcaggccggggagguggggcggucgggaggagucugggagcgggacugggaagagcgaggggaagcggggcgcggccggggaggcagaggaaggggcgccgcggcccgggggucccugcccgagggggcccgcgcccgcccgcccuccugcgggccgcgcccggcuccgcgcccgcccagcccggccuaggcccgcgacucccggcggcccggcccggcccugccggccucaccgcccccacggcuuccugcagcagcgccccgagccggcucagcaugauggcgcccggcccccggcucccgggcgaaagcggcggcggcagcgcucuaggcggaggaggcagccccguggccccggcggccccggcgcgacgaggggggcggggcccggccgcuccgccccuucccggcccggcugcguggcgcuggcuaaccccggcugggggcgcccagucgggcugggaaccgccagcggugggcccugagaguuggcugggagguguuuuuuuuuuuuuuuuuuuucuuuccuuucuuccgagacagggucucgcuuggucgcccaggcuggaguguaguggcgcgaucucugcucauugcagccuccaacuccuggacucaugcgauccuccaaccccggccuccagaguagcuggguccacaggcgcgcgccaccacgccuggccaauuguuuuuuuuuuuuguuuuuuuacugggaggggaggucucacugugcugccuaggaugaucuccagcuccuggccucaagcgacccucccgccagggccuccugaguagcugggauuaaggcgggagcuaagggagguguuuucgaagagaaauuacaauuccuccugaauugaagucucagucagccccaggcacaugggcugaugagcuccugaaaugugcuggucccaaccaagaugugccgugccaagcacaccccgauuuggaagauacaguaagaaaggaaagugugaaacugcaacaaccauggcuuauauugauuacauauugaaaugacuauuagguguguuggguuaaauaacguauauuguuaaaauuaacuucacguguugcuuuuuacuuuuuuga

SEQ ID NO: 17656 - RNA, 6374 nt, Homo sapiens
ccuuggggagguggggcgccagaccugagugcaggagacgcagaccuggaagggcucccccucccugaccugccacacaucgaguuugucugcgucgaguuuggccagucugugagggucaggaauagagcaggagacagcagggccaccuccuucagaaggcccccaccgcuccaucccugcacuggguggcccaggagagacuggcagcccagagggcacagcgcgcacgcccccacccgcaucugcuuugcagccucacuggccaggaagguggacaccucauaccucagucucccaauuacgcccuccuccucccccuccuccucccucuuuucucuccuccuccuccccuuucucuccuccucgccccccugaaaaccuguggcucggagagaccuuggcuucucugggacucuaccccuggggacuucccacaucugcuccugagcuugggggcaggggggcaaccgccugaggaaccucuccagcgaugggagccgcccgccugcugcccaaccucacucuguaagugugcuaccucucccacuggaguuucguugccauuuccagccucagggcagcccuccucuucccgggacucccacgcgugcgugcacggggcuggcagggcgggggcgggggccugggugcacccuaggcuugcagcuggcacccacaccugggcuuaccuccucuccccacacaggugcuuacagcugcugauucucugcugucaaacucagguaggcgggcauucccaccggcuuucccccaauuuuuccacccuaccugaccagggcgggugcaagggaccggcuccuuucagguggacagaggcagagucuggccucucccuggguccaggaggcacugagguuuggaggggagugagccuuugaccgggugggcagggaagggggcugacugagguuuugucucuguccucccucugaggacccuccccacuuccccugggucucugcuccucuuccucccucuccaucggguucccccagacuugagggauggagccuggagcgguuggaagcagguggaggugauggcucaggugaggcuuggguuugccaguaccugaaaggacagguuuugaugcaagaccacuuguauguccuucucgccaccccacucccaucaauauggaugccuggggugggggucucgugagcauguccagaaugccuggccagggugaggugacuccucaccuagagggcacagaggucaagcccaaagagguuuguuugggacgggaugcaggguucgcuucuccacacuccccccaccccaagucggccccccaccucccuccaugcacaccucccacccccaagucucagcccccagugcgaggcuugcucccuuuuuugugauccuccauaaaagugcagcuauuaaaaugcacugguccagaaccgcucuggggagagaucgcuuggcuuucccaggccagaggcccgcuucucuucauauccaguggggacuuuuuuugaagguaaaugccuuuucucugggagagggaaaggggcagccuuugaagcagugggggggugggagagggagagacaauucccccccccuuccuucccccuuuugcuccagccccguuccaggccuuuugcuucacacauccagggggagccagaagaaagcccccagccuggcugggagggggcugggggugggcccaaccuguucuggaggggaacuagcacaauggugcggcuggccgggcguuuauggccuggcugaggccccauucaggacucagggaagguggcaaagcgguccuuucccccuugaagugcccccucaccccccugggagggggggccagcaggccggaccacagccaugcuugaggggcugucugacaagcagcugucugcagugguggaaggggagguccucccgcagcgggaacaugaaagggacaggcuaggucccgcggggagagggacuuguggguugugggcugugggggggcguggggcugcuuuugugaaaagcuugaagggggacgaggaaaggagggggcuucgggggggcgcuuucugcuccugaccuggaacagacugccagaggaggccgucggccaagaggggcggagggccugaaccugggccaggaggcggggcugggauaggcaggaccccacccccuggaagggaggccagcguggggcaggcugggcaggucccccaccccaaaugcuccaggguggggcgaggggcaggucuugcagaggcuaggcagaggcugcucuauggggaggugcaauuggaaaugagcaacggugcacaguaaguguuaaccccgcgcagguuaaauguccagcucugagagcugcucccucacucccccugccucaaaggugauauuucccacccccucccuaggagagaguagccccuaacagaugcuaaucugggucuagcucuguccagauggcugagguugggccugggauaaagguggaauuagggauuuggggcaggggcugagaaaagcugucccagcacaggcagcggcauccagguggagacaaaaccagcaaaaaagguacauucucaugcuagagcugaggcuguugccaggagccaggaaaccuagcccgggucgcaccuugcaggauggaggggaagaaguacucagucucucccacucagccuuacagauggguaacgagagaccuagcugggaggcgguacuccuccuggcuuugcacagugcguggggggaaaugguuccucucccccaacccaaaggggaagcaggugggcgggcgcaucccaccaacuggccaggagccucuguuacauuguggcuaaggagcugccugccaggggcagccauugggccaccgcugauagugccuguccucuugguacugccucugccucccuccgcuaaggaggcaccuugccugccugcugucccauagugcccagccccagccccagccccagcuccagcccauagaggagggaggaacacuggaagggcccugagcaccagggggcaaggccgggaagaagauggguaugagcucaggauuccacaguuagugcuucaaagaaaugcucaugggacccugcaggagcuuucagagucccccacaugcucucuggugacccuaacucgcagcaccaucugcucugugcccgugugcugggcaaggggucuuucaaggccaguggggaggaugaggaaggaaucugguuguccuggcuaauggagcauguccuuggaguucugggggagaugacaggcucuggucuaagagguagggacagggguucugucccuaaugagcugugugccccgugcaccuccuucauagaauacgaggacgggauagaacccugagggcuccuuccagcucccagaguccugauuccagggcugugcucugucaauaagugucccccagccugggcagaccccagucccuucuguaagguagacgcaaagcaaagagguuaugaccggcucacccaggggccugggaaggcuauggccauaugcccacuucacucugcaggacaaguggccuguccccacuauauucaccuccucaccccucucccuuggauggaccagugguggugucacccaaagcaaauugacacuauuuuucccuugguaaccgcaaagggggagaaucacccgucuccuaauuuuaaccaguacgugagggaccagggcgccaugaccgaccagcugagcaggcggcagauccgcgaguaccaacucuacagcaggaccaguggcaagcacgugcaggucaccgggcgucgcaucuccgccaccgccgaggacggcaacaaguuuggugagaguuggcccuccccccagggcacccacaccuccacucugccucacuuccacccugccucaccuccugguccauccccagauccugugucagggcugagggccccaagggccugaguguccccaaccccuucgccugagucuggaggucaguguggcugggugguccccugcuguagccauaggccggcagccccgauggacggaggucuuucuccccucccccaccacagccaagcucauaguggagacggacacguuuggcagccggguucgcaucaaaggggcugagagugagaaguacaucuguaugaacaagaggggcaagcucaucgggaaggugaggcugggagacugggaaguaacagagaaucagcccuacugggguggggacauauagggcaucaugcuccccucucuccucugagccacacacccuccuguguaaagacuucccauccuacucucagcccacccacugggccacucucugguuuuuauuuuagaguccgggucuugcucugcuaccuaggcuggagugcaguggcacaaucauagcccacugcagcuuuguacuccugggcucaagcaauccucucgccucagccucugaaguaguagcuggcacuauaggugcaugccaccaugcccagcuaauuuuuuuuuuuuuuuuuguagagauagggccucacuauguugcccuggcuggucucaaacucacgggcuaaagcgauccucccaccucagccucccaaagugcugggauuacaggcgugagccacggagcccggccugguuucucuauuuaaaugaguccccgggacucuauuagcccucugaggggacuggcaagccacugggaucuguggggcugaugucaggaguauuucuccagcaggcaucaguaagagcuuagcaucuaccugacacugcagccucuggguggaggacuaagagcuguugaggguggaaaguggggcacagauguaagacaggaacucccccaaguucaguggggccagugggcuccagcuagcaagauagacacuaagcagcugccccugugaccaaagcacacgguaggccgggcccugcugggugggagaauuccacuucguuugaaaccaggcaaucccagcuucccauucggcugucgcugaccaaauaaccuuugguuugcuuaucuuugucaagccucaggcuucuugucuguagaaaugggcacagaccccugauugcagacagagugggauggguggcugcacuggcacccuucuuucuucucauuggaggcugcugccuccucucccaugcccagcagcaccccucaccuaggcugcaugagcauuucagugcuaagggcccgugcaugcugggaaaugccgcagguccuugaucuucaccuacaucucaggaagcugaggcccagccugguucaggaccgcuaaacgacaagccugcaacucagauccacaaagcguguucuuguuggccacuguugccucucuaaauaggaugccaucucaccaggcagaguucccugggcucacggccccguuguucccguugucccuccucagucguccaaaauaggccguaagggcgacaccccagaccaggguagguggacaaaugcccuuccuguccuugcuucucccgcagcccagcgggaagagcaaagacugcguguucacggagaucgugcuggagaacaacuauacggccuuccagaacgcccggcacgagggcugguucauggccuucacgcggcaggggcggccccgccaggcuucccgcagccgccagaaccagcgcgaggcccacuucaucaagcgccucuaccaaggccagcugcccuuccccaaccacgccgagaagcagaagcaguucgaguuugugggcuccgcccccacccgccggaccaagcgcacacggcggccccagccccucacguagucugggaggcagggggcagcagccccugggccgccuccccaccccuuucccuucuuaauccaaggacugggcugggguggcgggaggggagccagauccccgagggaggacccugagggccgcgaagcauccgagcccccagcugggaaggggcaggccggugccccaggggcggcuggcacagugcccccuucccggacggguggcaggcccuggagaggaacugagugucacccugaucucaggccaccagccucugccggccucccagccgggcuccugaagcccgcugaaaggucagcgacugaaggccuugcagacaaccgucuggagguggcuguccucaaaaucugcuucucggaucucccucagucugcccccagcccccaaacuccuccuggcuagacuguaggaagggacuuuuguuuguuuguuuguuucaggaaaaaagaaagggagagagaggaaaauagaggguuguccacuccucacauuccacgacccaggccugcaccccacccccaacucccagccccggaauaaaaccauuuuccugcaaa

SEQ ID NO: 17657 - RNA, 297 nt, Homo sapiens
cccuguggcugcagccuccaacucccacgcugcccccaaagggcucccugcuagaccuagagcucccuaagccugcauucuccaagucuggauauuuaggaaguggucaauaucuacaugugaaaugauccuuaaguccuguguuaauggcucuuguaucacugacuggcaccaucaccuccuuguccaucucuccuuuccccauccccugccaccuccugaaggcacccagcggacggacagagaacucagggacugaguuuccaucugugucucagaaaccaagcaagggcucca

SEQ ID NO: 17658 - RNA, 501 nt, Homo sapiens
uggccucaauauuguucccaccuaccuggaucuggcccuugaggagaaucacaucgguuaccuuuguccugaauguuugcgaggagcagaagcagaaccugauugcaagaguauagcuugacaaugagcucaaacaaggcuggaaacucuagggcagagcuuccacucuccuagggaacuagaaagaagaccaggauagguuugaggacaagaugcuagggagaaauaauaugaaggaggcaacuuagacaaacagggcugagacucaccuaauccauacugaugugcuuagauagaaagaccuaccuucaaauaccuuccagagggcugggcuaacaucccugauguacacuugcaccuguccuggagaagccucaucuggcagcuggagguaucagccaaccucacaaugaguaucuaggguagacaagguggagaaggugcaccaugagcugauguugguaccauggagacguaaccaugcccagaggucuaagccua

SEQ ID NO: 17659 - RNA, 616 nt, Homo sapiens
guuauuucauacuaguuuauuuaggaguuccauuuucacuccucaauagauuuuauguauuucucauaugcuucuucacucauaaguucaucuaguucugaaggguuacucagugucaucuugaucagccaaccaucuucauaacaagauuuguuuacaaguccuggauuuucugcaagagcuucauuaauuucaguuacuucuccugauaaaggagaauagaguucacuagcagcuuucacacuuuccaaagcaccaaacucaucuuguuuguucaauuuugucccaacuucagggagacuacaauaaacaacaucucccaacgcuuccugugcaaaauugcugauucccacuguuccaaugccauuuucuguuguuacccauucguguuucucugugaauuuacgcaccgagagcagagcggguccagugcguagcguacggacggcgcccacccccagcugccagggccucggcgggcagggcgcggcgggugacgggaccgcgcgcagggugcagagcagggcccgcacgcuccgcaccacucgcagcgccauguucgcaggggugcgggggucgcagcgcuacgccucggccacccgcgccgggaggcggg

SEQ ID NO: 17660 - RNA, 2589 nt, Homo sapiens
aggcuggaaccuauuugccucaguccuaucugauucaugagcacaugguuauuacugaucgcauugaaaacauugaucaccuggguuucuuuauuuaucgacugugucaugacaaggaaacuuacaaacugcaacgcagagaaacuauuaaagguaauacuuuuuaaauauuaaaguguugggcagaaaaguucauugcauuaaacuagauuuaggugaagccuagucauuguuaccaauauaccugccaugagugagguaauauugugucguuauauaauauuuccagguuucuauagaauuaucuuaauuccauuuaguaaguccacucuuuucagguggagagaaaaggucaaugugaaaugucauugccuugagaugaugguaccucauuuuccaucuaguuagucacccuguccaacuucccauccuaccacuuugguugagccauacugaaaggguuuuuauuauccagagggugucuugggaccagcucuucagcuguguuuucagggaucuggauucuaagcaggcuguuugccuuuuggaucauauugggaauaaucacugucaggguaguuggaaaggaauuugggugaagaacuaagagcauugauacaacuaauguuguagcuuugccaaaucauuuaacuuuuauuuucucaccugaaauauaagaauuacaguaucuccccauuuccuuuuaagagcauugugaaaauaaaaagaaaguacauguggcagcuguggaaaguaagaagugccauucagauacacuguggugugauuucuuuggaauugugucacccaguaaaagugcuuuccuggcuuuuugcuagcauuuuaaauaauacuguucucucaucuccggcgguugagucaucugaaaccagcuugauuucuuuuuuuuuuuuuuuuccaacuuuuauuuuagauucagggguacaugugcagguuuguuacaaaggguauauuaucugaugugagguuugggguacagaugaucccaucacucagguagugagcaaaguacccaauagguaguuuuucuuuucuuuucuuuuuuuuauuauacuuuaaguucugaguuacauguguacaauaugcagguuuguuacauagguauacaggugccauggugguuugcugcacccaucaaccugucaccaaauuagguauuucuccuaauguuaucccuccccuaggcccccaccucccgacaggccccagugugugauguuccccucucuguguccauguguucuuauuguucaccucccacuuaugagugagaagaugcaguguuugguuuucugaucuugugauaguuugcugagaaugaugguuuccagcuucauccacgucccugcaaaggacaugaacucauccuuuuuuauggcugcauaaaauuccauggugcauaugugccacauuuucuuaauccagucuaucuuugauggacauuuggguugguuccaaguuugcuauugugaguagugccacaguaaacguacaugugcaugugucuuuauagcagcaugauuuauaauccuuuguguauaugcccaguaaugggauugcugggucaaaugguauuucugguucuagauccuugaggaauugccacacucucuuccacaaugguugaacuaauuuacacucccaccaacaguguaaaagcguuccccaauagguaguuuuucaacccuuaccuccucccucccucccucccuuccuuauaguccucaguauguaucauucccaucuuuaugucagugaguucccaguguuuagcuccuauuuauaagugagagcauuguaagguagguauuugguuuucuguuucuguguuaauucauuuaugauaauggccuccagcuguauccauacugcugcaaaggacaugauuucuuuuuuauugcuguguugauuucuuacauuuuaaaauucucuugguucauaauuuuuuuuaaagucagccuuacacgugccaugaaauuuacccuuuuuagugugcaacucugaguuuccacaaagauacacaaggucuugcaagcaccaccauagucaagauacagaacauuuucaauaccuucaaguucaugaauuuguaagcagucuggauagcauuauuaauguugcugugaucugucaagauauuaauacuugguucagaaaagggagaaaaauuacuuuucuucaguguaaacauucaaacuguagaaguuuuuguggaauauagagugaaauacuucuauaugucuaaauaauaacuauaaaaaugaugugaauauuuauuauuaaagaaucaaaauuuuaaaaaacuuuuuucccucuccaacagguauucagaaacgugaagccagcaauuguuucgcaauucggcauuuugaaaacaaauuugccguggaaacuuuaauuuguucuugaacagucaagaaaaacauuauugaggaaaauuaauaucacagcauaaccccacccuuuacauuuugugcagugauuauuuuuuaaagucuucuuucauguaaguagcaaacagggcuuuacuaucuuuucaucucauuaauucaauuaaaaccauuaccu

SEQ ID NO: 17661 - RNA, 18614 nt, Homo sapiens
gcucgcucugcgcgugcgccgguggcgggacucuggggaaaauggcugcgucuucgaguggugagaaggagaaggagcggcugggaggcgguuugggaguggcgggugguaacagcacacgagagcggcugcugucugcgcuugaggacuuggagguccugucuagguaaugcggcgagccugagagccgggcuggagcugggccgggggacugaccccggagccggccggcccugcguuugugcucguucucgggguucggcggggagggccagcucgggaguuucgggugcaugagggucauggacgugggguccgcagcccucuggcacucugggcggcgguuuuucccguuagagggaauuuuaguaaugauaagaacucgcgcggucugagccucuucguccgcggccagccacuuaacauuuauggaacgcuccuugggggcucagcauuggggagacgguagugaaggguagacuggaugccagcugucgagagagagacagauguguaaacuggcuuggggccuguuuuuauuagagggcugcgcugcgggguacuggagcacagggacuaggcaccuuuuuugguuguagucagggcaggcccucugaagaaagugcugcuugggaagcaugagcucgccaaacucacuaggcagcacagauagauggaacagcaagugcaaaaagccuggcuugguggaguugcaaguuguuuaggaugguugugugucagagauaggagaugaaauuagaugucguucuucauauucugucaccuuucaugauaagucuuucaaguugaagccuuccuugacucccucccauugacuuggaugguaaauuaucuugguucuaccuccuaaagugucgcuccaauuugcccucucguuccaaccccgcuguucauaacuccuucuuaaauguagccucccaaacaguuuuaauugccucaugcuucugcacuuuauccuuuuauauuggccgauaccaguuuuaaaaggcaucuuauaucacuuuucugcagaaaaauuauauaaaagcuaccucauugguagguuugcguuguccagugagguaaaguucaaauucuuuagucagacuuccacaucuucagugccauucccagucuacucccgauuuggugaaugauucauauauccuucagaauccagcucaaaugucacuuuuucuauagccaacauucuuugacagcuuuagaauaaaucuuaccuguuguauuuuaaaauauacgugauauaaucagcacuuuauuuuugguguaaauuuaguccuugccaucguauugcuaccaaguuaccaggucagcacaauauuuaaugauggaagaaaacccgaaaacaccuagacagcagaaauuaaauggcuuauguguuugauccacuguuuaaaauaaacuguauuagggccgggugugguggcucacgccuauaauccgagcacuuugggaggccaaggcgggcggaucauuggaacuucuucacagaaugaagcugcucugguggugugacuggcuuccagaaaggucucauguguucacucagagguaguuauguguacugauucugugaucugugaaguuugucagucucugaauguaauuugugucuggcuugcauuuaugaaaaugagaagaaaaaucacgaauauaccuuacauauuuuuagauuuagccucuuuaaaaauaguggauuuauaacuuaggaucuuuuuuuuucuauuaaccugauuauauagccuuucgggauauuuauuaguuuauaaaauguaaugcaaggagauagucuuaaaaaguugaaacacagguuguaggcuaaacguuuuuuuuaacccauuuguaacucaaaacucauuguuccacagaaccauguugauaggaaucuugaguuuuccacaccagccuguuaauucuguuuaccugaaaaguguauuacugcuaauaauguaggcucuaaccgcuauggaaauuuuauuucuauggggaauugugucuggauucuaaugcaguaugcugggaaugcaccuucuuuuuagcaggacagggcucuugagugugggggcuuccuuuggccucuuuuucgcaguuggggaggacagggguuucuauuuuguccuggacuguuacagaacaugacuaagucuuagagacuucuaccuccccucuacuccggcgccuaaggcaagccuuguaaagccuucuguggacucacgcucccagauuugcaagaacagaggaaggcuuaucccacaucuccuaccauagccccacucuagucagcaccacuccugccccaccugaaaccagcuuuuacuuagaccagagguucucaaccgucuaugucucacuuguggcguacacuaaaaaguuuacuuaacaugcuguuuucauacgcuguugauccaucagcaaguccuguuagcucuaccuccaaaagauaucugaaaucuguccauguuucucccaucacgauuacuaaguccuggaggcuauaaccucgucaaaaccagugucauuuuuugccuggaacacuacagaaaccaccuaacuuacuuccuguucuggcccucuuacagucuauuuaccagaucacucaacaguuuuuaaaaguauaaaucaggucaugccauuucccuguuuaaaauaacccaguggcuucucauugcauuuagaaugaaacacuaggccgggcgcaguggcucaugccuguaaucccagcacuuugggaggccgaggccggcggaucaccuguggucgggauuucgagaccagccugaccaacagggagaaaccccaucuguacuaaaaaaaaaauacaaaauuagccgggcgugguggcacaugccuguaaucccagcugcuagggaggcugaggcaggagaauucuuugaacccgggagguggagguuggggugagccgagaucgcgccauugcacuccagccugggcaacaagagcaaaacuccaucucaaaaaauaaaaaauaaaaaaagaaugaaacacuaaucuuuaccauaacuauaaggcccuacguaaucucaccccuagccaccuggcugcuacauccucacuuugcuuuccucuccccauugugccaggcccuggcuacaccuccucagcuccaucuuuggggcacugaacugucugugucuucuacugugcucuuuccuuccagacaucuuggcugacuucucucauuuaauccgugucuuaugucaaagcugugcccuuaggaagaccuucucugaccacccuauugaaguagccaacccacucccccaguagucucuaauaaaacauugcuuuauuuccuucccaacccuuaucacucuagguuuauuucuucucuuaguucuucuugucucuuguauuagaauuuaagugccauuguucacuuugauaccccaaguaucuagaaagugccuggcacaugauaggcacucaauaaauauuugaugaauuagugaauaaaugaagacuuugcauucuuauaucuacuuuuuucauucauugauuaauucauaaauaaugguauggggaaguaguagugggaaggguugggucuaauugacaugauccagaaaaaugauaugaugcuagcuggaaggaagguggaaauuugaagguaaaaauagccugguagccagugagaaaguacaaaugcucaggcugaucagagcagugucagguagcuaguugugaagcugccccuucugcauaauuucucaaaagucccaucuaucaacaaguuugaaacuaauauauaaacauuaccugcuauacauuuuucccaaucuuauuuugcucaucagauacuaauuuucauacagggaaauugucauauuuauuaaaugagcauucuaaaaggauaucauuuuauuauguguaaggaucccucuuaguugauguuuaauuuaaaaaauucaaauaaaguggagaaucauuaaaaaaugguccaugcaucccuuaauuguuuuauuuuaccuuaaaauauauaaacauauguucauucacuaaucauguuauguaagacaggagucagaaaacuuuuucugcaaaggccagauaauaaauacuuuuggguuuaugggccauauagucucugcuguaacaacucaacucugccucuguauuuagggaaaacugccauagacaauuuguauauuaaugggcagacugucuuaggaaaauguuauuuacaaaaacugcagaagugcuggauuuggccuguagaccccugauguaugaguuuuucuugcauaaaucgcucauaaugcauugucugcaauuuguaguuugauuucuagaucaaaucaaaaugagaacuuauccucuuaucaagcagucuuagggcagacccuuaguuuuuaugacuuuucccugguccuuucuuuauagcuguccuuugcaagccucuguagagucuuuccaagcauuaggcuuagguuuuuauagaaagaacucucucuauucacaauagucuuucauuggcauuuaggugauagcuauuuauauaaugauaguauuaaguagaacuuuuauaaauaaguuugguaaccggcacaagcgagucuuggugagcuguaguucacagucaauagcggacuguagggaguagcccugaguguucaguaugcugugaaaggguuuuuguuguuguugguuuuuuuuuuuuagggaacuuauagaaaugcuggcaauuucaagaaaccaaaaguuguuacaggcuggagaggaaaaccagguaaguggcuucuuuuuaaauuaguuaauuucucuuuguuuuuuaauuaaaagaaaaaaacuugauuucugcaaguuuccucuuuauauuuacuuugugugggaacaggaauguuggauccuuuuaaguuauuaauuaaaacuuuaauauugguauuuucuuuguaucauuuacuuaagauaacagugcgcuuaagaagaauaguugccugaggguuuagcaguauuuuguuauuuucucuuacaauucuagucacacuuacauguuuauuuauuuuuguccuuugaauuaaccaagaaaggcuuguuguauggagauuacaacaauauuuagaaucaaaaguuaaugcucaaaaacuuaccguguauuguaaguauaguucccuaaugcaacuugaacaugcagggaaauaaaagagcauacaacucuuauuagacauugccuuauaggggugaaaguacgggcaguuuuuauuugcucacuuuucggugcuuucuaauuuuccauggugggugaacagacuuuuuuuccugauucagaauuuuuuuagagguaagaggauaaauuuuauauuauguuuuuggcacaguuuuuucuuuuuugagacaaguucucgcucuguagcccaggcuagagugcaguggcaugaugacugcucacugcagccucaaccugcuggacugaagcgaucucccacuuauccucaccaguaucugggacuauaggcaugcgcuauaaugccuugcuaauuuaaaagaaauuuuuuuuuuugguagagacauagucucacuguguagcccaggucagucuugaacugucuugaacuccuguccucaagggauccuccccaccuuggccuaccaaagugcugggacuauaggcaugagccaccauagcuggccaaaaaaaauguuuaagagaaaaugaauggagaggauuaaccuuucuaaagaugauguaaaggagaagaggagacaguaauaaaucuuuugucugcaucauuaccuuaguucugucuuacguuuugagggcagggaaaucugacggacucaauagaaaagugucagugagccucaaaaggggaggaggggauccagaugaggccacaagcuaggagaaacagcuaaccuuagggguaguaagguuuuuguuuuguuuuuuuucaaaaaagaaagaggcuagagauaaauauguuaauagaagacuacuagucucucagguacucuguuaauacccgugggauuaaauaggaauuuauacaaaguaugcaagaaguaaaaugcaaggcuugacuuuauuugauagacacuuauuaaaugcuugcuaugagccaggcacacagauuauucagaaggugauaauuaagaccuauaaucagcacugaucuuucuugcacuuuuuaaagaguagcaauuugugaauugugucuuaguacuguggauuccuauguaauuuucauugaaacuguuacuauuagagagggaugugcccauuugaaaauuuucuagccaccauuuuauuuggauauuuauaauuuuauauagaauuuuagaauuagaaaggaucuuaacgauguucaguucaaccuccugugagaauaagcuccaggguggacggaugagguagagguuaauggugaguggaaccagaaccuaggucuucugacuuuaguugaauaauuuuuuucuacugaacaauaagaucuaaagagaauauuuuuuacucauggguaguauacaaauuaauucaaccuguguaaacuucuugaaaguugucagggaacuacuguguacuacuugcuuuaauaauacagcuuuuauagaaauggaaaccuagcuuucuccuacgaugugggaggaaugaggauuagaagucuguuaaauaaauagaauauacuuuacuuuuuacagaaaaagcuuucuguuguuauuuaaaauacucuuaauauuuggcaguuuguagcucagucuuuugucuauuguauuagaagaauuccuauaaaaugagaagaacuucaugucaaaaggaucuugaagaggcauaccuguacuuuuuagucuucaacaaaucuuuuuaaauaguuuuaaaauugauucugaauuuugauagauauuuucuuucugaaguaguauucucuacuuagcacaguaaaggauauuuagacuagacuugcaucuuaauucuguacugggguagugaucguaauaacuagccuuugcugaacucuuccuguauguacuuaaagugcaauauaucaugaauccucacaauagcuucauguaauggcuacuauuaauauuauauuccuuuuccuauuaagaacacaggcucagagaggcugguaacuuucccugugucacacagcuagcagauggaggacuagagauaugaaccaccagacuuucuauuuuauguguuuuagccuucaugguuuuugccguaucugcauaccacuuguuuguuuacuguuuuaugaaaucacuguauuuuuuuuuuuuuccugagacgaagucuugcucugucacccaggcuggagugcaguggcgugaucuggguucacagcaaccuccgccuccuggguucaagcaauucuucugccucagccuccugaguagcugggauuacaggcaugugccaccacccccggcuaauuuuuauauuuuuaguagagacgaaguuucaccauguugguuaggcuggucucaaacuccugaccuugugauccgccuaccucggccucccaaagugcugggauuacaggcaugagccacugcgccuggccgaaaucaccguauuuuuaagaucaucuucauuguaaacaauacugugcauaaacucagaguuucagugucucaguuuuuucuaauauauauuagcacaaauguguaaguguaaaaguuuucuuaaguucuuggugccaccuaaaaucaucucaaauaccaaauuuugggagaacuuucauuauuuauauauacauauauauauuugcgauggaguuucgcucuuguugccccggcuggagugcaauggcgcgaucucagcucaccgcagccucugccuccggguucaagcgauucuccuuccucagccuccugaguaccugggauuauaggcaugcaccaccacgcccagcuaauuuuguauuuucaguagagaugggguuucuccauguuggucaggcuggucucgaacuuuugaccucuggugauucgccugccucggccucccaaagugcuaggauuacaggcgugagccaccgcgccuggccuauauuguauuuuuaaggauaaacuuuuuuuuuuuuuugagacagugucuuacucugucacccaggcuagagugcaguggcgugaucuuggcucacugcaaccuccaccucccaggcucaugcaauucuccugccucagccugcugaguaacugggauuuuaggcgccaccacacccaacuaauuuuuguauuuuuaguagagaugggguuucaccauguuggccaggccagucuagaacucgugaccucaagugaucugcccgcaucagccucccaaaguucugggauuacaggcaugagucacugugcccagccauaaggauaaacuuuaaaaucgugucuucccuaggaaaucacuaaacuugcucauguugccauauugcuaguucugaaaggcuaguuuuauuuuguuuuguaugaaagaauaucugaaaaaguagaaaaguuugauauuaauguuucccaaaauaaucauagguaggcucuuuuuauucuuaacaagaauuaggaauaaaauuuugaagguguugaaauuuauagccuagccaauucaguuacggauucuuuguuucauuggaaugcagccuuucaguagucuauugucugauuuaauugacuguuaucugacagguccuggaguuguuaauucaccgagauggggaauuucaagaacuaaugaaauuggcacuuaaucagggaaaaauucaucaugaaaugcaaguuuuagaaaaagaaguagagaagagagacagugauauucagcagcuacaaaaacagcuaaaggaagcagaacaaauacugguaaguugacagagguugguucuuaagguuaaaaaggauguuguuuaaucuguuucugaaaaaucuguuaucaauauuuugaagagcagaaaacuagacuuuccaagucuaaaggugauaucuugucacucaccauugccagugguuaaaugaaaggcuauugucauucucuuuuuuacuuacuguuuucaaauagucugcauuacuugugagccacauuuucgaugcuuaaagauuuuacaguauugaauuauagaaauggaaaguuuuacuuuuauccuggucugauauaaauuuuaauuaucaguagucuaaaucucucuuuuuuuuuuuuuggucucugauccuuagcauaaaaaucagggaaauuuuucauuuuuuauauauuuugaaaucaauaaaaauauauacacauuuuauaaauugauuaaaauugacauuaauuuagucauucauccucaucuagguaggauuuggacauagaucaaggauccuaguuuucccuuugcuguucuuggcuacuauuucaaagaggcaacuuauuugcuauuauuugcccaguuacuucacuaaauacuaacuaauauaacaugauaguauugcagaaauagcugagcuugauucucaugucgaccagacauugcuggcauccuuaccacugauuaaucucuuaacaaauguauuaaaaugagcuccaguaacuagaagccugggcaguucaggguaaauuaaucaccucuacuaaggaaacaacucacuaguaaauaguuuuuaaaaauauauuaaaaucaggccgggcaugguggcuaaugccuguaaucccagggcuuugggaggccaacgcagguggaucgcgaggucagucugugauugagaccagucucaguucgagaccagucuggccaacauagugaaacccugucucuauuacaaauacaaaaaauuagccaggugugguggugugugccuguaauuccagcuacucaggagacugaggcaggagaaucgcgugaaccugggaggcauagguugcagugagcugagauugcgcuauuguauuccagcccaggcaacagugcaagacucucaaaaaaaaaaaaaaaaaaaaaaauuagcugggcacaguggcucacacuuguaaucccagcacuuugggaagccaaagugggcagaucaccugaggucgggaguacaagacuagccuagucaacauggugaaauccaucucuacuaaaaauacaaaaaaauuuagcugggcauggugauucacgccuguaaucucagguacuugggaggcugaggcaggagaaucucuugaacccgggaggcagagguugcaaugaacugggaucaccccacugcacuccagccugggcgacagagggagacucugucucaaaauauauuauuuauauguuuguauauauuauauauauauuaaaaucuguaaauauguauauaaaaauccuuauguauguaauacuugcuuaucaaacaaaauucagaaaauacagaaaaauggaaagaagagggaaaaaauugucuuuaguucagcugcggaaagaaugccacuauucauaguuuggucuauuuccuuugagucucagguguauuaauuuuuuagguaauuguaguuagcaggauacuaacagacuuucaauuacuguuuauugaaacuuaagcauuuuucauauaauuguauccacuuuguuugauuuucccacuuuguguuauaaauaauuaaagacagugaacacaggaccauaaaacugaauuucaugacuuaaauaguaguaacuaacauugauugagcacuuaggcaccaggcccugugccuugcauuuuauaugcauuacuuccaucuuccuaacaguuuauaucaagucagugucgucauuuagaggaagaaaccaauacuuuaauaacuaacuugcccauggaggcuaaaaaguagauugaauuuaaaccuugaucucucugacuccauacucuuuuuuuuuuuuuuuuuuuuuuuuugagacagagucuugcucuugcucuauugcccaggccagagugcgauggcacagucuuggcucacugcaaccucugccuccuggguucaagcgauucuccugccucagccucccaaguagcugagauaggcgugugucaccaugcccauauaaauuuuuuguauuuuuaguagagauggguuuuuaccguguuggucaggcuggucucagacuccugaucucaaaugaucugccugccucggccucccaaaaugcugggauuacaggugugagccauugugccuggccugacuccauacucuuaaccacagugucauagucgaagauaugcauauacuagguuaacuucauuuuguccuuuaguguaccugagggcuuggagggaguguuuuugugauaaagucauuaaacauugagcugauauauaaacgaauaagaauaugaauucaagguuguaucuuccaaacuaggggaaaaaaggguauuuuauucuugaacuaguugcaagaauaggaugcuuuuggggucguccauagucugggugucuucugcauguuuaugguagaagacgugaagaaaaagacaauccaauuuauguuuuguuucuacaacuaauuugugaaugggagacuaguucauaaauauaauauuucuuucauuaaauaugacugaaauaaauaaugucaagugguauuucagaacauuacaaauaaauuguugggauuuccaaguuucaaagauuguucuuguaggcuaaaggaucuugugaauuaagccaaaaacuaaguuugauauaguugaagaauaaaccacguuuuuuaaauguuguuuaaauuaggcaacagcuguuuaccaagcgaaggagaaacucaagucaauagaaaaagcaagaaaagguuaguaucaugggaagacugaaugaccugaaaaguuaagguucugguuucaggaaaccaauacaagaggauauuacugauaaucauuugcugcuguugaaaagauucaguaaauuuuuauuguaaaguguguuguguucuagcauugugcuggguuuugugagggagguagaaguaucacaucuuuuuucagauuauaaaaagcaauuaauacaaggcaguuuauggcugugugcccaaaugugcaguaaaaacagugaguuuauaaaauuggugggagagggaaagagaaguauggguuagaagugggauuuguaccaaaucuugaagguuaggacagagagagugaaaagacauccauugggcaacugcgcugggacugaaacaucaugaagucagagccagacguacaugaagucagagccaguuauacccuuggcauauaagcacauuugguggugcagaggcccacaugccuuccugcccugcugucccuuuuucaaaggcuucuguuaaauagcuaauacuccuuuuuuuuuuuuuugagacggagucucgcucugucgcccaggcuggagugcaguggcgcgaucucggcgcacugcaagcuccgccucccggguucacgccacucuccugccucagccucccgaguagcugggacuacaggcgcccgccaccacacccggcuaauuuuuuguauuuuuaguagagacgggguuucacuguguuagccaggauggucuugaucuccugaccucgugaucugcccaccucggccucccaaagugcugggauuacaggcaugagccacugcgcccagccaaauagcuaauauucuuuugagaguuagguuaggcuucuguagcaagaaacaaaucucuaggagagauggcugaggcuggcuguugacuucuagaccguuguuugauucuguuuuuaaucuucaaaaacuguacacacauacacuuuguuacauugaaacaguaucuaaaguuuguaaaaugaagugugugguucucacuucucagagguaacuauuaauguuugguauauguccuagauuuuuuuuuucuagaucugugaguauguauguaauaaaaauacaaauacacauauguacauacauuuugaacagucgggucauaccguacauauuauuuagcaguuuaguuuuuuuuuuuaccuaaugaauacauuguagacaucuuucuauuuaggucuacuuaagagccuuagggcauauugaucgaacagaguggugugaacugucugcucugauuucauagcuuggaugucuuugagaaaugaaacacuguuuucucuauuuuauuugugcucacuaugcuuucagaagaggaaugguauuuaacgguaguuaauaauugagauuauugagugcuauggugcuaaucuccgaaauuuguuuaugucagcuaauuuuucuggauuaguguccuguuuuuggagauuuaaguuuauacuaaacauguagguauuguuaaggaaggcaggugacugagauuauuuuauuuucagauaauuuaaaauuaaauacgauguguaacugauagauacauuucuaaacuuguauguuuguuagacuacagguuauacuguccucuuaaaacucuuucaggugcuaucuccucugaagaaauaauuaaguaugcacauaggaucagugcaaguaaugcuguaugugcuccacugaccuggguuccagguaaacauacucgucuuauuauacuagauauaugugguuuugaagauucuuaggugacuauguacagacauagauuuaauuuaaaauguauuuauccuuagaaaccucugccacauauuuucacaucuuuaaugguuuauaaguaaugauauaggccauggguuuuauaaauuugguuuucugugaagccauuguugcuagggacuguguuucuuucgucuuuugaaauaauaaauugauaauuuuuuaaaguacgagauaauaaugugaugcuucuaaagcuuuggauuuauauaccauuuuaucagggcuggccagaagcaaacucuuuagagccauuaggauuuccacaaagguuccagccugagaaagacaauuccaguucucuuagaugcuaaagacaaagcacuacgcacccaacagugaacauacaggcuuggaaagagcugggauaauuagacagcaaaagagaggaucaagcugcaacuauauugacaguggaugaaacauaaaacaggagacguaagguagcagccuuauuggaggaaggggaaauauuaguaguuaucuccacuucaaaauaacuucugaaggugcuguguuaccaugcugaaagcacuaagggugacuauaauuuuggggauggauaagcugcaguuggugagaugugcccaaaaagucaauccaaaucuggucaaguuuuugucaaccacauacugcuauuuagugugcuuucauguuugggauggacauuaccugcuccugcuauuuugccacuuacacgaauuaguuucugaauuacaagaucaaagagguugguuagaaaaagguuuuaucuuagacaagguggcaugaggaaaauaaaaguaaaacaaaaagaugaaaaauguaaaaaaaaaaaaagauuuuaaauugagacaguccuucuauuaaacauuccaguccuuucugucuuauaagugucaugauuuuuuucucccuugcagcauaaucauugucauuuucuugcuagaaaauacaguuaaguuugaauaauugagauuauuauaauuuucuuaaguugucaucuggaaugucuacaaaaaaaugacaucucuuuuuuuuuaaaguguagaaaauaguauauucuugggaagauucagaaaagaaauuaaaaugcguguauuuuaaaaaguaauaugcuauuaauaacaauuuauaaggugacuuuuauauuucuuucuuucuuuuuuuuuuuuuuuuuuuuuugagacagggucuugcucuguggcccaggcuggagugcaguggugcaaucucagcucacugcaaccucugccucccggguucaagcgauucuccugccucagccucccgaguagcugggauuauaggugcgugccaccacgccugacuaauuuucuuauuuuuaguagagacgggguuucaccaugcuggccaggcuggucuugaacuucugacuugaggugauccacccaccucguccuccuaaagugcugggauuacaggcgugagccacugcaccuggccagaugacuucuguauuucaaaauugaaaauguagccugaacuuuucagcaugaaccagcgaaaaugaguaugucaaauaacauauuaacacuuauuuuuuaaaauaugauugaauuaaaugcagucuuuauuguuuuaggggacccccggagacccuacccaacugauuuagagaugagaaguggguuacugggucagaugaacaauccuuccacuaauggcgugaauggccauuuaccaggagaugcacuugcagcaggaagauugccagguaauguuaagccgaagaguguuuucaaacagaucaggguuuuccagagaugacaagguuggaauaucuggcgguaaagcaaguuugagauucccgacacaauuuuuuuuuuuuuguaaauuugagacagucuuguuaugucacccaggcuggagcguguuggcgaaaucuuggcucccagguucaagugauucuugugccucagccucccgaguagcugggauuacaggugugugccaccaggccuggcuaauuuuuguauuuuuaguggauaugggguuucgcucuguuggccaggcuggucucgaacuccugaccccaagcaaucaccugccucagccucccaaaguacuggaauuacaggugugagccagugugccugccucucagacccaguucauuguaauagcuagauucuuugccgguuuauucugcucuaaagauucuccuugagggagguaugaaauuagaacaagcugccuuucucuuauuuguaaauauuacacugucuuccucaggcauuuggccucucuuuuuaaauuauugcucuaaacauagcuuuuuuauaauugugaaacaugcuauguaaauagaguaagauaguuuacggaauaaagugaacacacuccugaacaacccccaaguuaacaaaaugaauaacaauagcuuuuuauaaacuuuuauaacuuuauaaaauaguauuucugugagacccaguucauucugagcuucaguuuuccucaaguuuuucauagguuugugcuauuuuuauauauauuuguuuuauauuauuccucaucuuuuauaguuuguaggugacuuuuguuuugaugugguagaacauuugggaaguagaaaaaggcauuuaaaaaaggaaaaaaauauacccuuucugaggcagucacuuuaaauauuuuagccuguuuccuuuuuuccccuauacauuuuuugcuuaauguuacaucauaaggcugucccugugucauuaauaaugcuuuguaugcaucauuuuuguuagcuaccuaaaguacaaccaggggaacucaacugugauauccuuggauaucaccucauauuucucauguuuuaaaaguacaggaaaaacagauauggggagucacugccacauuuuggaccaaggaagggacagaccuaaaaacagucuuccccagcuccaucccaaggccgauacucucauaucauggugcugucauuggagagggugcaguguaauguggcccacuccauggcagagaaguuagaugaggcaucagaggccagagcuggcaagcaggaaauuacccacugggguuccagggagacuugcugggaagcugcccuuugggauucuggugaaaccugcuaggaaaccaccuuuagaggcgccaccgaaaguugcuguggugaacaccacuuaauguccugcacaccaaccaggcaucacagcaguaaaggagacaaaaccaccugauccaggaagugaaacuuguuugcuaguggagucccaccugugcccucuacugacaaaacuuaauuguggcagcuggcaaaggagaaaugguuucaggggccagagagaaggguagauuugaggcuaacuggcauaccuuucuaguuaauaccauaacucuuucuuuugacccuuuaaaaaucugccuucuuuauuugagucuugaacuauaccuguuuaugugcucugucccuuugcuucagaaauacagacuuuaaauguaacuugggcccuuuuuuaagguauuucauaugcauacauugcuaaucaaccucucuuugaugagagucacuuacaauagcaguuccucuaucaagaaaucauucaaaucuauuauaauacuaaaguaccuauuacuuguuuauaauauguagaauaaucuacauaaccuaguauacauaaguauguauuauauaugcauauaauagauacauagauacaggaaaaauuuguaauuacaaaugucuuacaaaagaaaaauuaugucaacugacuaaauaguuucuuacagaguaguaugauuuuuuuaaaaaaguccccaguugcuaaaauaucaacuuuuccuugauaaauuugauuuuuauuaauuuggcuaaauguguauuuuuuuccuagucuuaaaaaaauuggcacaauagcuuaugccuguaaucccaacacuuugggaggcugagguagcaggauagcuugagcccaggaguuggagaccagccugguuaacauagugagaccucaucucuacaaaaacuuuaaaaaguacucaagcaugguggcacauaccuguaacccaguuacucaggaggcugaggcaggaggauugcuugagccuaggucagggcuucagugauguauucgugccacugcacucaagccugggugacagaaugagacccugugucaaaaaaagaagagaaaaaaguaaaauuaaaaaaaauacuucaaauuguugcauaaagggaaaaguaagaacuagauuaauuacagauagagcuguucuuaucuaugcuucuuuuuuucuccagauguccuugcuccacaguauccauggcagucaaaugacaugucgaugaauauguuaccaccaaaucauaguagugacuuuuuguuggaaccuccugggcauaauaaagaaaaugaagaugauguagagauuaugucaacggacuccucaagcaguaguagugagucugauugaaaaaccuuaaaagacaauauacagaauugaauacuguagaauucuguuucuuuaacaguagcagggaaauguaaacuacaggugacaaaaaauacccagguaaacacuggcuuugguagaauugugcagucauuaaaagucaaaauuuuuugacuuucuuuuuaaagccaaagaccauaguuuuaguuuuaagccacuagguagauauuuaggggaauagucaaaauuuacuguugaaaaagcaguugcuaugugcuuucuuacccuguucuguuccaguuuugcuggauuuguacauagccauucuagaaauagaguugagggaaauuauccauauacauaucacuaauaggcuucuuggaauuauuuagaaaagcauuuuuaaacuggcaguggaugacugaauaggcaucauauuucuuuuugugugucauuuaaaaguaacaaaaacugccauuugacaguaaaggcucuuggcuucuguuggaggcaugggaaauugucucaauuuguacaguuuguaauuguaauuuuuguaaauaaauuuguuuguacauuguaugcuuuuuuuuuaguuuaaauauacugucaguguagguaggaaauuauuucuguaaauccaguugcauuuua

SEQ ID NO: 17662 - RNA, 18614 nt, Homo sapiens
uaaaaugcaacuggauuuacagaaauaauuuccuaccuacacugacaguauauuuaaacuaaaaaaaaagcauacaauguacaaacaaauuuauuuacaaaaauuacaauuacaaacuguacaaauugagacaauuucccaugccuccaacagaagccaagagccuuuacugucaaauggcaguuuuuguuacuuuuaaaugacacacaaaaagaaauaugaugccuauucagucauccacugccaguuuaaaaaugcuuuucuaaauaauuccaagaagccuauuagugauauguauauggauaauuucccucaacucuauuucuagaauggcuauguacaaauccagcaaaacuggaacagaacaggguaagaaagcacauagcaacugcuuuuucaacaguaaauuuugacuauuccccuaaauaucuaccuaguggcuuaaaacuaaaacuauggucuuuggcuuuaaaaagaaagucaaaaaauuuugacuuuuaaugacugcacaauucuaccaaagccaguguuuaccuggguauuuuuugucaccuguaguuuacauuucccugcuacuguuaaagaaacagaauucuacaguauucaauucuguauauugucuuuuaagguuuuucaaucagacucacuacuacugcuugaggaguccguugacauaaucucuacaucaucuucauuuucuuuauuaugcccaggagguuccaacaaaaagucacuacuaugauuuggugguaacauauucaucgacaugucauuugacugccauggauacuguggagcaaggacaucuggagaaaaaaagaagcauagauaagaacagcucuaucuguaauuaaucuaguucuuacuuuucccuuuaugcaacaauuugaaguauuuuuuuuaauuuuacuuuuuucucuucuuuuuuugacacagggucucauucugucacccaggcuugagugcaguggcacgaauacaucacugaagcccugaccuaggcucaagcaauccuccugccucagccuccugaguaacuggguuacagguaugugccaccaugcuugaguacuuuuuaaaguuuuuguagagaugaggucucacuauguuaaccaggcuggucuccaacuccugggcucaagcuauccugcuaccucagccucccaaaguguugggauuacaggcauaagcuauugugccaauuuuuuuaagacuaggaaaaaaauacacauuuagccaaauuaauaaaaaucaaauuuaucaaggaaaaguugauauuuuagcaacuggggacuuuuuuaaaaaaaucauacuacucuguaagaaacuauuuagucaguugacauaauuuuucuuuuguaagacauuuguaauuacaaauuuuuccuguaucuauguaucuauuauaugcauauauaauacauacuuauguauacuagguuauguagauuauucuacauauuauaaacaaguaauagguacuuuaguauuauaauagauuugaaugauuucuugauagaggaacugcuauuguaagugacucucaucaaagagagguugauuagcaauguaugcauaugaaauaccuuaaaaaagggcccaaguuacauuuaaagucuguauuucugaagcaaagggacagagcacauaaacagguauaguucaagacucaaauaaagaaggcagauuuuuaaagggucaaaagaaagaguuaugguauuaacuagaaagguaugccaguuagccucaaaucuacccuucucucuggccccugaaaccauuucuccuuugccagcugccacaauuaaguuuugucaguagagggcacaggugggacuccacuagcaaacaaguuucacuuccuggaucaggugguuuugucuccuuuacugcugugaugccugguuggugugcaggacauuaagugguguucaccacagcaacuuucgguggcgccucuaaaggugguuuccuagcagguuucaccagaaucccaaagggcagcuucccagcaagucucccuggaaccccaguggguaauuuccugcuugccagcucuggccucugaugccucaucuaacuucucugccauggagugggccacauuacacugcacccucuccaaugacagcaccaugauaugagaguaucggccuugggauggagcuggggaagacuguuuuuaggucugucccuuccuugguccaaaauguggcagugacuccccauaucuguuuuuccuguacuuuuaaaacaugagaaauaugaggugauauccaaggauaucacaguugaguuccccugguuguacuuuagguagcuaacaaaaaugaugcauacaaagcauuauuaaugacacagggacagccuuaugauguaacauuaagcaaaaaauguauaggggaaaaaaggaaacaggcuaaaauauuuaaagugacugccucagaaaggguauauuuuuuuccuuuuuuaaaugccuuuuucuacuucccaaauguucuaccacaucaaaacaaaagucaccuacaaacuauaaaagaugaggaauaauauaaaacaaauauauauaaaaauagcacaaaccuaugaaaaacuugaggaaaacugaagcucagaaugaacugggucucacagaaauacuauuuuauaaaguuauaaaaguuuauaaaaagcuauuguuauucauuuuguuaacuuggggguuguucaggaguguguucacuuuauuccguaaacuaucuuacucuauuuacauagcauguuucacaauuauaaaaaagcuauguuuagagcaauaauuuaaaaagagaggccaaaugccugaggaagacaguguaauauuuacaaauaagagaaaggcagcuuguucuaauuucauaccucccucaaggagaaucuuuagagcagaauaaaccggcaaagaaucuagcuauuacaaugaacugggucugagaggcaggcacacuggcucacaccuguaauuccaguacuuugggaggcugaggcaggugauugcuuggggucaggaguucgagaccagccuggccaacagagcgaaaccccauauccacuaaaaauacaaaaauuagccaggccugguggcacacaccuguaaucccagcuacucgggaggcugaggcacaagaaucacuugaaccugggagccaagauuucgccaacacgcuccagccugggugacauaacaagacugucucaaauuuacaaaaaaaaaaaaauugugucgggaaucucaaacuugcuuuaccgccagauauuccaaccuugucaucucuggaaaacccugaucuguuugaaaacacucuucggcuuaacauuaccuggcaaucuuccugcugcaagugcaucuccugguaaauggccauucacgccauuaguggaaggauuguucaucugacccaguaacccacuucucaucucuaaaucaguuggguagggucuccggggguccccuaaaacaauaaagacugcauuuaauucaaucauauuuuaaaaaauaaguguuaauauguuauuugacauacucauuuucgcugguucaugcugaaaaguucaggcuacauuuucaauuuugaaauacagaagucaucuggccaggugcaguggcucacgccuguaaucccagcacuuuaggaggacgagguggguggaucaccucaagucagaaguucaagaccagccuggccagcauggugaaaccccgucucuacuaaaaauaagaaaauuagucaggcgugguggcacgcaccuauaaucccagcuacucgggaggcugaggcaggagaaucgcuugaacccgggaggcagagguugcagugagcugagauugcaccacugcacuccagccugggccacagagcaagacccugucucaaaaaaaaaaaaaaaaaaaaaagaaagaaagaaauauaaaagucaccuuauaaauuguuauuaauagcauauuacuuuuuaaaauacacgcauuuuaauuucuuuucugaaucuucccaagaauauacuauuuucuacacuuuaaaaaaaaagagaugucauuuuuuuguagacauuccagaugacaacuuaagaaaauuauaauaaucucaauuauucaaacuuaacuguauuuucuagcaagaaaaugacaaugauuaugcugcaagggagaaaaaaaucaugacacuuauaagacagaaaggacuggaauguuuaauagaaggacugucucaauuuaaaaucuuuuuuuuuuuuuacauuuuucaucuuuuuguuuuacuuuuauuuuccucaugccaccuugucuaagauaaaaccuuuuucuaaccaaccucuuugaucuuguaauucagaaacuaauucguguaaguggcaaaauagcaggagcagguaauguccaucccaaacaugaaagcacacuaaauagcaguaugugguugacaaaaacuugaccagauuuggauugacuuuuugggcacaucucaccaacugcagcuuauccauccccaaaauuauagucacccuuagugcuuucagcaugguaacacagcaccuucagaaguuauuuugaaguggagauaacuacuaauauuuccccuuccuccaauaaggcugcuaccuuacgucuccuguuuuauguuucauccacugucaauauaguugcagcuugauccucucuuuugcugucuaauuaucccagcucuuuccaagccuguauguucacuguugggugcguagugcuuugucuuuagcaucuaagagaacuggaauugucuuucucaggcuggaaccuuuguggaaauccuaauggcucuaaagaguuugcuucuggccagcccugauaaaaugguauauaaauccaaagcuuuagaagcaucacauuauuaucucguacuuuaaaaaauuaucaauuuauuauuucaaaagacgaaagaaacacagucccuagcaacaauggcuucacagaaaaccaaauuuauaaaacccauggccuauaucauuacuuauaaaccauuaaagaugugaaaauauguggcagagguuucuaaggauaaauacauuuuaaauuaaaucuaugucuguacauagucaccuaagaaucuucaaaaccacauauaucuaguauaauaagacgaguauguuuaccuggaacccaggucaguggagcacauacagcauuacuugcacugauccuaugugcauacuuaauuauuucuucagaggagauagcaccugaaagaguuuuaagaggacaguauaaccuguagucuaacaaacauacaaguuuagaaauguaucuaucaguuacacaucguauuuaauuuuaaauuaucugaaaauaaaauaaucucagucaccugccuuccuuaacaauaccuacauguuuaguauaaacuuaaaucuccaaaaacaggacacuaauccagaaaaauuagcugacauaaacaaauuucggagauuagcaccauagcacucaauaaucucaauuauuaacuaccguuaaauaccauuccucuucugaaagcauagugagcacaaauaaaauagagaaaacaguguuucauuucucaaagacauccaagcuaugaaaucagagcagacaguucacaccacucuguucgaucaauaugcccuaaggcucuuaaguagaccuaaauagaaagaugucuacaauguauucauuagguaaaaaaaaaaacuaaacugcuaaauaauauguacgguaugacccgacuguucaaaauguauguacauauguguauuuguauuuuuauuacauacauacucacagaucuagaaaaaaaaaaucuaggacauauaccaaacauuaauaguuaccucugagaagugagaaccacacacuucauuuuacaaacuuuagauacuguuucaauguaacaaaguguauguguguacaguuuuugaagauuaaaaacagaaucaaacaacggucuagaagucaacagccagccucagccaucucuccuagagauuuguuucuugcuacagaagccuaaccuaacucucaaaagaauauuagcuauuuggcugggcgcaguggcucaugccuguaaucccagcacuuugggaggccgaggugggcagaucacgaggucaggagaucaagaccauccuggcuaacacagugaaaccccgucucuacuaaaaauacaaaaaauuagccgggugugguggcgggcgccuguagucccagcuacucgggaggcugaggcaggagaguggcgugaacccgggaggcggagcuugcagugcgccgagaucgcgccacugcacuccagccugggcgacagagcgagacuccgucucaaaaaaaaaaaaaaggaguauuagcuauuuaacagaagccuuugaaaaagggacagcagggcaggaaggcaugugggccucugcaccaccaaaugugcuuauaugccaaggguauaacuggcucugacuucauguacgucuggcucugacuucaugauguuucagucccagcgcaguugcccaauggaugucuuuucacucucucuguccuaaccuucaagauuugguacaaaucccacuucuaacccauacuucucuuucccucucccaccaauuuuauaaacucacuguuuuuacugcacauuugggcacacagccauaaacugccuuguauuaauugcuuuuuauaaucugaaaaaagaugugauacuucuaccucccucacaaaacccagcacaaugcuagaacacaacacacuuuacaauaaaaauuuacugaaucuuuucaacagcagcaaaugauuaucaguaauauccucuuguauugguuuccugaaaccagaaccuuaacuuuucaggucauucagucuucccaugauacuaaccuuuucuugcuuuuucuauugacuugaguuucuccuucgcuugguaaacagcuguugccuaauuuaaacaacauuuaaaaaacgugguuuauucuucaacuauaucaaacuuaguuuuuggcuuaauucacaagauccuuuagccuacaagaacaaucuuugaaacuuggaaaucccaacaauuuauuuguaauguucugaaauaccacuugacauuauuuauuucagucauauuuaaugaaagaaauauuauauuuaugaacuagucucccauucacaaauuaguuguagaaacaaaacauaaauuggauugucuuuuucuucacgucuucuaccauaaacaugcagaagacacccagacuauggacgaccccaaaagcauccuauucuugcaacuaguucaagaauaaaauacccuuuuuuccccuaguuuggaagauacaaccuugaauucauauucuuauucguuuauauaucagcucaauguuuaaugacuuuaucacaaaaacacucccuccaagcccucagguacacuaaaggacaaaaugaaguuaaccuaguauaugcauaucuucgacuaugacacugugguuaagaguauggagucaggccaggcacaauggcucacaccuguaaucccagcauuuugggaggccgaggcaggcagaucauuugagaucaggagucugagaccagccugaccaacacgguaaaaacccaucucuacuaaaaauacaaaaaauuuauaugggcauggugacacacgccuaucucagcuacuugggaggcugaggcaggagaaucgcuugaacccaggaggcagagguugcagugagccaagacugugccaucgcacucuggccugggcaauagagcaagagcaagacucugucucaaaaaaaaaaaaaaaaaaaaaaaaagaguauggagucagagagaucaagguuuaaauucaaucuacuuuuuagccuccaugggcaaguuaguuauuaaaguauugguuucuuccucuaaaugacgacacugacuugauauaaacuguuaggaagauggaaguaaugcauauaaaaugcaaggcacagggccuggugccuaagugcucaaucaauguuaguuacuacuauuuaagucaugaaauucaguuuuaugguccuguguucacugucuuuaauuauuuauaacacaaagugggaaaaucaaacaaaguggauacaauuauaugaaaaaugcuuaaguuucaauaaacaguaauugaaagucuguuaguauccugcuaacuacaauuaccuaaaaaauuaauacaccugagacucaaaggaaauagaccaaacuaugaauaguggcauucuuuccgcagcugaacuaaagacaauuuuuucccucuucuuuccauuuuucuguauuuucugaauuuuguuugauaagcaaguauuacauacauaaggauuuuuauauacauauuuacagauuuuaauauauauauaauauauacaaacauauaaauaauauauuuugagacagagucucccucugucgcccaggcuggagugcaguggggugaucccaguucauugcaaccucugccucccggguucaagagauucuccugccucagccucccaaguaccugagauuacaggcgugaaucaccaugcccagcuaaauuuuuuuguauuuuuaguagagauggauuucaccauguugacuaggcuagucuuguacucccgaccucaggugaucugcccacuuuggcuucccaaagugcugggauuacaagugugagccacugugcccagcuaauuuuuuuuuuuuuuuuuuuuuuugagagucuugcacuguugccugggcuggaauacaauagcgcaaucucagcucacugcaaccuaugccucccagguucacgcgauucuccugccucagucuccugaguagcuggaauuacaggcacacaccaccacaccuggcuaauuuuuuguauuuguaauagagacaggguuucacuauguuggccagacuggucucgaacugagacuggucucaaucacagacugaccucgcgauccaccugcguuggccucccaaagcccugggauuacaggcauuagccaccaugcccggccugauuuuaauauauuuuuaaaaacuauuuacuagugaguuguuuccuuaguagaggugauuaauuuacccugaacugcccaggcuucuaguuacuggagcucauuuuaauacauuuguuaagagauuaaucagugguaaggaugccagcaaugucuggucgacaugagaaucaagcucagcuauuucugcaauacuaucauguuauauuaguuaguauuuagugaaguaacugggcaaauaauagcaaauaaguugccucuuugaaauaguagccaagaacagcaaagggaaaacuaggauccuugaucuauguccaaauccuaccuagaugaggaugaaugacuaaauuaaugucaauuuuaaucaauuuauaaaauguguauauauuuuuauugauuucaaaauauauaaaaaaugaaaaauuucccugauuuuuaugcuaaggaucagagaccaaaaaaaaaaaaagagagauuuagacuacugauaauuaaaauuuauaucagaccaggauaaaaguaaaacuuuccauuucuauaauucaauacuguaaaaucuuuaagcaucgaaaauguggcucacaaguaaugcagacuauuugaaaacaguaaguaaaaaagagaaugacaauagccuuucauuuaaccacuggcaauggugagugacaagauaucaccuuuagacuuggaaagucuaguuuucugcucuucaaaauauugauaacagauuuuucagaaacagauuaaacaacauccuuuuuaaccuuaagaaccaaccucugucaacuuaccaguauuuguucugcuuccuuuagcuguuuuuguagcugcugaauaucacugucucucuucucuacuucuuuuucuaaaacuugcauuucaugaugaauuuuucccugauuaagugccaauuucauuaguucuugaaauuccccaucucggugaauuaacaacuccaggaccugucagauaacagucaauuaaaucagacaauagacuacugaaaggcugcauuccaaugaaacaaagaauccguaacugaauuggcuaggcuauaaauuucaacaccuucaaaauuuuauuccuaauucuuguuaagaauaaaaagagccuaccuaugauuauuuugggaaacauuaauaucaaacuuuucuacuuuuucagauauucuuucauacaaaacaaaauaaaacuagccuuucagaacuagcaauauggcaacaugagcaaguuuagugauuuccuagggaagacacgauuuuaaaguuuauccuuauggcugggcacagugacucaugccuguaaucccagaacuuugggaggcugaugcgggcagaucacuugaggucacgaguucuagacuggccuggccaacauggugaaaccccaucucuacuaaaaauacaaaaauuaguugggugugguggcgccuaaaaucccaguuacucagcaggcugaggcaggagaauugcaugagccugggagguggagguugcagugagccaagaucacgccacugcacucuagccugggugacagaguaagacacugucucaaaaaaaaaaaaaaguuuauccuuaaaaauacaauauaggccaggcgcgguggcucacgccuguaauccuagcacuuugggaggccgaggcaggcgaaucaccagaggucaaaaguucgagaccagccugaccaacauggagaaaccccaucucuacugaaaauacaaaauuagcugggcgugguggugcaugccuauaaucccagguacucaggaggcugaggaaggagaaucgcuugaacccggaggcagaggcugcggugagcugagaucgcgccauugcacuccagccggggcaacaagagcgaaacuccaucgcaaauauauauauguauauauaaauaaugaaaguucucccaaaauuugguauuugagaugauuuuagguggcaccaagaacuuaagaaaacuuuuacacuuacacauuugugcuaauauauauuagaaaaaacugagacacugaaacucugaguuuaugcacaguauuguuuacaaugaagaugaucuuaaaaauacggugauuucggccaggcgcaguggcucaugccuguaaucccagcacuuugggaggccgagguaggcggaucacaaggucaggaguuugagaccagccuaaccaacauggugaaacuucgucucuacuaaaaauauaaaaauuagccgggggugguggcacaugccuguaaucccagcuacucaggaggcugaggcagaagaauugcuugaacccaggaggcggagguugcugugaacccagaucacgccacugcacuccagccugggugacagagcaagacuucgucucaggaaaaaaaaaaaaauacagugauuucauaaaacaguaaacaaacaagugguaugcagauacggcaaaaaccaugaaggcuaaaacacauaaaauagaaagucuggugguucauaucucuaguccuccaucugcuagcugugugacacagggaaaguuaccagccucucugagccuguguucuuaauaggaaaaggaauauaauauuaauaguagccauuacaugaagcuauugugaggauucaugauauauugcacuuuaaguacauacaggaagaguucagcaaaggcuaguuauuacgaucacuaccccaguacagaauuaagaugcaagucuagucuaaauauccuuuacugugcuaaguagagaauacuacuucagaaagaaaauaucuaucaaaauucagaaucaauuuuaaaacuauuuaaaaagauuuguugaagacuaaaaaguacagguaugccucuucaagauccuuuugacaugaaguucuucucauuuuauaggaauucuucuaauacaauagacaaaagacugagcuacaaacugccaaauauuaagaguauuuuaaauaacaacagaaagcuuuuucuguaaaaaguaaaguauauucuauuuauuuaacagacuucuaauccucauuccucccacaucguaggagaaagcuagguuuccauuucuauaaaagcuguauuauuaaagcaaguaguacacaguaguucccugacaacuuucaagaaguuuacacagguugaauuaauuuguauacuacccaugaguaaaaaauauucucuuuagaucuuauuguucaguagaaaaaaauuauucaacuaaagucagaagaccuagguucugguuccacucaccauuaaccucuaccucauccguccacccuggagcuuauucucacaggagguugaacugaacaucguuaagauccuuucuaauucuaaaauucuauauaaaauuauaaauauccaaauaaaaugguggcuagaaaauuuucaaaugggcacaucccucucuaauaguaacaguuucaaugaaaauuacauaggaauccacaguacuaagacacaauucacaaauugcuacucuuuaaaaagugcaagaaagaucagugcugauuauaggucuuaauuaucaccuucugaauaaucugugugccuggcucauagcaagcauuuaauaagugucuaucaaauaaagucaagccuugcauuuuacuucuugcauacuuuguauaaauuccuauuuaaucccacggguauuaacagaguaccugagagacuaguagucuucuauuaacauauuuaucucuagccucuuucuuuuuugaaaaaaaacaaaacaaaaaccuuacuaccccuaagguuagcuguuucuccuagcuuguggccucaucuggauccccuccuccccuuuugaggcucacugacacuuuucuauugaguccgucagauuucccugcccucaaaacguaagacagaacuaagguaaugaugcagacaaaagauuuauuacugucuccucuucuccuuuacaucaucuuuagaaagguuaauccucuccauucauuuucucuuaaacauuuuuuuuggccagcuaugguggcucaugccuauagucccagcacuuugguaggccaagguggggaggaucccuugaggacaggaguucaagacaguucaagacugaccugggcuacacagugagacuaugucucuaccaaaaaaaaaaauuucuuuuaaauuagcaaggcauuauagcgcaugccuauagucccagauacuggugaggauaagugggagaucgcuucaguccagcagguugaggcugcagugagcagucaucaugccacugcacucuagccugggcuacagagcgagaacuugucucaaaaaagaaaaaacugugccaaaaacauaauauaaaauuuauccucuuaccucuaaaaaaauucugaaucaggaaaaaaagucuguucacccaccauggaaaauuagaaagcaccgaaaagugagcaaauaaaaacugcccguacuuucaccccuauaaggcaaugucuaauaagaguuguaugcucuuuuauuucccugcauguucaaguugcauuagggaacuauacuuacaauacacgguaaguuuuugagcauuaacuuuugauucuaaauauuguuguaaucuccauacaacaagccuuucuugguuaauucaaaggacaaaaauaaauaaacauguaagugugacuagaauuguaagagaaaauaacaaaauacugcuaaacccucaggcaacuauucuucuuaagcgcacuguuaucuuaaguaaaugauacaaagaaaauaccaauauuaaaguuuuaauuaauaacuuaaaaggauccaacauuccuguucccacacaaaguaaauauaaagaggaaacuugcagaaaucaaguuuuuuucuuuuaauuaaaaaacaaagagaaauuaacuaauuuaaaaagaagccacuuaccugguuuuccucuccagccuguaacaacuuuugguuucuugaaauugccagcauuucuauaaguucccuaaaaaaaaaaaaccaacaacaacaaaaacccuuucacagcauacugaacacucagggcuacucccuacaguccgcuauugacugugaacuacagcucaccaagacucgcuugugccgguuaccaaacuuauuuauaaaaguucuacuuaauacuaucauuauauaaauagcuaucaccuaaaugccaaugaaagacuauugugaauagagagaguucuuucuauaaaaaccuaagccuaaugcuuggaaagacucuacagaggcuugcaaaggacagcuauaaagaaaggaccagggaaaagucauaaaaacuaagggucugcccuaagacugcuugauaagaggauaaguucucauuuugauuugaucuagaaaucaaacuacaaauugcagacaaugcauuaugagcgauuuaugcaagaaaaacucauacaucaggggucuacaggccaaauccagcacuucugcaguuuuuguaaauaacauuuuccuaagacagucugcccauuaauauacaaauugucuauggcaguuuucccuaaauacagaggcagaguugaguuguuacagcagagacuauauggcccauaaacccaaaaguauuuauuaucuggccuuugcagaaaaaguuuucugacuccugucuuacauaacaugauuagugaaugaacauauguuuauauauuuuaagguaaaauaaaacaauuaagggaugcauggaccauuuuuuaaugauucuccacuuuauuugaauuuuuuaaauuaaacaucaacuaagagggauccuuacacauaauaaaaugauauccuuuuagaaugcucauuuaauaaauaugacaauuucccuguaugaaaauuaguaucugaugagcaaaauaagauugggaaaaauguauagcagguaauguuuauauauuaguuucaaacuuguugauagaugggacuuuugagaaauuaugcagaaggggcagcuucacaacuagcuaccugacacugcucugaucagccugagcauuuguacuuucucacuggcuaccaggcuauuuuuaccuucaaauuuccaccuuccuuccagcuagcaucauaucauuuuucuggaucaugucaauuagacccaacccuucccacuacuacuuccccauaccauuauuuaugaauuaaucaaugaaugaaaaaaguagauauaagaaugcaaagucuucauuuauucacuaauucaucaaauauuuauugagugccuaucaugugccaggcacuuucuagauacuugggguaucaaagugaacaauggcacuuaaauucuaauacaagagacaagaagaacuaagagaagaaauaaaccuagagugauaaggguugggaaggaaauaaagcaauguuuuauuagagacuacugggggaguggguuggcuacuucaauaggguggucagagaaggucuuccuaagggcacagcuuugacauaagacacggauuaaaugagagaagucagccaagaugucuggaaggaaagagcacaguagaagacacagacaguucagugccccaaagauggagcugaggagguguagccagggccuggcacaauggggagaggaaagcaaagugaggauguagcagccagguggcuaggggugagauuacguagggccuuauaguuaugguaaagauuaguguuucauucuuuuuuuauuuuuuauuuuuugagauggaguuuugcucuuguugcccaggcuggagugcaauggcgcgaucucggcucaccccaaccuccaccucccggguucaaagaauucuccugccucagccucccuagcagcugggauuacaggcaugugccaccacgcccggcuaauuuuguauuuuuuuuuuaguacagaugggguuucucccuguuggucaggcuggucucgaaaucccgaccacaggugauccgccggccucggccucccaaagugcugggauuacaggcaugagccacugcgcccggccuaguguuucauucuaaaugcaaugagaagccacuggguuauuuuaaacagggaaauggcaugaccugauuuauacuuuuaaaaacuguugagugaucugguaaauagacuguaagagggccagaacaggaaguaaguuaggugguuucuguaguguuccaggcaaaaaaugacacugguuuugacgagguuauagccuccaggacuuaguaaucgugaugggagaaacauggacagauuucagauaucuuuuggagguagagcuaacaggacuugcugauggaucaacagcguaugaaaacagcauguuaaguaaacuuuuuaguguacgccacaagugagacauagacgguugagaaccucuggucuaaguaaaagcugguuucagguggggcaggaguggugcugacuagaguggggcuaugguaggagaugugggauaagccuuccucuguucuugcaaaucugggagcgugaguccacagaaggcuuuacaaggcuugccuuaggcgccggaguagaggggagguagaagucucuaagacuuagucauguucuguaacaguccaggacaaaauagaaaccccuguccuccccaacugcgaaaaagaggccaaaggaagcccccacacucaagagcccuguccugcuaaaaagaaggugcauucccagcauacugcauuagaauccagacacaauuccccauagaaauaaaauuuccauagcgguuagagccuacauuauuagcaguaauacacuuuucagguaaacagaauuaacaggcugguguggaaaacucaagauuccuaucaacaugguucuguggaacaaugaguuuugaguuacaaauggguuaaaaaaaacguuuagccuacaaccuguguuucaacuuuuuaagacuaucuccuugcauuacauuuuauaaacuaauaaauaucccgaaaggcuauauaaucagguuaauagaaaaaaaaagauccuaaguuauaaauccacuauuuuuaaagaggcuaaaucuaaaaauauguaagguauauucgugauuuuucuucucauuuucauaaaugcaagccagacacaaauuacauucagagacugacaaacuucacagaucacagaaucaguacacauaacuaccucugagugaacacaugagaccuuucuggaagccagucacaccaccagagcagcuucauucugugaagaaguuccaaugauccgcccgccuuggccucccaaagugcucggauuauaggcgugagccaccacacccggcccuaauacaguuuauuuuaaacaguggaucaaacacauaagccauuuaauuucugcugucuagguguuuucggguuuucuuccaucauuaaauauugugcugaccugguaacuugguagcaauacgauggcaaggacuaaauuuacaccaaaaauaaagugcugauuauaucacguauauuuuaaaauacaacagguaagauuuauucuaaagcugucaaagaauguuggcuauagaaaaagugacauuugagcuggauucugaaggauauaugaaucauucaccaaaucgggaguagacugggaauggcacugaagauguggaagucugacuaaagaauuugaacuuuaccucacuggacaacgcaaaccuaccaaugagguagcuuuuauauaauuuuucugcagaaaagugauauaagaugccuuuuaaaacugguaucggccaauauaaaaggauaaagugcagaagcaugaggcaauuaaaacuguuugggaggcuacauuuaagaaggaguuaugaacagcgggguuggaacgagagggcaaauuggagcgacacuuuaggagguagaaccaagauaauuuaccauccaagucaaugggagggagucaaggaaggcuucaacuugaaagacuuaucaugaaaggugacagaauaugaagaacgacaucuaauuucaucuccuaucucugacacacaaccauccuaaacaacuugcaacuccaccaagccaggcuuuuugcacuugcuguuccaucuaucugugcugccuagugaguuuggcgagcucaugcuucccaagcagcacuuucuucagagggccugcccugacuacaaccaaaaaaggugccuagucccugugcuccaguaccccgcagcgcagcccucuaauaaaaacaggccccaagccaguuuacacaucugucucucucucgacagcuggcauccagucuacccuucacuaccgucuccccaaugcugagcccccaaggagcguuccauaaauguuaaguggcuggccgcggacgaagaggcucagaccgcgcgaguucuuaucauuacuaaaauucccucuaacgggaaaaaccgccgcccagagugccagagggcugcggaccccacguccaugacccucaugcacccgaaacucccgagcuggcccuccccgccgaaccccgagaacgagcacaaacgcagggccggccggcuccggggucagucccccggcccagcuccagcccggcucucaggcucgccgcauuaccuagacaggaccuccaaguccucaagcgcagacagcagccgcucucgugugcuguuaccacccgccacucccaaaccgccucccagccgcuccuucuccuucucaccacucgaagacgcagccauuuuccccagagucccgccaccggcgcacgcgcagagcgagc

SEQ ID NO: 17663 - RNA, 24801 nt, Homo sapiens
uuuaaaauacuaaauaaaaaugacuaacaauuccacguaggccguauuaggcugcagaugagcuguugguagggauccguugaccaguaaauuaaguggauuaaaacccuaggcuuucaugcaggauugaucguagugggauguauuaggaagaaaggaagaggcuaaguuuuaauuucuuauauauaauuaggaugauggcagugggaauucaaaaagaagguaacuuugaggcaucucaaauguagauuaggcaagacaggcaugagucugaaaaagagaggcaaugaaaagaggaaugguuugaaggugagaugcagaagcuuaauuuuaggugugguaaguuuuaauagcuggugacaugucuugguagaagaguccagcaagaaaugucauuauggguacuaaugcuugagaaagauugguuauagagaugcagauuuagauuauuucacccagaaaauguaguugaaauuuagggaaugagguuuagggaaagagugugaagaaaaaagaaaagggaggugggaggagacagagugaaagggaagaagccagauccugaguuuucacugagaagaggauuugaacaacacagugguggucaacagcaguuauuggaacuguagauuguugguuuugggaacaccugucuagguuguuaagagccaguggaauaggacauccuggaaaugaagaaacaucaaaauccaaggaaucugagagaaugggaacaaaaaaacacauguagagauuuauggaaaacuugagacacaggggaagaaggauaaaaauagaacucagauuucuggagguggaugacauuuaacuuuaauaaguaaagggcccugucucuacaaaaaauuaaaaaaaaaaauauuccagugugguacgcaccuguaguccuagcugcucaggaggcugagguaggagaacacuugaagcuuggaguucuagguuacacugagucaugauuaugcaacuguacuacaaccugggccacacagccaagaccccaucuccaaaaaauaaaaaauaaagggaagaacaguaagguuugaccuuuaggggaauggauguauuaugcacugagagacccuuucuucuccaaagaauguugauguucacuaacauuugggaaaaauuguguaacucccacuggcacugugaaauuguuuuucuguuuuuguuguuguuguuguuguuguuguuuuuuggaggggaaggaggaaggguguuguuugguuuuuugguauuccacccuacucugucacccuauuucucccacaaaaucuguucuagaaccuaaauauauauuuguucuagagccuaaaugaaaucuaccagauaagugacaugauauauacuauguaaguuuccauauauauuuuucuuacugaauaucagucacuucaucguucauaagcccacuuuucuuauacauccuuucuagucacccuaguaguaguccuucaguccucaucucuucccuucuuucuccccauguuacaaguucgacuuacaacugagccagauagauccaucuuccucuacuuaccuaguccccacucuuauuuucuucacucaggaguugacuacaucucaugcuucgaaauuacacuugaaaacuuuguuuauugauuuaaaaagauaaaaaacuuucauaguacuuuuacuucagcagaugguuuugaccaaguaccaacaagcuuuauggcaaaauagguauuaagguggccuguggcaaauaauuagauuaugggcaauuaagguaauuaaguggugaugugguaucccaucaggguguacagucauuuaccucaaaagaagaaaacaucucuauugagaaugcauaugcauauaaaagcucuguauaaccuuugcugugaaaaguauaucccauuuguaaaccauugguguuuuuuucagaaucgccuaccauuuggugcaagcaaaaagcaaucagcaauuggacagguaaacuuguuuuauuguuuauauguuacucugaacauugaaugaaaauaccacuaauagcuuguuuuaaaacgugcuauuuuucacauagaaaaauucuauugaaaaauauaaccaccuauuauaauguaucagauaucauaguauaucacaguaugucauaucuaguucuuaguuuaugucauauuucuuguuaagccuaacauauuuuuuugauuuguaauuaaagauaguuucuaaaaugguggguagaaaaaauacuuuaaaagcuuuguuuuuuaaaaaauauucuaccaacuuuuaaaaaguguuuuaaucuuguuucuucuggccaaaugaaaagcauuugauuuugaauuuuaagagcagagaaaacugacaacuugagguuuauuaaaauagacgaauagcaaagauacagacuccuauguaccagauacgugcucaguguaccaucuuuugcaaaguggauauaguccuuucuaaguuuaagaaaaucugguuuccuuguggaauaauggagcaaauaaauuuuauuuguuggucucauauauauguauuaauauauuaaaauuaguaucucucucuauaaguucauuauuuaagauaggauuguuaacaguagcuaaaguuaauauucaguaacuaauaacaucucaugggaguuuauuguuuaagaauuaaucuuuuauagauuaaaagcauaaaacugagcagaugguaauuucuuuguguacaguuguaauaucauaauucuauagaaucaguuaucuuaaagugucuuaaaaaaugaguauuuaaagaaccucuagagagucaggacagcauagcaguuaagaguagggcuucugaugucagacuucuggguucaaaucccagucuuccaaaauaaaacuauuuggguuuauugaagaaauuagagauaagauugaaacuaauuuuuuaaaguauuuuauaaagacauuuccaaaauuagcuuuuuaagauuauuguuauacaucuuugaaagaguaauccuaaagcuccagcugauuagcauguaguagugcauuucucugagaagaucaccagggugguaauaccuguuccugauaucuaaagcuuuuucuucaauauguaggacuuacugccuuauauucuaauacaguguuucuaggaauagaaagggaaucuuucuuugagagguacaugucagaaucagugugguuucccuuugcuuaauaggcauuuaugauaaagauaguuuuccaacuuuuuuccuguauuuaucauuaaaagcaauaaaauaugucauuuuacauguaaguuuaaaauuauuuuuacaugaaaacaaaagauuuguuggacagaaaagaaguuaacaggcuuguuuuacuuauugguuuguuuuaaaaggagaaauaaauguugaucuuaaaguuucauaucacuuucucuuaaaaauucaugggaugaguaauuggaucugguuuagugucuagaaaaauguguaucacaccguaaguguucaguaauguuacauauuauuauuaccaaaaucauuaucacaucuuucuuccauuuuaaaaucaacuauaaucagucauaccaauuccuugacuacuuuguugcaguugauaggcagacuauuaacaauuuuuaaucuucuaaacuaagguaauuaauugguaacuuauguauuuucugccucuuuuaaaaauaauuuggggcaguccaccacaacgaaaaaacuuguuaauaaauuaguaaugauauaccaaaguaugaaagcuuuuaaaagugaguaacaaguguaaaugcauguaugagcguuaaucaguuucuuaauauuauuuacuggagaaaaaugugaaaaaaaaauucuaaguagaaaauaguuguauguucagauaauuuaucugaaggcaauuaguuuuguuucaaguuuuucaguaacuaauucucuggaaauuaaugagauuacucuuuacuaauaggaaaagaauggcauugaagcagauuuccagcaacaagugcuuugggggauugcagaaaguuuuugaacaugacagguaacuauuaagaagauauaauuuuagauaccucauucuguuggauuauuuuguucuauuuuaaaaccaaucuuuaucuagauauuauaguaccucauuuuacuuuuaaacuugcuuacucucuuucugugguuauguauuugacaauucuaccagacuuaauuaacuguggaugugauugugugagguagagccuuaacagagaaguaucuucaagcuuugacaugaugcucuucugaaacuuuaugaaaaugcuuauguugccaguaaaaauucugaaaacauuuucuuugaggaucucuaaguguaggaaaaacaccuggacuuuuugagaaagauggcacacuaaacacaugcauuugcuuccgcugccuccaaaacucugacuaacauggcauuaaguaaagagauuaaacacacacgcacacauacauauaccuauaaaggcauaaagaagcaggagacaggagcuaagaauaacauuuuagaagcaggaauacaaauggagagguaguaccugacuuaguaaaaccuagaaagcuacauucuaaacauaagcaagaaaaccugagaaaugacacaauuuauuuaaagccauaguaauuggaggcaccagggaccccugaaaauaaggauaaaaguugagcuuagaaaaaagauuaauugaaagucuguuuuuaaaaggagauagaucugagagugucccagcuuuauggacugccucuuccuaacucugggaaagauuggagguaaguucucuagagaaaguaaacuguuuguacuggggaauaccagacacaauuagugggauugugauacugcaaauagauuaagcaaaaguuugcacacugaguuucuuccacuagcuuucaaaauuuggggacuuagucuuauauccuuuagaagaauuucuuuguggggaguuugaguagcccaaaggaagagauuucaagauacugagauuugccaacaaaguaaccuaaccagaccuuacaguaaagcaaugauugacaacuccaccuguaggcacagugcuuucaacuagauuuuuaguguuucucucuuaaauaggaguggacagcuaaagaucacuagacauuuguauaaagucuuuaauuugauaugaacuucucuucauaucaaaguauaaaagauauugaccucuugacuucauaggaugcuauuaaaaaauauucaaguacauggccagguguggugacuuacaccuguaauacuaacacuuugggaggccaaggcaggcagaucaccugaggucaggaguucgagaccaaccuggccaacauggugaaacccugucucuacugaaaaaaaaaaaauauauauauauauauauguacaaaaauuagccaggcaugguuaugcacaccuguagucccagcuacuuaggaggcugaggcaggagaauugcuugaaccugggaggcagagguugcagugagcuaagauggcaccacugcacuccagccugggcgacaagagcgaaacucugucucaaaaaacauaaaauaaaaaaauccucaacuacaaaaaagccuagacauuuaaauuuugguaguagaaaugacaaaacucaauagaaugguuaguugaacauucuagaaaguaaaauaagauaaaagugauaaaucagaaaggacaacaaaauuagaggacuaguccaaaaauccaacauuaaaaguuaggaauuuuggaaaauagaacagaaauagagguauagauauaaauaauaaauaauucaagaauucccagaacugaaguugccagauuuaaaaaguugucuaguacaauggaugaaaauagaucuacaccaacaacauaguaaaguuuuagaguguugggaacaaagaaaauucucaaacauugagaaaaagagaaaguagauuaagaauuuuucaaagguuuaggucagcucaacgguauuacuagaacuaagaaggcagagcagcagugcuuucaggauucugaaggauaacuucuauguccaaccauauugucaauuaagugagaguagaaugaagauguuuucauauaugaaaggucucaaaguguauuucccaugcacuuuuggaagcaacugaauaauaugcuucaccaaaaugagggacuaaagcaagauagcugaaggcauaagauccaagaaaacagaucagaggagaaagaguuuccagaugaguggagcuauauuaaggcagcaacuagaaagcagcaggucaaaaguuggagaugguagccaguaauuacauguagccauuuacaucaaauuagcuaauuaauaaaacuucagucccacuagccacauuucaggugcucaguagucacaugaccagaagcuguuguacuggacaauacauagauagaacauuuuuauuaauaucacuguagaaaguucuguucggcaguacuggucugaagggguuuuuuuaauguagaugaaauugauagaacugacuguauuagagaggaaauuuaugaaaccaaucaggguugggggaguuugguauugaauuagugauacaugcagagugaccacacaaauaucugugcaugagauuguauucuuuugguaauugagcaacaucuuaaugacaugauagggacagagguuucagaagauugcuugauaauccuguuguguuuuuuuuuuuuuuuuuugcuuuuacauaaguguuaaucauaccacuguugaacauacuuuagaccugauuuauuccacaacugcuugagaaagguccucuuuuaaaaauuuuguuguaauaacaaaacaacaugaaauauacccucuuaacaaauguuuaagugugcaagaaaggucuuaaggcaccaaccauucuguaacaagauuauguucucuugauuuuacguauugauaacagauaucccugcauugaauauggauuugauauaguauuauaaugaaaguaaauguuucagcuucccuaacaaaaguugaaaaccuaaaaacaaaugucagaaauuuuuugugccgucagucaucaacaagaaaaguugcuuagaauaauguggaaaaagaaaaucaccaauaugcagagaauggaaaggagcauacagaaaacuucccaugauggggccuuugugggagucuauuccuaacaaggaaggauaaccaguaacaaaaaggagagaauuaccagcucaaugaaaacaaaaaaaacugaaagaaaaaggaaaguaaugcuaauauacuacauggcuuaucucugaauagcauuuauaacuucuuaauauugauuaaccaaaauuauaugugauacgauaguggaaggagaaauguaggggcaugcagagagcaaagacagggagcugaaaguuaacuaaaauccuucuauaaugggaagccaauagauaauaacuaaaaacugaaaaaucuagaagcaguaauaaagucauauuauguagauagggacauaaauaccagaaaaaucaacuaaaagagguaaauuaauuaucucuggaauauggaaaaugagaagguuggagaguuuuuuauauauuuaguuuuuauauauauuuaguuuuucauaacaguguguggaaguauuuacuauuuaguuacaguuuacuuuaaacuauguacuuacauaacuuugauaaaaagauagguguuuacucugaaguaguaagaguuuacuuccauuuauaugauguuuuaaauaaacccaugagagaucacuguugcaugaauuacuguuuacuggaaaaacgccugugguuuuaaucaaaauugucuuuucuaguugcauuaauagugauugugauaaaauauuagugaugaaagagcgaauuaaggauguguugcauuuuagugccuaugaacaaauauguaagaucucaagaauucauuuuuuuaugaaagaugauuugucauuucauacauuucuuuagaaacaaaaacuauuuuuuaauaaaugccacaaugaauuacauuuauuuuuucacuuauuuugcccagaaugacagugccaugcaaaguauaggcucagguugguuuagaucaguaugcuaaauugaccacauucuuucuuuaagggacaaguauauucguuaaauguuaguggaaccacuuauuuugaacauuaaauaacuuauuuuggaccuuuaguauauaucuuacuuuuuauauagugcauaauuauuuuguuucuguauugauuaaugaggggcauuaauauuuuguuguuguuuuuguuaaaacuaguguugaacuaaacugcaaaaugaaauuugcugucuacuuaccaccaaaggcagaaacaggaaagugcccugcacuguauuggcucucagguaaguauuaugcauuugaguuuuauaaagucguuucuauuuucuuuuuaacuggcuuaucuuacccuuuuauuuuaacuugguaggcuuuuugagccauuuaugaaagacuuuaaggaccugucauagucuacucuguuacuuuuauccucagaauaauuucagaccuacugaauuauauuuauuucauauauuuuucuaauagaccaaguaauuuagcagagaauguaaaguucuguacucaauagcaagggcuuagaaaacuuauuuacuuaauuuggaccuacccaagcauuucuggaguuuauagagacuuuacuaguccauuagaacaauauuaggugaaaucaggacaccaagauacucuaauuagaaaccagcuauuguaaaaagucaaauaacuuacaguguucucuaaaauauuuuaacuggacuccauagagcuucucugacaacaaucuggaaagucacaaaagaacgcuaaggcuucucuuaaucaguguuucauauuaacuacuguagaauagauugugaagaguaagauuuugacaccugcaguuuugaaaccucuaugcuaacuuuucuuucacaagacgcugguacuucaucuucagaagcaaacauaaggagagaauccuagcaacuaaauugugucacagaguacuauuuuaauuuuguuuccuucaaauugguuccuguaacuuugauuuaacaaauccucccucauguguguuucaucaaggacaagucccaaauaccagucuuugaaaaugagaauaaauauuucaucuuaaaggguaaagauuaagugcauaucugacuuuaacucaagaaaacauuucugugauugaaugaagagcacugauuuugcuagaagagcauuagguauugcuaaaagcaagagcaacaaaauuaguuauuuaauugucuuagaaaauauaauauuguauagcuaaaaaugaucuuagaaaucauguaaucccuagaaagaaaaugaggcccagugaagcuaaauauuguccagggucacacgcuaauguggaguugaacaaguuuucugacucacaguccagagcuguauuuaguuuuuucuccuguuguuuuugcguuuuguuucuggugagggguacuauagucauaucucuuggcuaaacaauaauaaccagaagcccugaggcauugugucauagguacucuaauaauagggcccuaaguuuuaacuaaaauugaaucuagcaagacauaucugagcuuuacaaguauaaaauacagaauuuuuguuuguuuacaucaaaugacaggacaguuuccuuagugagaugcugaagaacagauagaccuuggaaauuaaggcuugauuuucugaguaaagguaagauugccugaccagugcacgugagaaauggugacaaaaaaauuucagaagguuuacuucccagcaagucuaaggaaaacaaugacagaaagauuacacaauuauuauauagcuaaaauagagaaauuagcugaaaucaaaacagccaaacugaaaucuuaaaagauaguucauguguagugauuuguaucuuucccaagugaaggugaccauugaaacagcccuuuauuagcuguguacccaauagaauugaaaacauguccauacagaaacuugcacaugaauguucauggcacacuauuauaauagccaaaaaguauaaacaaaccaaaucucucucaacuggugaaaugaucaauaaaaucgauugcuaguucauuccucaccauucucacaucauuguaguauuagauaccuauaguaaaagaauuaagucaucuccucuaucaugacugaaaagcauggagcuaggaaaaauaacagaaacuucuaaaaacugaggcuaaaacucaauuuaaggauggcauauggucaccauuacucucuuuuuaguucagugaagaauacaaagaugauuaagcuaaauuuuguugcugagaacuaucuguauguaaaaaaaaguauuuguauuaugaagaccauaguauuugcuuauuuacugugaauauguuuuggugcagaaauagugcgauguuuaauuagcauauuugauaacacuucacugggguuguuuuaauauugggcuuaugcaccauauugucacucuacaguuugaaaauuucugaauucccaaacacuccugguccaaaggauuuuaguaauugaaacuuuaguagugauuuuaaaaggauaguuaugggaucacuuaaccuaacacaguucuuagguuaauacuauuacaaauuuugugaaaaagugaauuuuagugucuuacucaaaauuguuucuaaagcaaaaaaaauaauaauaccaaaugagcuuguuuuccuguauuauaaacaguuuaaagcuuauaaaccauucacaauauagcaugagauaauuuauuuuuaauaauuucaacuuuuauuuuagauuaaagggguacacgugcagguuuguuauaugagcguauugcgugacauggagguuugggguaugaaagauaccaucacccggguagugaacauaguaccuaacugguaguuuuucagcccuuguccgucuccgucucccccugcucuaauaguccccaguauuaauggugcacaucuucauguccaugugugcccaauaacaauauuuuuuaucuucagguuuaacuugcacagagcaaaauuuuauaucaaaaucugguuaucaucagucugcuucagaacauggucuuguugucauugcuccagauaccagcccucguaaguguuuguggucuagauauccuuuguaaaaaucuaaaucuuuaagacugguauaaagugguaugauauauacauuauacaauucauuuuauauuuuugcuguuaucucuauuaaccuuucaaguggcaucaugacuccaaaauaccaugcuguacauuuuccucauugaauuuuacucaugacauggccuuuaugaaagaggauaguuuugcuauucccauuguacagauuaagauacuucaaagcagagauugagcaacucaauucauauaucauguuggcacuacugucaaaauacuaauguguaaugcauaggaaauuauuuuucuauuccagagguauacugucuuguugcaugauaauuacaucuuuuuucaucucuguuaacaucaaccauacaguuaaacaaguauuaguuuuaauauaaaugauuugaauauuuacauuagagaaaugaaaauaucaacuacgugagacucaaugcaucagacaguuaaaacuuguuuuaugacucuagaaguuucaggaaauggaauuuaaauggcaguaaaacuagggaaguuauauggcuggccuggcaaguaguauauuuccuuucacaggccauauuauacaaaaacaaugcauaucugguuagaaauauaacaacagauuuaauucaaaauaauaucaaaaauauaaaauacgaaaauagauauauaaaagggaaacuaaaauuuuguuaucauaaacgaagacuuuaauaaaugggaaaaugcuguguuucuagauggauaaaaugaaucuuacgacaaggucaugucuccaaauuacucuacguguuacuguaauucuauucaaaaucccaaugguuggcuuuuuaaccacaugcaaguauauaaaauaaaauguaacaaguuaaaaagaaacauaagaaaauuccaguggagguuggauagauaggaaaaaugugauggaaagcauauuagaaaacauuuucaguucaagauaguaaguugagcacaagcaucugccuccccacuccuguguaaagagaauuuaaaaagugcugauagugagagagggucaucagggaagggaucacaacacauuucugaaagauaaaaagaggauauaaguccuuuuugacagguaaaccagaguaaggaaacauauguucagaguacauaagaaacuucaucaacaaagaaaguuaguguaucuuaccuuggcagcugaauacuccagcuuggaaggucauuuuuuaccucauuggccagaacgagucgcagggccccauucaagggcaagaggagcaggaaguauaauccuaucaugugcuccaaaaggcagagagcucacaacauuuggugaacaguucccaugcaaauggacuugcagauucaucugaaaguguguuauuaaacaugggccauuacuacagagcagaugaaaccacaagauuguuucuugauagguggcugcaauauuaaaggugaagaugagagcugggacuuuggcacuggugcuggauuuuauguugaugccacugaagauccuuggaaaaccaacuacagaauguacucuuaugucacagaggagguaauuuaauuuguauuguaauuauuaauugaugacugccaagaguuugauuuugaacacaaaguccuuacaauccugaggauuuuaaacuaggguauaaaaguuacuaguaaaaauuccaaaguuugcuaguacuauaguucuauuuacugcaauuuaaauuaacacuaaguacaauuaaagaauauaaucauuauauugagaccuguuuauacuacccagaauaaccaagaaaaugguauaugaaaaaaaccuuuaauuugccuggcagcugguucauuuggauguauuuuauagugauaagccaaggcuuaguuagaaaacauaagugguaaagcauuaccucuauuaauaauauuuguaugcugcuuaugcauuuucugaauuuuauaugauuuucauuguuacuauguauaucauaaaaacuuagaaacaauaguguaaguuuuuaauuacccauaauucuguuacccccccaaaacacuuauguuuugguauguuccagacuguuucuaugacuaguuuucacguaauucuaaacuuuuuuauuuucuucuucuuuuuaaguuacauauaaaaauauuuucuaguguuauucugauuuuaauaauuguguaauauucugucauaugccauaauugacuuuuuccucuuauagaauacuuaugguuuuguauauguuuuuacccuaauaaauauuacugcauugauuauauuugugcauaauguuuucucccuaaggacuuuuccuuagaauauauuccaaaaagugaaauuacuaggucaaaacuuaaaagcauuuuaaagguucuuucugcaucaccuuccuaaaguguuuucuaagaagucuguaccauauauuuuccagggauauauuaauaaucauggucugccugaggauuuaguuuuguuuuguuuucauuguuacuaguucaaaccauuguaagacuaugauuuggcaguauugauuguguaauuauuuucuguaacuuugaaaugucugaacuuauuuucuuugauaucuuuugucacacuauuaaauuuuuucuagcuuccccaacucauaaaugccaauuuuccaguggauccccaaaggaugucuauuuuuggccacuccaugggaggucauggagcucugaucugugcuuugaaaaauccuggaaaauacaaaguaagauuaucuaaacuucuagugauaaauauuucucuugaauaacauaauauuaggaaccuucaaagaguaaaauuacaauauuguuaguauuggaacuaaacuuuucuaguguugagaacuuugggguguuugaaggguggguauuuaauuugaccauagaguguaugcugcagaaucagacgcauaggaauucagcaagagugcuuucuuauuggccuacuggaaguauuauaaaauguagcuucuccuuuaauuguuuuuauuccaacuauaguuuugaacacacuuuuuuucuguaaagguuauuauuacugauuaauguuauaguggcaggaucuaucauuuauauucuuaccagggaugucuuuguaaaguugacuuugauuuucugagguaaaagauaugauuuguagaagcuuaagaauuguguucuuaaugccucuaaugaaaauugaaaugcagcuugauuaaaaaacaucacucucagccuuucccagagucaaauuugaauaacuaccauauguaguaugucauacugugcagaacagcauguuacaagaguugaauaaggaaguguuaaagcaacuagcaucuuaaaauuucuucugccuuuaaauuuacagggcuguucaugcccuuaaaauugguuuaauucauuuccuccucuuaggaagaacuugauuauuuuaggugugcuacugagaaaugaaaacauuucucauaacaguuucuuucuguggcaucaaauauuuuguuuuugguacgcuuuauuaucaaguuuuauuaauucauggccugacagugggcuuucuaaguaagcacuuuuauuuccauuuuuuaaggcagucuaucaugucugagguagaaaagcaaacuuaguugauuuuuuuguccuuuaaaaaagcuaguagauaccacuaaacauuuacauugaugaguacucugaaguugagagaucccaucucugcaucucauccagugaaaaagaacauuguauagaacacagaguuguauuaaaaauucugucauauugaaaugcauugcucacugcuuuguugguacuguuuaagagaaaugugucagauuuaguaacauguucacuaagguaagcaugaacuguuuuauaucacuauagauuaauuuucagugcuaaaaaagcagaaacgcugaacauagacuucuguuuguaucuuaaauugcaauguauuguuuugcauuauuuuagcaacuauacuuauuagcucucuuaauagaauacacaaaagauguauuauggaaaggccugcaaucuaagccagcaauauaucaaaaggaaaauuguucacaggguuuucauggcaagucagaauuuuuaagcaaguugcaaguaacuucuauauuuuuaaguaaguugcaaauaucuauucauauuuaauuuagcaaaauauaacuuguuuuuaaauuucuuuuguuucugaagucugugucagcauuugcuccaauuugcaacccuguacucugucccuggggcaaaaaagccuuuaguggauauuugggaacagaucaaaguaaauggaagguagguacugaauggcugucuuaauacucauucuuaaguuucaaguuuguuuaaaagguuggacauauauuauauuccuacccugcucauguuagggcucuagagcugagacaaauuagcaaaagauauauauauaucgauauauauaucaauauaugagauauauauuauuauauauauuauuuuauauauauuauuauauauauuauuuuauauauauauauauauaaaucaacaaaaaacccuacuuucuaauuguauugaaucauggcagauauucuggggcuauauuuuuuuucuacuaaugguuaauuuauauuuuuauuucuaaauuaacaucacuucuaaauuaaccaaaaaauaccacauauuacagguugagcaucccuaaucuaaaaauaccauauauuacagguugagcaucccuaaucuaaaaauucaaaaugcuacaauggguauuuccuuggagcauuaccuuuaagcgucauguggguacucaaaacguuucagauuuuggagcauuucugauuuuggauuuuuggauuagggauguucaaccuguguuacuaaauuuagacuugccucuuauuaacuaugugcucaguuguguaauagaagcaaagaagccuggcuuuuuaaauuacuuuguuuucaaaauuuagcauuucagaucucgauuuuaaauuccagacacgagucuuuaaaaauagauauucuguuauguacauuuaugugaauauucccacagcaagauugcuuuuucaagcaugcaaacaggugcuuucaaguggaaauaaaaaugacccuuuuuccugagagccauguuacucuugugcagaaaugggccauuuacaaacucugccaagaguuugaauacuuugcaaaugaacucaucaugauguguauuguuaacaagcagaaaauacuugaauggguaaaaaaugcaacuucuuugucuuaaaguauuuaaaguauaguucuguguucaggguucauuccuacaugaaccccuauuuuauguaaggaugauuauugaaauuccaacacauuuuauuuaaggaugauuacugaaauucuaacuaauuaaaggguucauccuuuaguaacuagauuacaguuuuguuuaggcuugaauuuuuacuauguuugaagaaugcuagaaaugauuuaggauuagguccuuugagaacugacauugcauguacaucaguguuuugagucuucaucuggugcaaagucuaugcuagguucugagcuguuuugucacgaaaauggugacccuuucacauccaccaggggcuuauggucuaauagaagaauuggguaaaagaccaacuaauuggagggugaaggugagagguagagguacagguaaccuaaaaaggaaucuagauauguacuuuucuccaagugacaguagauuuuacugucuuaauuauguuguauuuaggguauuauuuaauuuacgauugaaaucaggaaaccauguagaauuaugaaaucauagaauuuagaacuaacuagucagacuuuauagguccucucccacucuaagaugaaaggaaauagaaccuucaaaagcaggauacuuagaggacaaaucuuuucgugguuguuugucuuggucaauguauaaaguugugguuaaugaauauauaugaauaagaauauuucgagguggaugauaaaacauaaaauuguaacuaguggcagcuccucagagaauaaauuugagaugauguugauaugauucagaugauucacaccagguguuucugaaagcuuauguagauagcagagguuuggugcuguucaacagcaaaaaagaaggcugaauguguuuaugucuggaauuacagccauaaagaagagacauaaaaaaaaagauuaucugaaauagagaauauuuggaaaaagaucauggaguuagaagaagcuucuaguuuccaauuuguggaaggaguuacaaaggaaaaaaaaucauguucuugcuggagccaagaggagauuaagaauauuaaagguuuagaaggaaaaaggccauuuucuuaagaaucccugagauaugggauucuugccacuagucuaggacugcuugaaaguagggaagagacuauuauuagaaaauagaauuccgaagaccuuguaaauaaaagccuggcaagucagauuuugaaccaacuuaaaagcauauuucugauuuaaucagccuaagagcuuaaauaacuuuaaauuucuguuugguacuaguauaguauauccugaagaguaucuuugaauuuauuuuucaauguuacuucucuuuuuacaggcuuaugaugcuacccaccuugugaaauccuauccaggaucucagcuggacauacuaauugaucaagggaaagaugaccaguuucuuuuagauggacaguuacucccugauaacuucauagcugccuguacagaaaagaaaauccccguuguuuuucgauugcaagaggcaaguauuaggaaacuuuagcuugaucuagauaauguaacuaugaaaaauuaggauucugugauauuuucuuaacuuuauuuuagaauauaaaaugcuacuucuaguaaguuuuuaauuauauucagacacuugaagugaaaaccugccuauaaaauuaauuauaucuaacacuaaauuugauagaaauaggaaagcuuuuggcagugaaaaauauuguuuuccaucaaaccaguaaauaacaagauuuuuaaugcuugaaugaugauuaaucuucagcauuagcagauacuucuuucuuuacacauggaccuuugcugcaguagaauaaaaaggacaaacuucuaccuaaauuacuccuuauuuuauguauauauuuuagccucagaaguuaaguauuauuuaucacacaugugcuuuauauuauuugacuuucauauuaaucuauucauugugcuacuugauauuucuaguuguuuaagaauaauuacugaaucccaaugggcuugcaaguuuuuuuuaacuaaaauauuuuugaccguccacuacucaccuaacucuauauaugcuaccauaguccuaauuaaggaaguucugcuuuuauuuuuaagaaaaauucauaagcuucagaauauaauuuaaaauauuuuagagugaaaaaugagcacugaaaauuauacauggucaugauuuuuaaauaaauuuuuauccauguuuaaggauaaugugucaggcacauugaucuaaaauguaauuacgaugguaaauguucaaaucuagaucaguguguaaugugguacauuaguuuguaaaaugcuuucacagcauuaacucauuguuaauucuuauaccgccaaaugagauaucauuucuuuccuauccaucuguuuuacaaaugaggagacaggcucagagaaguaaccuacuuaucuaaggccacauagcuaguaagugguggaaccagaacuggaacuaaggccauuuaacugcaaauacugaccuccugucauuuaucaagccauuuucagacggcaugauauucuccugaggagcaaaggaauggaauuagagcuagcacaaggagaaauugugcauagcuugcugccuacguaacuuaugcagaagaucugagcagucuuccuguuuuuagggauauuuugcacaugugaacuauauagugagaaaaugucaaaaacuaauacaugauauacuguuugucucuuaguguccauccuugaguaauagaauuuuguuuuagauuuauuugaacauuuaccaucacaauuaaauuuuaggucaacaaccagccuugagaaauccaaauaccaauuugacuauaaauauaguaauacguuuaacugcaauaacuauagcuauaagugcguaccaaaccauguuuuuuccaaaugaccuuaauuucuuggcacuacccauguuggauaccucauuugcuuccccaaagacugggcccaaaauuucuguuguuucuacaaugauucugccugccaacaaagucugaaaaucucaaguuuguuauaaaaacagcacaguuagaacaugaugacauuccuggagggaaaaauaaguccacuuauuuguuucuaaaaugccuguaucccaagcaacuagaacacauaguuggcuauacuuaaugaggagucaagacaaaccauucaauucuucuaaaaaaguaagaaaguauucaaagcaccagagucacaauguugagcucaggugcaauuuucuauucacuuuacuuccagcauggucggguuaagaguggacuacauagcuugaagcggauuucguugagauucguuguaauugaaucaacaacugaaugagcaugccuaaguaguggcuccagagagucugcuuucagauuuucuugccagcuuugacccaagauuacccugggucugcgaguuuuaucaccugcuuuaucauuugauuacaaguauaguauaacuguauuuccuugugggauagaagcuguaaaaaauaagcugaaaauaauaggggauauauauaaauaaacgaucugagaaagaauaaagaaaauaauuacaaucaugcacaugauuuacucaacuucauucuuuuaccucuuuuuaaugguguuaaaugcucacaauuuauauuuauacucugucgaaugucaaaaaaaauuuuuuagagagagggguuagugcaucggggauauuuauuugguuauuauuuuauauaauuuuuucuuuuucuauuuuggcuucagggaaucuaaauugaaaaaaaaauacuagguagcagaauucugauaucuaguguacagagaucaaaucuuagucugaaaaagaagggccuaguaugucuuaucuuuaguuauuggaguuacacagugagaaaaaaaaauuuagugaccuaauacugugaagaaguuuccagaaauaguaaucucuuuuuguggaauagaaggagaggcuauacuaccuccuuaagucucaggaccuuuuugaagauugagaggcuguuuuagccucugcaucugccugcuagagaagaguaagaacauggcagagaaucccagaaauguagagcucucucauucaucucuguaucccaugcuuauuuagcauagguaucuagcacagagacucucaauacuuguuaaaugaauacagugcaaagucuuccuccuuauacacugaagagauuuaauaaccuggggauucuuauccaagcuuuucuaauugggucuggaaaauauauaagaaaacacugccuguuaggauaaacauccaucauagcugcuggagcacugcucccuuuuugagagcugagugaagaaugaaagaaugaaagguguucauuuauuuuuauacuccaggagucaagaguuuugcuaccaaggauuuuccauuuaaagugugagguagaggagaaaaguccccuucaagugucacuaaacauaggcauuugcacaagcugcuuaacauaucauaccaacucauucaucaaagaauuuaauuaaagaagccauccccauuuaauaagacugauaaauagaaacccucgucagggaugauacaauuagcucgaauuguguaacuucagcaggauaccaauuguucaaauguauucuauugccuuuuuguugacauuuuuuaaaauucuugggcccucaauggcaggcauuuucuucuuucucauauaggugaaucuuuaucauuauggaacuuauggucauuuguuuuggauuuuagaugucuugucuugcaauauauuccuggguuuaccuugggacuucucuaauaauaaugauggcuauucauaugugucugauggcucuuaacacacaagaaacuaaggauaaaaauauggcauacucagucacauuggaacuuggucacacaagucuuuugagauaucuguuucccugcaucuguacccauuuucuaucagauccaucuuuugaucugugaaaaauggcagauaauacuugguacauuuuacagguuugguggccuaaaacuccaggccuguuuaacuucuuaacaauucaagaauuauauggauggaaaauguuuuucuuuacauuucuuucuuuauauaggaaacuguaauuuagcucuaaauucaacuagccagcugggacuagucuaaucauugagagacaugacaccaaguaauuccgaggcucagcuuuaaucuugacaacauuccugucacauucacuuccaugauagaagacagauugcuuuagaagacuuaaguuaccuugaccuuaaacuagaacuuuuuauuaacagcuguucccaagauaaacauuuaauaccucucuggaagggagagauugagaacauuuacugauucaucaaaaccuuggggauuuccuuguucucugaagcgucagugauauuuuuauuagcucuauuuuuauuucuuaggugcuuagaaaaauucccaucuuuucccaucagugaccauucacuaguucaaaaugggaaaaacaaaaucuuuguuagacuuucauuucuuucgguuuauucaaccuuguauuuuaauuguagauagggauaaauuaucugguguuugauacccuuagaaaguucuucccaccuggaguguaaauuaguuuaaccauuguagaagauaguguggugauuccgcagaccuagaggcagaaaugccauuugacccagcaauccuauuacuagguguauacccaaaggaauauaaaucauucuguuauaaagauacaagcacacauauguucacuacaguacuauucaauacuauucaauagcaaagacauggaaucaacccaaguacccaucggugauagacuaaauaaagaaaaugugguacauaugcaccauggaauacuguacagccauaaaaaggaaugagaucauguccuuugcagggacauggauggaguuggaagccauuauccucaacaaacuaaugcaggaauagaaaaccaaacaccaggccaggcgcaguggcucacgccuguaaucccagcacuuugggaggcuaagguggacggaucacaaggucaggagaucgagaccauccuggcuaacauggcgaaaccccgucucuacuaaaaauacaaaaaauuagcugggcaugguggcaugcaccuguagucccagcuagucgggaggcugaggcaggagaaucgcuugaacccgggauguggagguugcagugagccaagaucaugcacuccagcaugggugacagagugagacuccgucucaaaaaaaaaaaagaccaaacaccacaugcucucacuuauaagcaggagcugaauggugagaacacauggauauauggaggggaacaacccacacuggggccugccaaagggcgaugggaguuggggaaagcaucaggaagaacagcugauggaugcucggcuuaauaccuaggugauggcuugaucugagcagcaaaccaccauggcacacguuuacuuauguaacugcauauccagcacauguacuccugaacuuaaaaguugaacaacaaaaaaagaaggaaaaugcguuaauaccuuauuguaauuauuuuuuuuuuggaagacuauuuuuuauauucagaagaagugucagagucagcagaaagggauuauuucuccauuuaccuacaacaaugguuuuaaaugacuggauagauagaaaucucuuucaacuuaacugcuuagcacauugcauuuuucucuguuucauguuaguuuuccaaaggauuacugacuuuuuaccuaauuugcuaagggaugucaggccuuaaugacauauuuccccucacauaaagauacaacaugcuuuuacuguguaggaggaauuguuaacaggauuuaugauggcuguguuugacuucccaacaaugauagaacauuugggcauuuuuauguucuuuuucuauauuguuugugugcuuauuuuguguuuuaauagucacugucuuacugaugugcugcauuugugaauugaaaugucuugcccauguuucuaagaucucuaaauccugauucuuuucaucuugguugauaugacagugucauaucaacugacacugucaauugauagugucauuuucaaugacagugucuacucugcauauuuaaugcacucuacaguguugauaugacaugucuacucugcauauuuaauuaauguguuacuuccacucuuuacauauuaauggcagcauuuagaaguuaggcuauguuuagaagcuaggcagaauguuuaguuuuccuucacauuuuugcugcucuuuuaauguacagugaaaauguuaaaguacaaggaugacaaccuugauuuuauuauaaaccuuccucauacuuccuuaauguuaugacuauuuguaagcaaauuaaacgaccuuagagauauauuuaauguuccuaauacugauguuccugaaugguagauaaaugucuuaucaucucuuuaucuucuaggguuaugaucauagcuacuacuucauugcaaccuuuauuacugaccacaucagacaucaugcuaaauaccugaaugcaugaaaaaacuccaaauaagagaaucucuucaggauuauaaaaguuguaaaaugcaacuguauugcugagcaaaaaaaaaaaaaauucaaaacauuggauuuuauagugcuaaaagggcuuuauucuauaguugaaucaccucugaauaaagauauaaaaccuacuucugauuuuaaaaguuauuuuacaaguguucacauaggaaaucuuuaaugcucuauagcuuuuucagugucguuuggaaauucuuguauuaaucccaggucauagaauaugaauguaauccuauuugaaguauagaguagcaacucuggaacagaagacuuaaaaguaauuuagcccagacuccucaccuuuccagacuuuaagccucugaagacauuggacugucuuugucauguucauuguuguaucucuagugucuagcaagugucuagaaagcaaauauccacuugauuucuaguggauauuuaauaacuguuagcuacagaauaaagagguaggcucagaaagguuaaaugaauuccccaucguuacacagcuauuugugggauauuagaagacagauuuucuuuucuuaccuauugagucuaauauauuugugaacauugguuuuuggguguauuaagguucucaagaauuaaauaagauucaaucugaaaauggcuaaauaaggaaacguauuaguuucauauguuacuguaaacaugaauauuuucccauaguugcaagcagagauuuaacuuggugagcucaccaagaaaaguaauaucucuguaaauacccaauuguuuuccuuuaagaacuuuuaauagacaaacuuuuugaaaugugauaaaagccagu

SEQ ID NO: 17664 - RNA, 200059 nt, Homo sapiens
gagacacaugcgcgcugccgccgccgccgccgccgccgcaguccuuagcuucccggggacaggaaaccuucaagaccgagcugccacggccgccuccccgcccgccccccauucuacgcgccugcccacacccuccuccccuccuuccagcgccuuucgguggagcacugcggcacucagcccgagcugccguuuuccccucgcggggaacgcugugacccccccgcaggagcggcggggcggggugggggggcccgggagaagauggcgacgccgggaagcgaaccccaaccuuucgucccggcccuuucgguagcuacucugcacccacuucaucauccccaccaccaccaccaccaccaucagcaccacggaggaaccggcgcccccggcggggcgggugguggcggcgguggcagcgggggcuucaaccugcccuugaaccggggucuggagcgcgcgcuugaggaggcggccaacuccggggggcugaaccugagcgccaggaaauugaaggaauuuccccguaccgcagcccccgggcacgaccucucggacacggugcaggcaggugagugagggccgaggggcgggcaggggugugggugcugucugggugucugucgugcguucccuaacgcgguggacagucggagaucuugucuugcugggggagggaggguccaucggcccguugucucccgaagaagggacucgcgugggcgcggaagaagcgggcccuggagagggcacgggggcccugccugguccggcgaugcagugccaggagggcaggggugcgccgggccucugcgccugagagcgaggggucuccggcucuccacccuguggcugccgcgccagggaaguaaccgcggggcugggacuugcaggcgcgccgcgugcgcgcaguguaagugggagguuucaggcggcugugucggcuuccugggccccgcgcagggcugggaacuccagcgcggacagcggcgucggcgccuccaaccaguucaagccgucuuugcaucgaggcguagcccauccugguggggaaacccagacaaagguggcacgcccucggccgagccaggggcaucggcgcagugccgcgagcccccucggcgacaucgccgagcgaucgggcaacucggugccgccugugaggugcccaaguuuccucucccugcgcuugugcgggaaaagagccgccgggcuuguagugaaucccagucggcugccgcuucggaagcgaucggcccucuuccuuccgugccuuuugcucaccgcccacacaguuuggguccuaccaccgaggcuaccugguucucaguuacccaaccguugcgggggccccaggaaaggacggcguggcauauuaaaggcaaaguaauuaacgugagccuguuuuccugugugagcccggcaaguuguaacucgcgccaauaagcagcauaacuuuuucaaguuacgucauguguuacauacuucuaaaacgucugcuuucucuuugguaguuggaguuccaggagcgggaucuauaaacaggaaggagggugguggaauaggauuggggccuuagggucuauacagaacugacuugguuuccggccauccgguuccgcucccugggggaggguuugugucauagcaagcgcccaacauuucccagggcagugggugcuccguuuuggagccgcugcccagaccucuuggcugucaucgccucauggcccagggucagacccccugggucuuggauggguugacucucaucacaggagcacccaguuuaaucuuguagugggcaagggagcaggcaguggguuuuuggaggcuagguuuccagugucuuuucccccuuuuaauucaauaaacauuuaucuagagccuuaaugaauauuuagauacaguucugaguucacuggaggcaaagauggcucuccagggucauuaaacuuuguaauuuggauuuagggauagucaggaaucggcaaaaaagagggaauuuccaaaguugagcugucaacagcuggggagugucuuucaauaagaccucuuaguuacaucuucucaaguggaacuuauuccaagaauugccugaaucacugacuuaaaaaacuacauuaaauuuuacuucccuucugcuauagaguguaccgugagcuagcuaugcuaugguuggcuauaucugcagaaaauagagcuggcaugacuaauaauaauagguuuguguaguucaguaagggggcuucauaguuguucuacuucaguuaugcuaaggauuauuuacaaaguuaggugaacuugaugugucugcuguguuggcauuucuuugagaagaccagugcuuuuagggaucacaucuuuuagcuaagaccucgccaugugaaguggaugcugaaaguguucuuguuggcuuguuuauggcaagcuuaaguugugaguuuugcagguuuuuauuuaugagcucacuugcacauguuuuaugcucaggaaaaucuaacugguuaaaauucagaggcuuuauguuaauuccucauccaaaaauacaguauuauuugggggaagaggaguggagggauauucauguuuguagaaacuuaagucaaccccaucagaaaaguauucauugcagcuaguuauuuuacaugaaauuagaauacccaaauguauuaaauauuugcuucugcaaaacgucuuugccucaggucaaaagcuagguguaaaccacauguacucuuuguucuaaagauaaauuuaauugagcacaguuucuuauuugagagaccagaaagcaaaauaaagaguuaaaguuaccuccgguguacacaguguugacacagcguacauguaagaguucuaguacaguugaaaguuugaguaguaacauuuauaauaaagauagugguuucuccuugacucauauuuacuuuaagaaugucucuuaaaauuagaauggcauaugaagauccuuaaaggccuaagaggcaaaguggauuuuuuuuuccauauauuuucuaagacagggagugguagagcaagcuuuuucucacaguuuuguuguauauuacaggccauuugguuuacgccuuguaaaaagucaggcuucuggcagccaccugugcagaacugcaccugggcaauauagcccaucugaacagaguggaaaaccaagauguaaacaaagaaacauagaauagaugucuaagcugucacucaagugcauauacuuuauugauaggaaaaaauucaagcucucauuuugagccuauuaauuuacuucuauuugaaucaaaauaaguuuuguugucagagucuagucuuuuaauaggugaaacggggaaagaaagacugauccacgcaggugcagugagugacacaggugucacugauggaaagggacaaaacagaagagccacuaucagcacugggugcgccucucuaugcguuaucugcaugaucuuaguccccacuaggagcccagucauacccucauuuauacaugggaagacugagacagagacaaguuacauaauaugcugaagauuauaccucuacugagauggucaaccggugauuggaacccuggcagccucacguuaauucauguucuugaccauauucucaucaagcagagggaagggguugagagauagaaucugggaggcuuccuggaaauucauucaaccagcauugauuccacaagaauguacugagccccucugagugcuggccacugaucuaggcacuggggacacaacagugaccaaaagagaaucccuguaucccuucuuguggaguucauucuaguuggagaauagagagauacaugaauaaauugauuuugcaggauaaauaggaugaguuacaggauagauggaauaucuuuguuuuauaaauacacagauugcuuuguauugacuucagguggcuuguagcaagaguauaaaugaugacuaguaauacauauaaucugaagcauaaaauugggccaaagaaaaacaaguacacaaauuugcauaugaguaaagcaaauuuuuuuuuuuuuuggugcugauuuauuaaguagugucguuuugaaugaagaaguucaaaaggguauuuuguacaauuaaaagugaauugaaaaggaguaagaaaagaaaguggcugauugcaggagguucuagaaaauaaaaaagaagcccuuagacuuggcaugcaggacacuuguugaaagucuuguuaaggaaaguggggaauauuucauugcuaauuaucuuuuugaguuggcucuaagcaggaaagacuaugggccaggcacuguggcucacaccuguaaucccagcacuuugggaggccuagguggaaggaccacuugaccccaggaguuugagaacggucugggcaauauagugagaccccaucucuacgaaaaauaaaauauuaggccaggcacgauagcucacuccuguaacgccugcacuuugggaggccaagguggguggaucaccugaggucaggaguuugagaccagccugaccaacaugguaaaaccucaucucuacugaaaauacaaacauuagccgggcaugguggcaugugccuguaaucucagcuacucaggaggcugaggugggagaaucacuugaacccaggaggcggagguugcagugagcugagguugcagugagcugaggucgcaccacugcaugccagccugggcgacagagagagacuccaucucaaaaaaugaaugaauaaauaaguaaauaaaauaaaaaauuaggcgggugugguggcgcaugccuguaguuccagcuaugcggacggcugaggugggaagcccauagguugaggcugcagugaaagccaugaucgcgccacugcacuccagccuacgugacagagugagacccugccuuaaacaaacaaacaaacaaacaaacaaaacaaagacuaugugggaaacaaagagcuuacucagggaagaauauugaagugcagcauuaaaaauacccauuuaugugugagggaagaguucuguaggagaugcaaaguauaagacaauacaggaauacaugagaugcuaaauaacaguuccaggaagccacugaggcccaaggcaggucaaggugaggugccaaguagcacugauggacauuguguguagaauucagaggaaaaggucauuuucaugaggaugcuuaggaaagacuuugauagcagagguaggauuuggaucagguuuuguaggauggauaggauuuagauagaagugccuaugaauauucugugauuggaaggauggugccaagacguggaguaagaaccugacaguuggccggguguggugacucacaccuguaaucccagcauuuugggaggcugaggcggguggaucacuugaggccaggaguucaagaccagccuggccaagacggugaaacccugugucuacaaaaaaaaaaaaaaaaaaaaaaaaaagcuggguuccuguaaucccaguuacucgggaggcugaggcaugagaauugcuugaaccugggaggugaagguuguagugagccgagguugcgccacugcacuccagccugggcgacagaacaagacucugucucaaacaaacaaacaaacaaaugaaccugacagucuaagauucugugaauaaaagaaacagagagggcauuuaagccugucuuucuggucauauucuucuacccaacuccugccuuauaauggaguaaaggcuacagggcucuuaugacccuuuaauugaggacuccggaaauggcugaagccuaggauuugucagccugugggaauaacacccuagcucugugugaucuggcucucucaaaugucuguacagauucaaaggaucuucucugagauuugugggugguuuuaucucuugaaggcugacuuccacacccuauucccauccuaaagcaauggaguccuugggauguuagcacucuuuagucguuggaauucacagaagacuugauaacaaaaucuagucauuuucaacaacuuaacuuuauuucauaauuuuugccaucaauauguuucacuauaaauauaauaaaauuuuugaaaucacauguguuuccuuaaaauguauguucuuuuauaguuauauccaguuuugaauuaucguucugcuauugaauuaaauuugguaguuuuuaacauaccuguugcuuuuuguggugguuacuaucagauaaaugccuuuguuuauuacauguauucuaaauauucuuccauucauaaacuaugauucauauccuuuucuuuccuauuacuauuguuuuuucuucccuguuaagguauagauaaauuccaacaucaaacaaaagcuuuuggaacaacucagacaauaucuguagugguucugaaucacgucuagaugggcccuuccacaugucugugguauauggcaaaaacagucuccacaaaccuacaugcuauucucauugcuugcauuacaggcugcuuucuugaaaaggcaaggacauacuaaucaugcuucuagaauaauagcauacaauuauaggccagggaaccucugggaauuuuuggucugugccaguuuauaaaggaacagcccaagguuugaccuucaucacugagaugacucuacuggagaguuugucagucacugcaacaucugauuugauuuuugguagguguuugauacuaggccacaaauuagcacacccugucauuuaaaaauucuuguuuaaauuauugacugagacuuuuuuuugugugcguguguuacuguaaugaacugaaauuucccauggcauggcauaauaacucuuuguaauaaacauuuaaaggguagauaccuuuugaaauccauguugacgucgauuaauucagaagucaaacuuguuuugcccgugcuguccaucugguauauguacauagacuuuuucuauuauaucauucaacuucaucauugcuuguuuaaacacaagcuauuuuccucuuuuguguauacauuucuguucccccauauauauagacuuuuuauauuucagcugggcagcauuuacuugcucuuaaugucuccccauaauuucccuucaggugugguacugcaugugcuuuuucaaagccuugauaauuuaaauggcagaaaugcuauuauuaacuccauauaaggugguuauggguuugucacucaggccauguguaacuugaauuuuugucuaagccucagaaaaaccuguuugugaggccacuuuucagaauuucuugggcuuuuuggaaaauugaacgucugucuuggauauuggcuugagcuuagauauggcaauuccaccagugauuauuucagugauugugugaauuguuagaauuaagauaauuugguguuaauugcagugauuauuucaaguuauaagauuguaaucuauuauaaacguguuaaggauggaaggcacaaaacccaacuauuuuuccauagugaauaaucuuuuuuaaugcccaacucauaggaagccuagcuucuguuauugcuacuagucuuuuguugcaugaaagauuuuuguuuuugcaucagaauuuugccaugauauuucagagaguaagaaaagaaaaaaagaaaagaaaggucaggguuccaagucagacuuaauguaggaaaacuaggcauucuaauauagacucaaacaugaaauaugccuguguuauucuucauccuaauuuaagaguuuagugauauugcuuccauauucugcaguaagaaauaguacauuuggaaaccaucuccucccauaaaguaauucaaaaauaaagugagauuguuuacaugaauagaaaguugaugaacugugagaauuggggcuucccuugcuuacuccagccaugcaauagaagggaaaugcuuuuauagucagauuucuguucacuguuuuuccuaaccauauccuccuucacuggccauaaaggaggauauagcuggagaaaaaaaucagagaagaacaguauguuugauuugcauaacagaaauacuucauauuuugcuugguaagaaauuauugcuucucuguuaauaugaugcuggugcugaggcagcucaacugacuauaccugaaauucuuaccgaacauuuuuaaguaaucggggacagguuauuugauuuugggaucuuccuagauguuuguuuuucuuccuucugcuguuugcuuuuuucccucagucccucugcuggagggggaccuaacacaggugugggaugaaacugagcaggagccuucuagcucagugugucuugaauuuccuuuccacuguucuugccaaaugggcagaaaguggcccccaucuuaguuuuucuaaucuucuggcuucucauguggacuugcuuuugacagcugaccccugcagugugguauguauagcuuuggcacacgauguguuccucuguuauucuucccuauuuuugauguuuaugccauacagcgugaggaguagcaucaauauuucugaucugguucagucagcuuagcucugauuuaacuacuuuaucucugcaggcaaugguggcaauucaaagacagcaccaucaacacacugcuuggcuugcccuuccucuggauugccuucauuuugcuuuuccaagucauuuaccucaugucccuucuccucccuguucuguaggauucuacugaccccacucucauuucaucugggcccccagccugucaaaacaaacagccucccuaucagcccuuucuugcagaugucagcacugaaucauacaugaccuuaagccaucuuugcauuauuuccuuauggcauuuuuuguuuuauugccuuccucugauacuuucccuauguuuaaccuuuuugcuccuucacuggccugugagauuuggcuagacgggacuuuuccugauuuuuguauggcuuccaugcccaggacagaaaaugcuagaaaaacauugauggauuacucucuuuccucuuuccuacacuuggucucugcauuuuucauccaucaucuuggaucuacccugaaguuauccccuacuugugcauaguuugcugaucugcucagauuuuccugugagagcugauuuuucucacauagccucuuuuuacuucucagugucauccacuguauuagucugcuaggggcaccaugacaauauuccucagacuggguggcuuagacaacagaaauuaauuuucccauagcucuggaggcuggaaguccaagaucaaggugucggcagguuugauucuccugaggccucucucuuggcuuacagguggagguugucuuccugggucuucacaggccguuccuuuuuauacacaaauccuuguugucccuuccugagcccaaauuuccucuucuuauaaggguaucagugagauuggauugggacccacccauaggaccucauguaaucuucauuacuucuuuaaagacuuugucucuaaauacagucacauucugaggugcuagggguuagugcuuccauuacuuuugggggucauaauucagcccauaacgcccacugacucaccccugcuguagcugguagcuggaguuccucccccagccuguguaaacugaucuuggacuugugugaggcugcccucaaugcugcucuugcaggaggcccaagacaggucuguuuguuaaccauccuguccuuggaaucuagcccugcacacacuagcuacaccugcauccacgcugagagucccaauaaugcuccugagcccucgaaugugcuguaaaaugguaagagagccacauauacacuuacaaauggaugacuccggcucaucuggaccccuccuccaucucucauagacuuagaaucuuuucggugguuggugggucccuagagucacacuuuauuuuuagcuaagguggggucacuucucaccaacauuugcaaguguucgauaagcaauguuacaucuaaaaucaaaugaguuauagugaauucugagggagaugggcagguguuuuauaauaucaaauauuguuugaaauuagcaaaugaaaaacuaaucaauaucuuuugagcacuuauuguguaaggagcauagccaaaaauauaaaggcauaguuccaccuaguuugaauuggaugaggauuaaagaaauuauguauuugaaagucccuuacacauacaguacuccaauuaacaaguauuauuucaccaaagccuuucagcccuuagccaaauggaauuucuuccuuuuuuuuuuaaguauagcuuagugauuaaaaauaggguuuccugagcuucaaagaccuguguucaaaucuuggccuuguugcuuauaaacuaugucacuuuggccagaugacuuaaacccuaugcaucgguuuccucaccugucaaauggagauaauaauaguauguaccuaguagaguugucaugaggacauugguuauaauaacaacagcuaacauuagcaagcaguuauucuaugucagguauugcuccaagugcuuuauaugcaaauauauguauuaaauguauguaauagauguuucaccucauuuaaugcuugcuacauggucuguauuaacuagagugggggcucaauaacuccaagcaaugccuuucuauugcaaccugaagagggagauuagaaauguagaaaccauccauucauaucucucccucauuuaauagcugaggacacuaaggcccagagaguauaaucauuuggccaaggguacacagcauggcaguaggugccagagccagggcagagucucccaggcucacaucaaagggucguuucuguggagccaggaggugacauugggaugaagggaaggcuuucccucauccauaggguucucaggucaaacccacccaaaccagccagguugugggccucccaaaaaacaaaaaaaaauggugugaaaccuuuaauaacagaugguccaaaccuggggagaauaagauaaagcuaacgguaguuacagaugagacauguuaguguaggauuugacugcaugugguuugagggacaugcacaggccucuugucaacuggauuccacauacuaaaggagugugcugggcagcccccgacucacaaacggggccaucagccuuuccuagcaaggcuuuguuucagaacuuggcaugcauuuuccuauaaaaacaaggugguaaccugugauuugguucucccgccaacccacaaagcccuguuuaacccuagcagaccugggccuucuuauuaauggugguuucuuauuguuucuuuggaaaaaugcaaucccaguuccaacaugaaaucccgaaucuggagaacuuggcaucaggcugugaaugaggccccugccucuugaaaauaauucucuccccucuggccauuccggccaggggucggagguuccccacaccucucccaggucccuugaucagggcacucagcggcugggaaacaaggguuggcauaagucagggauccacuuggaccucaggaaggccacugggccagggaggaauaggccggggagccacccaccugagggaggcgugcaggaacuuagacacuucucuauuuaauuuuuauauuucuucuguauuaucuccccaacuuacuaauuuuggaauuggaagcaaguuagugaacuuuucugaacaucagguuuguaauuuguuagaagcgaaaaugcucuuuaucccuugggugguuguauagauucaaaggguaauagauagcacaggagcagggcucaggucuggcaaacagugagugacuaguagaaaaccugucacuuucuguccuuaauuuccauggggcuaugugacauagucuucuucagucacguagauaauuggaagcugucagccuaucauuagcauagaggcuaaagcacaaacuguggcugggucuuugucccugcucugccaggacauggcuacuacuucacuucccugagucucaguuuccucgucauaaaauggggauaauaauuauagaauuauugugaggaacaaaugaauacauaugucaagugcuuaggucagugcauggcacugauuuugccauuaugauuauucuguaucuuuagaaaagagagucaguguuauaaggcacagaaagacuaaauuccuagaaaugcugugacauuaauaaaauaacaucaguauccagcaagcuuggguguacaugcuuucaguguguguacauguuauuuauauccuuucggcagucuugggaggaugguagcauaggugguauucauuauuccauauugcauggggggaaacaggcuggauggugaaaugacuuuccuucgguuaugcugcuagucagcaguugagacaagaccacaucuucuggguuuucaugcuguuuuuauuccucaauucaacgguguucuuagguuugauuuaauuucugcuggggccgggugcaauggcucauaccuguaauccuagcaauuugggaggccaagguggguaaaucacuugaggccaggaguuugagaccagccuggccaauauggugagacccgucucuacuaaaaauacaaaaauuagcugggugugguggugggcaccuguaauccaagcuacucaggaggcuagggcaagagaaucgcuugaacugggaggcggagguugcagugagcugagaucacgccauugcacuccagccugggugacagaaugagacucugucuccaaaauaauaauaauaauaauaauaauaauaauaauaauaaugacaacaauaauuucuacugggacagaggagucuugaggggacugagucucgcagagaagaguguguucagguuucucacaguagagaauggggaacccuauuccugugccacguuguguauucaggugaagggugcuggggccagcucuuguuuuggccuccagauuggaggggugaggaagugguggcuggggccucagaggagggccuggggugccugucuucagucucuacggaagucuugucauugauuuaaaagcucuuccaaguuaaaaaacaagcaaacaaauaaaaaaccauugacagucucuucauguucuuggcaaagaacaauuuaugaauaauuuuauguucuugacaugcucugaagaugaauagcaaacacuucuaccagaagugaagaaauggcuacuaggaggcugagcuuuaggaauaaauauauaguagauucaauuguuaucuuuuuuuucccucacucuuuuacuggcauccagcauuuauuuugaacuucagucagaaguuauuucacuaagaaccuugucauagcuucaacaucucccugaggcuacugauaugguaacucggaagggggaauaauguuuguagggccagacucaugucuggguccagggucuuucagaauguuccucuuucaguucucagaacacccuugugaggucgggaguaucaucguuacugagaagggcacuuaucacaaguuaggcagucagaguauauuuguaagccaguaguaagacagagccgaaauuggagcccaaacaguuguugaagaagugcaggauccuccucuauuuuagugucacugaauauuuagagcuagaggaagagaccagagaaggagauuuugcagaugagaaucaagccuauggcauuucuacagaugguccucggggugacauagagauuuuagaguucauccccaaguaggacccggauuccugacuaaugugauuucccccacugaucugaaagugagcucagagaccccagauauaugcauggggaguuccagcccuaauccucacuuguuugugauggccagcuaucagcuccauuucuaagaauuguguuuuaaagcaagucacaauuacuaguuuuaaaaauucuucaagguaucuguuauuaaaaaauauagacacacauuuggguuuucagcuuugguauaaacuuuucuuguuagacuuuguaacacaugaccuaauugaacaguuuacugauauuuucuauaaacaguuuacugauauuuacuuucccuccagugagaaaugaacgaauuucaucgagugcaagaccaaguuuacuuucuagaacauuaccuauagaauacaaauguuuacauuccaaagacuguuuuauuauguaauaagaaucaucaauuugacauauaaaaauauguuuuauuuuguaauagagaucuuucuauacauuaauuaccucuacaauuuuauagaugaaauagggcagcacaagauuauggcuaaaaaacagauuuuuuuugagugcaugcaaaucaaauccaacuuaaaggaaucugugcaauugacggcaaauagaucucucuuugugcaguucccuuggaggugaaaaugauaaucucugcaugcaauuuaaggcaauuuuguguguguguguguguguguguguguguguguguuuuccugguguuuuagaaagccuggauaaauccaaguuaauuuuaguuguagcagucauuccaucgguuauaggcuuguaaucaacucuuagcugugguuuguucagauauuuacaaugaaugcuuucuuguaucuauacaguacuguaaaagguacugugcuauaacuuuauaaguacaaaugugccuaaaucugauauauuuuauaaaauucaguuggcagcugugaaggcuugcuuuugucucuuccuccccugcacaggcuaaguccuuggaaucaguauguuaaugaagacuugguaucucaauaugaaauuugcaccaugggaguucugagauaaugcguccugauagagccccuaaugccugccucuuaggagggcgagugacaaagacaguauaacucagcuaaguccuuucauaaucaggcagccuuggucuuucucaagugguuccauaguuucugugugugugcuuucuuguguuucugugucucagaccucuucucuccuugggcagucugucuguaaucuuuuaauacugcaugguagauuggauuggaugagccccaucaccuuuggauaagaaaaggcuuuuggacacaaguccaugcaacacucuuuucuuuagagaacacaauagaucacugggaacaucauaagaggugcucucagagggugcuuauaaguggcaccauccuaaauccagguuuaccggggacagucuggguuuauaacucauccuggccuaaugaauaauagcacccucuuuuagcacagcaugauuuagauaaguuauauggucaccccaugcacaugggaugugguagauaacaccuuuuaagaauaaagugaaauggauucaagugaagugacuuaccuacccaugucuaguugugucagauugaauccagaauugguccagguuauccuggucauuucaccagcuacccauauugcuguccuuugaaggaauuacaaugcuuggcugguucucuuuuuuaacuuucaugccaagaaacccucuuaguaaagucuuagacauuuguuguuuauuuuaguugguaaaauacagcauuaauuuaaaaauuacaaaauauugcauacauaggaaggaguccguacccuauguagacaugauuuaaguaaugaugauaaaacagacauagugacagaagcauauagaaaggugaucaccugggaaggggugcagagaggauggaaacauucuaugucuuagaauggugaguacauagguagguguauguauuugucagaacucagugaacucugcacuuaaaaugggugcauuuuacuguauguaaaucauaccuugauacaguagacuaaaaauuuaccuauuuaccacuauccaacuuaaaaaggagaacauuuccaauaccuuuuuagcuuucugccuggugccgauuccugacugacaagcuguuuuaaaacacagaauaacugaggcuuuauugcuaaaucaaugccuccuauuagaagacugauauuucuguuuuaguggacguucuuuaaucuuuauuuuccuuauuucgaaacgucuuguuaacccucuuuacguagucuuacucauaaaauauucuaauucuguauuuaacaagcggcauuuuauuuuagugauagaaaaaacuguggcugaaccaaguuuucugggaucacuggaaugauguuagcuaauggaguccaauguugaaagcauuuguugcgcaccuacuggaugucagacacuuugcagacacgaucuuauuucuccucugagccuaauaauagguaucauuucccuuaaauuuccucauguguagaauugaggccuauagauguuaagaacuugcccaagauccccaugcaaaaguaauuaggagaauuaggagucaggguuugagccccagggaucuaaguacauuguuaauguagagaacugcccuuugcugggagaaguuaagcacuuggcuggcuccccugguuguaucguguagcaccaggaccauguggcguaucacuuccaaauuuccuaaaucacugugauccugcauacuccuugcccagaccccuccuguggcucucuccugcuugcccaccgaggcucagcugccuagcagcagauccacagggccucugguaucuggcgccaacccgcuuauccugcuggguuuuccucuagcuccccucaagggccuguguggcuccagcugccuuuuccauuaguguucccauauguuccagguuaaggccuccgcuuugccuucgauuguaccuuuucugucuucauugcacuugccaaauaaaauaaacaaaacaaaacaaugacagaccccagcucuccagucccugucaagcagucaucucaaaauuuuaauuccugccucuucuaggaugccccaaaugccagccucccucucugcaacucuacucaucuuuucaucuaaaacagaguuuauaaugauugaguugguccuuaauuguucuuuaauuccaugucuuuuuucucuaauaagaauaagaaugauaauagcuucauuuauugagucagauauuguguucuccacuuuauguggcuucccucagcuaacucccagagcaaucuugggagguaaguacacauuuucuucccaucugacagacuggaaaauugaggcucagagagaaaugccugagaucacauggcuacuaaguggcaagacugggauucgguuugacuugaguuugacuacucuuugcugacuucuugcaaaugccuugaggagaguagaaaagaaaggaaacugacauugacugugccuuugcuauggcuuggcaucgagaugguuuagcuuauuaucucacaggguccuuauccugugcuaagaaucagaucuccaaaaaaauugagaauuagaucucuaaaaaacggaggcucuguuuacauaauucauucaaggucacagcgcugauuaguggagagauaaaaauuaaaccaggucuuucugccccuagagaugcuccacugcgugcaugaggacacuuuauuucuuuuucuuacucucugcauggccuagcauagagcuggauauuagggaaacuuuucaauuaguuauagguugcuuaaaaaacaacaaaaacaaaaguuccuuuuauucuguuagaagcaugagcauaucacacauauuccgguagggaagaguaguaccauaaagaauguuggauuuuuagaagagacaacguaaaagcaaaggugaggugagauagacacuugaacagaauggcagucacagaauuucuuaucuuuugagagauuuacuugagggauucuaccuuuacuauaguagaggagugucuaaaauuaaaagacaggagaagaugacuuaguauucccauucagauuuuuaaauugcugugugguuagcugucuccagucaggcagcuucacugcuccuuucuuuaacugccuuucucaggcauagaaguaaaaagaaguaaaagguaacggccaguugcccucggccucuccauugguggauuugcagagugcugaaauucacccuagaguuuacccuucaaaguaacuaggcauuaaaaaacucauaccuacaaaaaaggaacuccuuuguguuccaacaauuguuacaauauguuagacuuuuggugaucaaaacacaccuccauuaacugcuccagcaucuugugcaucucagcuguuugugcgagucauccagcaugagggaggaugggucugcaucaggugcaguuccugggccuuggaauauguccuccacuuuuguuugaucagcggcguguuuccauugagugugcugugugccaagagaacaguugucagugguauucgcagugaugcacauuagcaugagugccagagauucaaguggcgacgaguaccaacucugccuuccacccauugcuuuuugugcucucagaaacuggagaaacgcuagcuuugcacacuggguuuucucgaagcgggcuaggcguaucauuuccaagggcuguggagcuuccuggaacugugcaugcugugaacacucucccagaaugaugaaaugccaaagugcucaagucaccaugccuuuguucacuggcucccaugccuuucuugcugugaccauccaugaggcuuagaaccaucacagcuguuuaggaaauggucuuggaguccaacagaccaaggucaaauucuggcucugucacuuagcaguugggugacuguaggcaauucauguaccucucugaacuucucauuucucaucuguaaaguaagugagaguaauaacacuuaugggguugcugugaugacuaaaauaacaaauucuaaguauguggcacuugggguaugugugugugagagagagagagaaagagcgggagggagggagggagagagagagagagacaggcaggcaguggcuguuuuuuugaacggcgaugcccacagagggggaguuauuuuuggagaggagggggucuucucacugcucccaauucucauccaugcuggggacgugcaucugucucugccacuacucugggaacauaucucuugucggauacagcugucuuucuguuguucccuuggucugccagcacagggcugaggccauucccugcacuccucuuccuacuuguacccccacugcaggccaugccuggggacucccugacccugcuguccuucucagcuuggagcuugcugcucuuuauggggaggacuuugguucucuuugccaggcugccugagaaacaggcccagguggugugaaguaauaauccccagaccaaauauguuuaucgucuuauuugagccauccugagacuuacugcaacacuacuuuaagcuuagugaguuuaauuuggaucacagccuauuauacauauggcauggugucagcuuuuaguaaaagauaaaauaggugcgugaaaugaaagagacauagaugccaguuggagaacagagugaucuaaaagcaaauucugcauagcaauaugaauacuucagaguggacagggguauaguuugaaagaagcuaccuauaacgacuguuuucauuauauugacuaaagaaaaaaaaagcucgacaaaaucucccuaacucguggagucauauggaagauagaauaagaagacagugcacaauugugggcaaaagaagguaaugaaacauugcaaagacuuuaaaaagcuuuuuuuaaguucuauauucacagccacauuucguaaacuuaagaggugcugcauuuuuuuucauucauucauccauccagcaaauauuuauuaucuagugugaguaaacuugcccaugagcccaucccuuuccacugccuguuacuguaugugacaaggauaguagcgugcucaguagcuugcaaccacguugccugggugagcgacuccuccaucuacuggcccagugaccuugggcaaguuccauaaccucucuaugcucuaguuuccucaucuguaaaagagaaaugauaauagcaccugucacagagggcuuuggggaauugaaaaugcaaggagugcagagcaaugccuggcaucugagagacauucaauacauguuaacucuuaucauuuguuuucugacuuauucauuugcuucuuuauugucacucucucuuuccaucauuaaacgcugagagaaaccuuguuuucucuuuucucauguaacuacuauccuugguuccuaggacagugucugcccaugguagcagcuuaguaaauauuugagccgaguaagugaauaaauggcuggaugaaugaauggaaugcaugaaggcuggacucugugcugggugcuuccuagacaggagugaacaaaacuuggugccugcuggguauaugcccaaaggaaagaaaaucaguacagcaaagagauaucugcacccccauguuuguugcagcacuguugacaauagccaagauuugaaagcauccuaaguguccaucaacagaugaauggauaaagaaaaugugguacauaugcacaauggaguacuauucagccauaaaaagaaugagauccugucauuugcaaccacauggauagaacuggacaucauuauauuaagugaaauaagccgggcacagaaagacaaacuucgcauguucucacuuauuuguaggagcuaaaaauuaaaacaguugaacucauggacauagacauagagaguagaaugaugguuaccagaggaugggaaguggagggaugggaaggagguggggaugguuaauagguaugaaaaauagaaugaaugaaggaacaagaucuaguauaugauagcacaacagggugacuauagucaaauauauauauauauauauauauuuuuuuuuuuuuugagauggagucuuacucuauuccccagacuggagcgcaguggcaugaucucagcucacugcaaccuccaccugccucguucaagccucccaaguagcugggauuacaggcacacaccaccaugcccggcuaauuuuuguauuuuuaguagagacgggguuucgccauguuggccaggcuggucucgaacuccugaccucaccucaggugauccgccugccucggccucccaaagugcuggaauuacaggccacugugccugaccauauagucaauaauaauuuaauuguaauuuaaauauaauuuuacaguaaccuaaagaguauaauuauccuuuguaacacaaaggauaaaugcuugaaaugauggauacccauuuauccugaugugauuauugcaugccuguaugaaaguaucucauguaccccauaaauauauauaccuacuauguacccccagaaauuaaaaauuaaaaaaaauuaacauuaaaaaauacaaaacaagugguguugccugcauuuuagagcuuccagcuagucaagugaaggagaagucuagagaucuauaauaaccaaaggugcuaagugucaaugcaagggaagaacggggacaccaugcuguauggcaucaaggaagaaguggcauuuuccgacuauguugagugguggacugauaaacaagagcacuuuuuuucuuuauccauuagaagacuuaaaauaauuauuuguagaucccacuuccccacuuuuuaaagcauuuccuucucaauuauucccucucuucaaacauacaaacuuauacgcauauucuaaaacuuguaaaaggaaguuaaacacauuuuaaucauuuaaaagguuuuuuaaaaagucaacccauguaacuuaaaaaugauuaugaagcacuuguuuacuuucgguugucuggcauuuauuugugugugggguuuuuuuuuuuuuuuuuuuuuuuugguguaugggcuauuuauugcuuuuucuuaauuuuuuccuuguguguuuggaaagcaaaauccaaacaaaguccuuuuuggcagugguaauaauaaauauucuguuuagccuuuggaugagguuuacaugauguaucuauaagcacauucuggaauauuggaauaacaguuuccaauccuuuugaucaauggauagugggauaaaugaaaaguuccaaccaaaauauaccuacuggacaagaaccaucaucuuuuaauaggcagaaauccucuuuaggguccagccuuccuuucauuccuguucuacauugucaaugacucugaccacaggaacagagaacugcuggauagggugcagugcugcugguccccucuaucaucaccagcacaaauaauuguauuaauuuuuuuuuuaggaguggaguuuaagcucagcugugcaccccagacauugaugaagauagucuaucguaugacuuagagucacagaaccacaagaugcgugugugauuaucuaaauaaagagcucuuacugcaaccuugugacucuggugauagaacugggcgugggagggcuuucucauucaugugcugugcacacaaaugauucucuaaguugaaggacacauugcucugcagcauaacugaaaaaucugugcaugaauguguguguguguguguguguguguguguguguguugugggggggauguggucucauuccuacuugcaaaaauccuccagaagggguuuucaaagcauugcacagcuguugcuugucagcuucuuguguugacuagaugucagcaacacuuccucaacuuuggacaaugacuugaaagcaagaucagugugugcucaugggauggauuuaaauggaauugaaugauacagaaaccauugccuaauuuauauuuagguaagucauguuuucuuucucucucucuuuaaauuuuuccugaaaugcauguaugaagcucuuuuuggcuaaaaugagagaaugaagcaggcuccugaguccuugagugaagaggauccauugagaaguccagagggagagagaaugagcuugauuaacggcagcacaggauuggcaggagugauauaaaauaguacaucaucucagagugaccuaauacucgacuuuggaaugcauuuuuauuuuuggcaguggauuuaccucccuguguccugccuggacaaacguuggaauuagucagcauuccuuaagcacaugcugauuauggccaaagaaaguggcaggcuugaggcuugcuggcgaccaggagaaagccagcuggauuagacauuugccgugagccuuuuguucauguaacuuauggggcagucuccuaagccagagaaacaagaaacucaaaggcaguuuuagcaagguucucaugcauggcagcauauuuuaauacuaaugcucccuuuaggcaggcccuaaauaagaaugucuuguucuaauuuuuuuccguagacuuaagauuguugggaaaaaacuuguuagaauucccaagugaaaccauuuaaaugccuuggcuucugauaacugggaguccugagugaaguugucaguugcugcugaacucagcagaaauaauugcgcucccuaugccaaugaucugugcauauuuugagaccauucugagaccaaggaggcuaucacaacauguucacauugcuaucguugauuagagcccugagcuuuacauguugucuccugugguguccuucggaauauuggagagccaugccucuuuccuuucaauguucucaaccuggcccagccaggauuagaggcucccuucugagguucaguagaauuuuauauuuacccuuuaucauuauucaccuuacuguauugcacuucucugucuacagucuccagcauuccauuacagugcuaggacuauguuggcauuuguauucguuuuucauuacuucauaagaaauugccccaaauuugguggcuuaaaaugaugcacauuuaugauggcacaguuucuauggaucaggaguccagacacaguuuggcuggauucucugcccuaggucucacaaggcuguacucaaggaacuggcuggggcuucucucaucugaagcuuggaguccuuuuccaagcuuucgagguuguuggcaggauucggucccuugugauuguggaacucaugguggccuuuuuucuuucaggccagcaggaaaaggucucugacuugagggugggccccaguccuucuuuuauuuuauuauuauuuuuugagacagaguuucguucuuguugcccaggcugagugcaaccucggugccaucucggcucacugcaaccuccaccuccagaguucaaaugauccucccaccucagccucccaaguagcuaggauuacaggcacacgccaccaugccuggcuaauuuuuguaucuuuuaguagagaugggauuucaccauguuggccaggcuggucucgaacuccugaccucaagugauccacccaccucggccucccaaagugcugggauuacagguaugagccacugcaccuggcccccaguucuucuuuuaaaggcaucaccuaauuaggucaggcccacucaacaguugauuaaccuuaauuauauuugcaaaaucccuuugccauuuaagaugacacaauaauuggaaugauaucccaucauauucacagguccuaccuauacucaaaaggugguagguuauacaggguggauauaguguugaaagaaggaaugaaugaaaugaaugaauucugauagcuggaagcacagcaacuagcuuuuuuuguagcaugagugagagaagguauugaguuccuuauugaagaaugcaguugcaacaguuuaucacuagugagcugcuucuugguaacuauaagacauaagcagacaagaaacagcaagaaaggaaggaaggagaaaagagaacgagaaggaaaucauuauuuuggaccgauuuccgguggugguuucaagaaguucuccccacccuccagacugcugucauuuacaauugcuagagaacaagagcugggagccucuccuugguucugcuccuguggcauagccaugggggaugcagaagggcaguggugcccacuaaagggaauccccgucagcuuugguuuuaguuuccagagauugagccucugccuuaggcugagagaaaaacuuagugugagucuuuauuugcucccuuauaaucacaggcacauguggcaccuccucccccaucucugccccaccucuuccaacagugagaugcauuagguguggaaaggaagccuucauuucaaaaucuccuggcugcgguuagcuuuaaaaaucaaauggaacuguggucgucuguguuuaauuuggaagagcagaaaggaugcgugcuuuguggcgccugcauagugaaagucuccaugacuuaauaccacugcccagccuuagaagcuucccaugcagacaauggcccugcuuccccaucaguucuugggcuugggugccaccuuauauaaacauugcugcuuuuagugcaucgcagaagcaaaaggaugacacauuaauagcagcuggaggaucucauuaaaauucggaggaaaauaugaaggcuggagccugguaauguacagacaguaagucuuugucugucugauuaacaauugcaugcauucuaagugccuugcuggaugguaagaaccagcauuucagccagaaguaccauguucuucuccuuaagaauaaccuauuucuguuuuucaauucccuuauccccucuaaaaauaauaugcuggucuuuuggacucccuugagaacugaaacagcuuagcaacuggggcagucccugagagcuggugcagaaacaacuguugcuagcuuggauuugaauuaugcagucagaugcuuacaucgugggagggggauguacgggguguguggccuucagaugcuuacauugugggagggggauguacaggguguguggccuucaugccagaaaggacagggaagcacucccugguuggcgggaggaggggagaugcugggguugaggcccuuaccuuuauuuauguuguucacugguacagccagacugcaaccucucaacucuucagacaagaccuaaggccgacaaaauucacucccucaugaagaacauugggcuguuucucccugguguguagguggugggagugaaguagaggggcucgcugugugcagggaaagggcugcauucucaagaauuuguauguagcccuuggacuaaaaacaaaauauuccaaaggaaugcuucuuuuggaacccugguccagucccucgucuaagcaggagugcccuuauaugcuugacuguggauggcaucugauuacgggcagaagguugcacuggauugcugccugaugcggacccacagaacacaguuuaacucuggcucugucagcagucaucaguguuuauuuuuccaacucuucagagagauauuagucguuaugaaaaguguaccaucucagaacuccauggaauaagcugccaauauaagacagguugaaauuauugugucuuuuugccuagaguuauuuuuaguuauuuuuucuuccuuggaauuucuuuucuuuuuuuuuuuuaaccauauaugcuaacuuuguagcugguggcaaaaaaagauuauuuucccuauauuaaugacuucuucagcugaauugaggaauaggguuaccagcucuuuucuuggaguuuaacacucucaaucugauaauaugaauaacaccucaauaaccacaacaagagcggaucaucuucaguaucuuuccugaauuaccuuuuggcuuuucaccaccuuguuuguccguuucagaguuugucuuucuguaaaaucaugggaaggcaucugauuacuuuguucuugauguaccugaguaaugcgaacaucugaauaauugaacaaaaaucuuguuuaaacaaaacuuuuguuucagaagcaucugucaaauuguuagucaucugacaauuuaaaaugucaaagcaagaguuggcugaucuuaaccuuagccuugucacauuauuaacuucauggagcuucagaguaacuugagaagacuugcagucuguaccugaaaaagccagguuuagaaaguggcucaugaagaaguaaaaccucucagucaaguggaaugugcaagggaaccccuaggagcauuuuggcaugaacauuucuuuugaguuucuagcccaagaccucuuuauaacauuuguuccucucccagguccuccuccuacugccucuaauuuuuaaauaaguucuguuuaacucauuuuuggauaauaagcuagcucugagaaagcuugguagaacuauuuucacugaaggaguucuaaaacugaucauaucucuugucaucaaauuauaaccugacuguugccuguuaucugaaauucuaagauagugaagagaguuauuuuacuuuuucuuguagggcccuucugucauuacuuccuugcuagaauccuaugugugauaaugagggaaugaaauuauccaaaggguaauuugcaguaugcauccuacccagcaguugaaacuacugcagcgaaacugcaaggaaaccuaacccauguuuucuuguaaugcuacccuuugggggucaugcaugcugcuuucugcuccaacagucuuaacgugggaauuggggacacuuacuuuuugaccuggaacaaaucucuaagacucguaagccaccaauugauucaccuuuuguagcagggcuuguaugacaaacucuuuugugagaacaaaaggaaagucccuucccuuuuugccauucuuguucuguagauuaauuagcaaagacguaguggagaaaugugucacuugcaagacauuucuggcacggaguggaccaaguggaaaugcuuaaauguguugcagggauaucaaagggacugagcuuuuggaacaaagaggaacagagcccaaaggacaguugguacaaauuacacaauuuucaguugguucuaauaaaguucuaggaaaaggggcuuaugcacaaaggcugagcucuugccucuguuguucuucaaauccaaaaugucauuaaaauacuaguagugguugucauauuuuaauaacauuuuggauuugaaguguguagcugaaacuuacucuuuguuaauggauguaucacugggugagcuucuagacugccucaccaauggaucuagcauuaccuugguuaaugaaauaagguaaaacacagucccuguguaccagaaagcagguucaugugucagcugcaucaugucauuuggaacuuugcaggugugguuuuccuuugcuccuucaaucuccucauuucuuucauugccuggaugaagccccugcaacaggagagcuuuugccuccucugccucaccucagcccccuagaccucugugugcaacuggaguaugguguuaagugagccuggagcagucuuaggaaaaggcuucaagugaggcuaggugggaaggccugggacagaaauaaauucaaaacaacaaccaaagaacugauagguggaauaaaagaagugggacagaaaagauucaaaggugggaauugaaagagagagguacaguaagaauagcuggcguccagugaacauguacaguggaccaugcacaguuccaagcacguucgauuuauuauuucaucuaagacucacgagaacucuauaagacaaaggucugacauucucauccccguguuagaugugaggaaucuggagcacaaauguguaaguaauuuuucuguugagaaauggaccuaucagggguugaacccaagcaguuugccuccaguuaauguccuucgccacuuuauauugaacugagaaaaggcgggacaaaagucacaaccaaagguggcuuuggccuucagaauauuccaccuacugccaucaauauuccaccuucucaagcccacaugcuccuguuucuuuuuuuguccccccauuccauaauuaaucauccuugcaauaaaagagacuuuuggaaauuauuuugggaaaaugaagucuuugggaggccaagguggguggaucacuugaggucaggaguuuuaggccacccuggccaauauggcgaaacccccuuuguacuaaaaauucaaaaauuagccgggcgugcuggugugugccuguagucccagcuacuugggaggcugaggcaggagaaucgcuugaaccugggaggcggaguuugcagugagccgaaaucaugccacagcacuccagccugggcggcagagagagacuccaucucaaaaaaaaaaaaaaaaagaaagaaagaaaaugaaggguauagcugaaaucugcucauuucaugaucuugacaauuuaaaaaaccugauugcuguugcaguaggacuguuuaaaaaaggaaagagaaaaauauauuuuuaaaaaucugagcauguugaaagacacaaaggaccuuuguuacaagucacuccuaccaauggaagaacaaccguugcucucaucuuuuuuuuuuuuuuuuuuuuuuggucauuucaucucuccaguggcugagaucaauaagagaugcucuaugguugcuuuugaguuccuuuggaugucuuaaugaagggaugaacauauuguuuuuuuuuuuugacacagggucucauucugucacucccugcuggagugcagugacacaaucuuagcucacuguagccuugaccucccgggcucaggugauccucccaccuuagccuccugaguggcugggaccacaggcacgcaccaccaugcccagcuuuuuuuuuuuuuuuuuuuuuuuuguauuuuuaguagagacggggucucaacauguugcccaggcuggucuugaacuucucagaucaagccaucugcuugccucggccucccagagugcugggauuauagguauucgccgcugugcccagccacauauugcuuuugauguaguuaaacaguuaacugcuaccaagcucuucacagagguuacugggcucaggaauaaaaaggcuucuacuccaaaucugguagcaccuugcaccacaaagacuugcucucucaguaagaaaacaaauggcaguucuauauauagucaagaguggaggcaggaaaagacuacauuucugaaaaauguguucccaagaaauccauguuaaucaaugucagagaccauccaguuuuuauauauugcagucucaagaaauauucugccacagauucucuaaggacugaucauaaaacacaaaaccuuuuuaucuuuuguaaguuugucaguucuaacauuaaaugcuuaauuuugacaguuaccaaaacaagucgauucuagcuuuccuuuuuuaaaguuucaggugaaauuugcuauaaucucauguccauccucauucaggcaugcugaaagcacuaauauucuguuugcuuuugagugcuaaagaaauauagcccaugagauuacuggccaaauugaaaagaaugaggcuuauuguaccaagauaucuuucuugauaaauuaagucaaugaucuauuuccugcacuagaggucuugauuggguaugucauagcguaauuuuguuugccuucugaggcacaccuauucucuugcucuuuaacuuggaaagcuccuaacucagaagccacucugugaacauauggcuccaaagauugcuucagauuccuggcugccugugcuaaugucaguacucaccuuuggacaggauaucuaauuuuuagauucuagacaguugaaaguaacuaaccucucuagguuuuucuucuguuuccuagaguaaauguuaucaaugugauuuaaucugacuagauuacuauacauuuuugaacguaaucauuuauuuguguuuauauuauuugcucuuguuucagcuacggaauuuuucuauuuuuuuuuuuuuugagacagugugucacugugucccccaggcuggagugcaguggcgcaaucuccgcucacugcaaccuccgccucucagguucaagcaauucuccugccucagccucccaaguagcugggauuacaggcgugagccacugcgcccagccaaggaauuuugcuuucuuuagucagcuagauuuuaaacuccacgaggucaggaaacuuacuuuucacacguuuuuccuucuuauagaauaauauuuucucgauauguuuuagaggugguauuuuauaggcagugguuaaagacugaaaacuuuaaccacuuuaaacucugaaauucuaggcaaugggauuuguacugaaagacauaggauaauuaugacacuucaauuauaguccguucaauucaccacuggggugguucuaaguuuaguucaugguggcuuucucccaggaaaucuaaaguacuuuacauauauagcuccauuguuucucauagcaugcaaccuuaacccaguguuuucacaugugauuugagagcucgauacccaaauuaugguccaugcaccagcagcaccggcaucaccuaggagcuggugggaaaugcaggcucucaggccucacccaaggccucaugaaucagagucuguauuuuaacaagauuucgggugaucugugugcacauuacaguuugaagagauaagacaccaaaguuaacuauuuuuccuguuaucacauggcaaguagaucuccaguccugagucuggguugcauagcuugugauguugauguugcaaagaugcaggugccuucuuuucccaugaugaugcagagcccccucagcuccuguuggagccugugauggucucuacacuccguguuuuucuucuuaggcucuuuaucuguaccugcguugcuuuugucccuuaagguuuugucccuuugauuuccucuuaagugcucugaacuuaaucauuuuuuguuucuuaauuuuaacauggccauuucagucugaugacaguuuuauaaucaaaacccacaugcaaucgauuaauaauguuuuauaaagcaacaguugcuacgaaaaaaaguggaucuuccugagaugaggcuauauguaaaauauggauggaauuuguaugccaauugggaacugauggagaaauguauuuuggucugacauaaaaguuccuuucucaaacuacuuucauacaacuaagcaaugaaagagcagagaauucucaacuugcuucacuacuggaaaguaaagggaaauuuauggggguaauagugacauugagaaguaguucuuuaaagaacugcauuuuucauagguaacuggaaacauuuccagcuuugaaaaugaacagauaucuuuuucucucauguuuaguaaggcuuuagaaaugaguaggaacaauuugguagaauuucuuaccuguauuucaaaacaugcugagucuacuuguuaaguaagauguuuuaaaagcauuugguccuuggaauucugcuacucauaagaaugcauuucuagagccgggcgugguggcucacgccuguaaucccagcacuuugggaggccgaggcaggcggaucacgaggucaggagaucaagaccauucucgcuaacacggugaaaccacgucucuacuaaaaauacaaaaaauuagccaggcauaguggugggcgccuguagucccagcuacucgugaaucugggaggcggagcuuucagugagcagagaucaugccacugcacuccagccugggcgacagagcgagacugcaucucaaaaaaaaaaaaaaaaaaacaaaaaaacgcauuucuauaaccugcaccgauuuuguagaaauuagugugaucugaagcuaguuguccugaauaugcuuuauguaaauauguguggcucacucaaguaauuuucauucuuuagauuacaucucucgaucuuuuuggauguaacuggauuugcuggaguuaagaaagaacguugucauucccccugcccacccccaccuuccucggcuauugauguaauaaauguaauuacgguacuaagaaauccuuuccagcugaaggaacaaaccacaaagucugugcuuuaaaucuuuguaauuuuuucuuuccguuuaaaaucuaagccauauauucagauuugggcgugcuuuuugcaggugucuauuuuuagagcuuucccuguuuuguaauuucccaguucucagucaugaguauuggggaaaaaugcacauuaaaauugguuuuuacuuuuguuuuauuuuaaaauuuguuuugaguuuuauaacuuuaaaagccucgugcauucuuuucacagcuuccagccccaggaacauggcaauggaacauguuuauugccagucuagcaucuagaaaaagcuaacuccuggaugacacaaaguaaaugauugcaaaaagaaagagagagaggaagaaaggaugacaggcaggggaaagaucagggggucugaccacagagguggcgcauuuuacugaauuaagcaugauaguuguugcccaggaaggucucacagagggccacauguggggucagagguugccugucacaugugguuggcagccagaaacagccauagcaaggcugaggggagcaucauucauuuuuucauucaguuagguuuuuguuuuuguuuuuugagacagggucucccucugucacucaggcuggagugcagaggugcaaucuuagcucacugcagcuuccacuuccccaggcucaagggauccucccaccucagccucccgaauagcugggacuauaggcacacgccaccaacacccaacugauuguuguauuuuuaguagagaugggguuucgccauguugcccaggcuggucucaaacuccugagcucaaagcaauccgcuggccucagccucucaaagugcugggauuacaggcgugagccaccaugcccagcuucaguuaauguuuauugaguucccucccuggguuaaggaaugauacuucagcuuuaacagugagggguaggcgccaggaucagguccugggauguguggcuguauuuuucuggcaugagcagcuuucucaggcauugguucuuuccaagcaggaaaguuuauuagaauuuugcacagaugcgguucauuucacccaggauuuugucuuaguuuuagcagcagagacagugaaucucacugggucuuaaucaggaaaaggaguuggccguuaaaugaccucaggaguggcuucuggcuuagacccuggagaugccgugugguuugcuaaggaucaacuagcucaugacaaauacuagaagagacuuaauaaaucuggaccuuucuuuaccaauccaaguugcuugaguuguaaaugauguaaaaauagcacccuacagacacuaguuguucagggugaaaucucuuauuuccauuagcccugauucuagagaagaguggagaguuggccuuaggugcccucuuugucuuugacuguauauguggcacacuuucuucagccaauggaauggcauacguuguaugccaucugcaagagccugauaaguugcauuacaaauagagugugcaaacaauaguacugauuaagugacaaauguugaggccugggaacugauuuuuggcacugacaaauuaaggcagauuagaccgccuuucaggacacuuuugauaaugcuacguguaugugaaagaagaagguaucagaaaaaacuuaauagaguuucuuagcaagaguacuggaacauaauuguggaugccuaagaggaaguguuugagucaggaaaauuucaguuguccugaauugaugaacgagucucuuuuuaguaaaugcuucuuuuaacggucaugguuaguuaggacuuagagacaaauuacagaguagcuuauuguuauuucuguuguuguauaauaaacuuuuggagaugaacuucauuaaaugccccuggucugguuuuguuggugaaaagcugaaauaaaucuauuguuguuaacaucuguggugauauagacuugaaauuauaaucuuagcauggguuagaggagcugugagaaacagugaaaauucauauagcacuuauuauacacaguguaugaaauuaauaaucucugcauccuccucccaauugcugaaauuauucuuacgguuuccauuucauugugguaccauagaguauguaagggaugcuggggcuaagacuauuagcauuaugggaauauuuaaauauaauuuaauaugagaaaaaucagaggaaugugcaaacucuaggcuguauuucucccuaauggguaaauccagucauauaucucugacagaauuguaaaaacacugaguuauuugaucuuuccugacugacuuaucuuggagucauuuauauuuauaacaugcugugcaccaaagcaugaaaagcagaagcauacaguuucgcucucaucugaaguaauaaaauauuuuuuauuuacauagucaaucugggauagauuauaguagaaaaccccuacaaaucugagauacugaaagugguagccguuuucagagauaaauaaguaaccuauuagccugauuagaugucuuugcuacucacaugguaaauaaggcguaacuuugcuuguuuacuccuuuaaauuuccuuauagauguacuuacuuucuuuuuauauguuuaaggucuuaguagaauuucaucccuuccuccagcuuuuuauuguauaaaauguuaaauguggaaaaauugaagaauuuauguagcauagcacaucuguauaucuacuaccuaaauuaauuaauuaacauggugcuguauuucguuucucucucucugucuuuuuuuuuuuuuuuuuuuuugagacagucaucucgcucugucacccaggcuggaaugcaguggcgccaucuccguucacugcaacccccgccucucggguucaagugauucuccugccuuagccucccgaguagcugggauuacaggcgcccgccacuacauccagcuaacuuuuuuguauauuuaguagagacgggguuuugccauguuggccaggcuggucucgaacuccugaucucaggugaucugccugccuuggccucccaaaguguugggauuauaggugugagcaaccgugcccagccugcauuugcuuucucuauuuguguguguauauguguaugugaagguaugcggauguguguauauauauauauauguuuuuugcugaacaguuugagauuaaucaggguaaggagaugucaugaugcuuacccucucucucuauauauuuuuuaaggcagggucucacuaugucacccaggcuggagggcaguggugcaaucauagcucacugcagccucgaacuucugggcucaacuaauccucccaccucagccucccaaguagcuggaacuauaggcacaugccaccacaccuggcuaauuuuaauuuuauuucuauagagagaaaucuuaccauguugcccaggcuggucucagacucaagugauccuccugccucagccucccaaguauucagauuauaggcaugagccacugugccuggccuaaguucuugagcaucuguuuccuaauaguaagggcauucucguacauaaagacacuaacauuucaaaauaugaaaaaugaacgauaauuuucucauuauaucugguauccaguccauauuuaaauuuaucuaguugucuccaaauugucuuuuauggcgauuuuuucuuccuaaauucagauacacagugcucaugcauugcaauucauauuguaguccuaaacucuuuuauguuuaaucuagcaucuagaacaguucucucacuuuuuuuuuuuuuuuuuuuuuuuugagauggcguuuugcucuugucacccaggcuggagggcaauggugcuauauuggcucacuguaaccuccgccuccuggguucaagugauucuccugucucagccuuccgaguaggugggauuacuugugcccaccaacacgcccagcuaauuuuuguauuuuuaguagagacaggguuuuaccacauugguuaggcuggucucgaacuccugaccucaggugauccaauggccuuggcuucacaaagugcugggauuacaaguguaagccacugugccugggauuuuuuuuuuuuuuuuuugacauugacuuuagaaagagaccaggccacuugccuuggaggacaucccacauggaggaugugucugauuguuuccuguugaggcuguucaguuucucucauucaugauuuccuguaaacuggaaguuaggccagaaguuuggaguuuauuaguucaguuaaucuuuuuugggaagaugagguagaggagauuaagaaaaagucagugucaucuucgcagagugauuuuucuuaaaacccuggccucugugauauugagaaagucacaauauuggaaggugacacuugucaacuucugauuagagucucuuccuuauuuuaaaagacaugaacuaaaaguugacuggguuuccuguccuccccccuucacccuaucucuuucuaucuccucuucuuugcucuuccauggccaugaguaugugccacuaauaggacauuuucuuacaauguggcaauuuccuuguauacguuuaugucuagcccaccauucuaugagcugcugacagcagggagguguugcuuuuuuugugauuucuugaaacccaauauaauucaguguuaucacaggccaauuuauuaacauuuaaaacucucuucuuggccaggcgugguggcucacaccuguaaucucagcccuuuaggaggcuaaggcaggaggaucacuugagcccaggaguuugaggcugcagugagccaugauugcagcacuacacugcagccuggauaacagagcaagacccuaucucaaaaauaaaauaaaauaauaaauaaauaaaagucucaucuuaaauuugauggggaaaggaauuuucuggauccacaacugaauugucuaugcuuggcaggcagauguuuucucaaauggugaauggauucaccuucuuucucuucccuaguuuagcuacuuucacucccuucuagucuucauauauucccaagugaagugagaagauaggucuguauaucagugacuguccuuuucuuuuuucuuuucgauuucucuuuuaggagcugagauguuucuucucugaacuuuauuuuucauugcuuauggcuuuuuuuuuucccccuguaaguucucugcgagcuauacaccuguggaaauauagggacucuccuucauuuucaaagagcucagaauaucggugagacaaagucccuuccugccuggacauucagauuggcccuauggacuuaaauugucaagcaaguauacuuuuuugugugccccgcaacuuggccuaaacuuugcuauaaauggcaaaguuacugaauugccuuggcuccauaccaaauguuggaaauaauuuuaggauauaaaaacacaucuuucauaugaaaguauuucuuuuagggucccuugauaagcauauauauguguuacucauuuuccuaaugaauuaguuccuuucuucaauuguaaggauaaacccucauuaauaucuaauuuguuggaaugaaaaugauuccaguaacauuuuuaugacuucaaugugacucccuuaugaaaaggcauaauggaauggcuacuuuaaucaaauuugaagaaaaaagaaauauuauucugaauacgcacuucauaaauaggaaaggcaguuuucagcauuuacuuuagguaucauuuauucagugagagcuugaggguaacccccagguuccugcaggcaauuaagacgaaagucaugauuuuggagagcucuggguuuaguaaaaccacauuagauuagaguucuuagaccaggaaggggcccuagaaaaccaucagaucaagccucuugccuuuaggcaaauaggauacuaaccccuguugacagacaagcauauuugaaaccaauaaugguguuuugaacaaaagaaaaauaggggcuuggagccuggguuuucaucuuuuauugcacucuuccuacuguaauuauaguuuuauuuuucaauucaauucauuggauccgagaggagcucauuuaucgauuugcaaccuaaguauuagccauggagucauucuugaacuuugccguggacuugggugaaaaauguuucugguuuucaaggcuucccuaguaucauaugguauuggaaucaaaaauagaguauuguuuuaaaacugucagcauaggcagaacuucucauccagcaacgcauuccguagcucaaguccucauuuugaacauaggauugcaaugcugagccccuaccaucuuuccacuggaaggaacaguugggcagcuuuuuaagguacggcgccucguggaggacuccauuaaugaggaaucauggucuccugacuuuggauugaucauuuuuguucaaaacaggaguauuccugagucagagucagccacagcuuauaggcaacaauuuucaggagacaacaucccaaguuaacugcuuauggcccccaaaacuguaaggcuugugauagugccccagugaaauaugccacuguggcauucccauccuuuuagcuccuggauuucuccuuuucagcccauaauaggcaagggcaaguaagggaacuaacaauuauaugagcacuuccucugucccacacauggugcuaaguccuuuaaagaaaacaagguuuucuucacugguucucuauggccauuauuagagaaugcuggagucacugaucuggaaaaaccuguuuaauuccuuggucucaauuucuuaucuguaaaaugagauuaaauugguaaaauaugugaagcacuuaaaaaguauguuuuaaaugguacuuaguguuacccacuucauauacauuucugccagcucuaucauaccuaaucacucauuugaucaugucauccucuucccagucucuguucuuugagcugaagaauguuuggugauuccuggcugcuucugggcaaaacuccuuaguuuguugugugaucuggccccgucuuaccucuuuagacugauagaucccuucauucucgcauugguauuaaaaaucaauauagaccaugauuuuggguuuauggcuucuguaaguuugugagguuucucuaccuaaaauucccuuaccaccuguccuccuaugucccuucccucuacagucuccaccuguucaaauccccaugucccuucaggacacgggucccagccucugccccaauguagccuuuccugcuugccuuuaaacugggaguaauauccuccuuuggauuacuagcccuguauuuauagcuguuuugaaacccuauggaaguguaggcuuugaaucaucaaaaaguauuaagugauguucaguacuuccauuuacucaguacuaaaguucaucaguguauuuucaaacauuuuucaacaagacuugaaauaaaaaaaaaguuuuuccuuaagagguuuuuucuuucuuucuuuccuuuuuuuuuuuuuuuuuuguccauuugacaucugaauccugaauugacuagacaaauuugguuuuucuagucagugguuaacugggacaugccauucuucaaacauuucuaggaaucccaauaccuaguagcugauucggucgugcuggagaauacaaaggcaguaaucaaagagccuacacagagagacacugaauuuuagaaccaggauaaaucaaagugacuuuagugaaacgucaccacgaucugacgugaucugaauaaaccacaaucucagagagugaggauauguuuugaguaaauuuguucuguguguuggcgagaguggcugccuaguuaaccgugggcaggucugugaguuugcggcaugccccuucguuccagcugcuugcugauaggcuggcccaggcgggauccauccuucugaucgccagguccugaugaggcuggugccaccacuacauccauuccagggagacucccaaucucugucaguuucuucugcuuuucugaauucuaaacucacucugaucugauuucauuauuugucuguugugguagcuuuggugaaguuggaccacaaauaaugauauagaagaaaaaaugaacuuuuuuucuucuuuccuguguccuuuuaucagguaucauuuccucuauaaaacuaauuuuaaguugauagagucuuaggucuauagccacuguugaaugcaccuaaucaggccaucuccuugaacuagagaauguuugcaucauaggauagauaccagguucccugagagguggguaccaggugccugggaagugaaguaacuugccaagaacagagagccagggagugacauugcaggcauuuaagccuaggcagucugagucccgaaaacaagucaagacauuuauugucuuuccauuucuuacccauguucuuacuguuuugccuggacuccucuuuuaaucucagugaaaaaaaaaaaaaaaguacauauuuaacaacugaagaaaauaaacagagacuguaguaaauuuccaagcuaauagcaaguuauguaaaaaauacuacuugcugaugagguuuguaagaaccuccuagaaccuuauagaacaaguguggaauacuuguuuucugcuaagggcuauugaccccaagaaaauucaaugaagcgaucuuugcaaaauaguaaaugauuuuucuuugucucccugcagaagcaaagaggcuuagaccucuagccacuguugaaugcaccaaaucaggccaccuccuugagcuacacagaauguuugcauuauaggauaggugccaagugcccuggaagguugguggagagagagaugacuuccagcugagauuguacaguagaauuuaauauuuaaaguuucucgauuugacggggcugaauuaguucauaugaguucauaaguaggaacugcuucgcuuaauuuuggugaauaaaauauccuggcugcaaaauacaaaaaagaaagucacccucauuuucaaauguaugguuagugcuuuccauagaaaacauauggcuaaauguguguguuuuuuuaauuuagcucugaaaugugaagacuguaauaagaucuaguaacaagagcgcaguuuagaaaaaccugauugacucuaguuuauguaacuauacaggcuauauaaagaaagucucauaaaugaacuucaucuaaagaguguggcagcuauaaccuucuccaacuuucaggcucuggguguucuccuagcuucuucugaguuuauagucuuuauguaauuauuaauaccaugaugaucauucugggguuugcuuuuugcccuggucacuuuagguuuaauuuuauuccauuccuggucauuuauaguuuuguucugucaucuccccauacccaucgagaacccuauucuccuguggcagacuuuaaugaauguaaccgcagauuauguguuuucuuucuuuggugaacuuagaggaugcauaggccaggugccaaguguuagaagaaaccauaccuuuccugauggugcugcauggcuagccuaccccgaccaugcaguaagugacuuccucaccgcugauguggcagaccugcucugcaucuccacaggguuucuggguucuuuuccaggcuguuuccauauugcacacucagacuggguaggaaagcaggcagggcacaguuuuauauguacgucagcauuuucacuuggugauggauauaagcuaacuuuuguagcucuccuagguuuauuacugacaucuguuccccccugagcauauccagcuggggcugaagccacaucugcacuuuaaacuuccaucuaccuuuauguuuucaauguaauuuuagauuucauuuguuuuuaauugugaacucagaagagaugaguuccagcuaugacucagugugaguuccuaugucauaauucuacauuucuggagugcuuacaccugacaggaauaaacucaaggaaacaaaaagaacaggaaaggccuuaggcacauacugguuguucuagauguggaguucugcuggcaacugccacagagugaaauuggccacauggaauccaaagcacggccucacauuguuuuuuuuuuuuugaauauuuuauguaagacagggauguuaaagguagaggaaguaauuaagaauggcagcuaugucuuuaaaauuaaacacaucggucauaacuuuaaugaagguguaaaaguguuuuuaguuuuaaacaggcaaaaaggcuuuuaaauacaaguaaccaguuuugagacuuuaaaaagcagaaguuuuucaugccagugcuuccuauuuuaguuucaaaggaaaggaggaggagcugagguuuggaugguuaucauagaugagggaguugacaugaucaaaaauguuuuuuucccugggaacacaucuugagugcuuaucucuucuaauagauaaagggcuggugaauuuugaauguuuccugcagcucugaagaaacacugugauccuaaugaacaccgaggaaagcuuguauugcagcccuaaauauuaccugcuucaaggaggcagcauguuuugguacagucugaucaugacuauaaaucaaagcaucuuuacuucuccagggagauaaaaaaaaucauguguuacuuuauaaggaucuuguaguugcaguaugucugucagauguuuccauuuuuaugauuuaagacacuuggugcugcuaugaauagcaaauuggaaaaauugggcauuuuuuaaauuuugaauuuuaucuuagcauauaucuggaaaugaaauagcgaucuuggaacagagacaucuuuguuagaauaugaaagaaugucagugaauucuaacuugaagcuacauugagaugacauguuaaaggcaugaauagacaaagggaaugauuuucaggaagugccuucuggagacugugggaaaucccgucauggguagaggaacagcuugcgauuggaucaaagucacgcaaaguuacgcaggugguagaugcugguagucaacauggcuagguccauggcaaucgaucauuugcccagcauuuugccugcugaauuugggggagugaagaggacauuuucaccaccccaggaagauaguaacuagugcucuauguauguagcucagagcccuugaauuuucaagugaccuuuuaaaaguuucccccagaaagguuugaauagacuuccuaucuauuacucuaaguuuaggucuaagaaaauucccaaauggguuaauacagucgauccucaaucuuugagaauucuguaucugugaaauuggccuacuugcuaaaauguauuuguaagccccaaauccauccgugaggacucuuuguggucauugguggauauguacagagcagcaaaaaaauuugaguagcucaagguacacguacccgguggagguugaacaaggugacacucugccuucuugccucaguucucauacuguaaacgaguguccuggaugcagacaauucagugccaugucuucugcauuuuugggcuuuuucuuggugauuucacuguuuaaaauggcuccccaaauauagggcuaaagaacuguccaguaggacuuuuuuuuuuuuuagauggagucuuacucuugucgcccaggcuggagugcaguggcuugaucuuggcucacugcaacuuccgccucccggguucaagcaauucuccugccucagccucucaaguagcugggguuacaggcaucagccaccacgcccggcuaauuuuuauauuuuuaguagagacaggguuucaccaugucgaacaggcuggacuugaacuccugaccucaggugauccaccagccuuggccucccaaagugcugggauuacaggcgugaaccaccgcgccuggcccuguccaguguuuuuaagugcaagaaggcugugaugugccuuauagggaaaaauacauguguuagcuaagcuuucuucaggcaugggcuuuagugcuguuggcugugaguuuagugucaaugaaccaacaacuuagaucaaauaagccauuuuuuuuuuaaaaaacagaaacacacauaaaaugacguuauaaguugguugaugaaaauuuugugaccagaggcuugcaggaaccuaacccuguguuucccccagaagcuaaggauuaguauuuccuauggcgguguucaaggcaacuucauagacagaacuaccaucaugaauaacaaggaucacugugugggcugagugcgguggcucaugccuguaaucccagcacuuugggaggccgaggcaggcagaucaccugagguaaggaguucaagacuagccuggccaacaugaugaaacccugucucuacuaaaaauacaaaaauuagccggucaagguggcgggcacccaauaaaaugacaauagaguuuaaacuccaugguuucugaggcauuuucugaguaaauuggcauacagcguauguacucuuuccucuagaaguuccagaaacaacacuauuucuuuaugugcaaaauggccucuuuugagcagcccuggggcaguuuugucuggcccucuugcagccagggugccccaguuuaguguacaauugguauaaaaauaggcaacacaggaacuugcuugucucgggggaaaagacgcuugcagauuuauagaaauuuuacauuuguaugcaugauauucuguagguucaagaaaaaacaauucaauuucaagauaacauucuacaggguaaauaaaauuuaauuucaauaaauuuaaggggaaaaguuguccaucuuucuauacuuucuguaacuuuuguaguuucaccacuaacaacaacaaaaaaaaaagaacacaaacaaaauagccuugcucuggguuuugaggaaaugguuuugcaaggcuauuugguuagacaaugaauuagagucagaacuuccgggaugggcuuucgguaagggaaaugcuuaggcugcugcaaagccuggauucaacuuacacaggauccuugagaaguuguucuucgcauccagaaccaugggcaaugcucuaugguauaaaaaccccgaagguaaacacugucugauauauauuuuuuauaauugcaaaauacacauaaacuuaccaucuugacuguuuuuaagugugcaguuacauauucacauugucgcacagucuccagagcucuuuucaucuugcaaaacugaaacucuguaccauuaaaugacucuucaucucccucucuccagcucagccccuggaaaccaccauucuguuuuccaucucuaugaauuugacuacccuagguaccuuauauaaauagaagcauagaguauuugucuuuuuaguauuggcugauuuuacuuagcauuauauaauguccuuaagguccauccauacuguagcaggugucagaauuuccuuccuucuuaaggcugauuaauauuuaauugcauguauacaccacauuuuguuuauccauucuucugucaaugaacauuuggguugcuuccacaauuugacuauugugaauaaugcugccaugaacguggguuugcaaauaucucuuugagacccuguuuucaauuuuuuuuuguuguuguauacucagaaguagaauugcuggaucagacgguaacuuuauuuuuaauuuuuuugaggaucugccauaauguuuuccauggugguuccaccauuuuacauucccacccacaguacacagggguuccaguuucuccacauccuugccaacauuuguuacuuucauuuuuuuugguagcugacugauaauuaugacuaaauaauauuguugaagaacuauuacaaugucaagaaauuuuggccaucagugauagucuuaugauuaaacuuaguaguauuuuauuauuaaacuuaguagcauuuauuaguaguaguuuuauuucagaaauauuugcauuuuccauguuucuagccccucaauuauguagguagaaacaaauaauauagaaucaauuuaccuuauguuaccuuagaacuguggccacagccuaguaggugcucaguucauuuuuguuaaaugaaugaaucaaugaccaugaagacaguucagguuauuuguuauggagauacguaaugggauuggaaaacauguaggguaaauguauuagcccucuccuguguuaacucuuuagcccuuucaaaacuaaagguauuuggccaugugcgguggcucacgccaccgaucuuaauuuuuuuauuuuaaaaauagcuuacuuaaaaaauagcuuuguuguauuaaaaaauagcacccagcuaauuuuuguauuuucaguagagacaggguuucaccauguuggccaggcuggucuugaacuccuggccucaggugauccacccgccucaggccucccauagugcugggauuacaggcgugagccaccacacccggccaggcuuuuuaacauaguaacauaaacauuuuuauucucacaaugucuuuaugguuugggaaugguggcuuccugucuuucagagucugguguuauuuguuuuuuuggugugugccuugcagacaccugcacuugaaaucuuucagguauuuugcagucguuuucucagauggcuggauuauuucaagccaagaauaacagaguuagggucaagacugugaaccguauggucaguccuucuaaggaaguauuuauuuuuauucacuuuuguuugccuuuccuugggucaugguccuaauugcuguucccuuuggcugcaguuauucaaaacugaauuuacugcugagccuaagacaguguuuuucaaacuuuuaaaauuaagacacccaguaagaaauauguuuuacaguuuuuuuacauccugaccagauuuacacacacacacacacacacacacacacacacacacagaaccugaaguauuuguugcaaguugcagauguuuacaguuacugcuaaggauauguguuuccauuuaauuuacauaaaauacuguucauugaauugauuuuaugacucacauuauuucaucaugcaguuuaacaaauacugagcacuggugucacagaacuuugucguucaugcucuuuagcaacagucagcuuuucugcucaugacugauggccuauugcuaugauucuguuagcgcuuuaaagcaauuugauugucaaagucauguuagcucugguuguguauucaguuacucaguuucaccuuuacaggcagcugcuccuugggaaauggggcuugcugagcagguugaauguuccauagaaucagaucuauacuuuggggaacucagcaguaugggaaucacaagccaacccacccuauccguuaaagggcucaggcccauuggucuccauugucacuuagacuagcacaacaucaccuaccucauggaugcuuugagggcagggccgguuuuguuuuucuuuuuauuccucagagcccgcagcaugauuccuuguguggagaauaugcaucagccuuggcucugguccucucuucacugucccucuucuccucccuacagaaaacagcaaagcauguauagaaagagaugugcagacuguguggaaugaccugagggguaacuugcuuagaggguagagacuguuguguguaaaaacuuauguuugaggcaaauugcaggaaaaaguucuuuaaaugaaggaaagauaagauuauaaguuuuuuaaaaaguugucuuaaugaauagaggagaaugacuagucauuauuucauagaucauagguacauaggugauuuuaaagguugagugacuggucccuugagguuaguucaauguccucuuguaaucugaauuuuuucaucaaauucuuuuaaauccagguggggcucagcucccucugaaguaucacaaaacccuaaaugaauuagguuaauaagacuaauuauauuuccauagcaauguuuaaguggccugcugcccaaucaccuuccaagcccugcucuguuggguuucuuuuuacccagucaugaucacguaggaccaggcuguuuuucguaggggguuauggagucgcaaugccugggguguuaggaauauaggcugggcuuguaucauaguacccacgccgcugccuaacucuugauauccagugacugaguuggacuuuguagcugcuuucucuuuauuaggagaaaagagcuuguuuaauaaaccuaagaauuaauagccuguguucaguaguuggauuuguaaccugaauguuuuuaugucuacugacuugcaacguugucauauaaauuaaagaucauagauccagcuaugguuuaaaggugacuuccaggacauggauuugaaagaucagaauuugaaucucaucucuuuccauucuagcuugguaaccuugaggaaaccacuuaacuucucuaagccucaaaggugucaaguagauuaaugcaacuauguauagcugacccugaggaauuuuugguuccgcuagaauaaagcuugaauuuuuggacauuagaaggaucuuugaagaugauguagcuucguuguguaacugaagaccagagaaauuuaagugaguuuccuggaauaguuuaugccucugcuuccugugucaugauuaccacccagaacacgugcuuaauuggggacagguaauccauucagggugaagaacauggcuuuugggucagucugcaguggaucuaaaucagcccccugcuguuuacugugucuguagucuagaaaaagcuauuuaacuucuugcagauuuagccuaacuaugaaauuaaauuggggauuuaaaaaaacucauagggacguggugaggcuugacugagauaaauuuaugcaaagcucuuagcacaauggcuaguacccagaaagugcucaacauuauuauuauuuccuaauugaagggcauugaugauuuaaaauaaaauggaggcuggguacaggcucaugucuguaaucccuacacuuugggaggccgaguuggguggaacacuugagcccaggacuuugagacuagauugggcaacaugguaaaacuccaucucuauaaaaaauacacaaauuagcugacugcgguggugccuguagccccagcuacugaagaggcugaggugggaggauggauugagccccggaggucagugcugcagugaaccaugauugugccacugugcuccagccugggcaacagagcaagacccggucaacaaauacauacaugcauacauacaugcaugcauacauacauacauacauacauacauguaaauaauuaaauaacucauuucuugucagauaaauggcuguaucuuuauaauaagauaucuguauccugugacuucauccuguaaauaauuuugugccucuugugcuuucuaugaucuagggaggagaaagcuaauucuucuucauuuuaugcacggagcagagacacggagagccucuaauuuauuucuucuugguguggcccuguuuucugagcaugggugugucugaucccuggggagagcagagccacacuguggaucugaggugcugggaagccauccaguuuccuccuccugacccugacucaagucuucccugaaaucucugucagccccauucucuuucugucagccccauucucuuucugucagccgcccuccuuacauaacccaaauggguuguuugcaaagcuagugucgcugagguguucuguguacaacagaaaagaaucuagggaggauuccuaugugucacuaaagccaguaauuaaguggacaacagggggagcuaacacugaaugcaccaauaaauuucaagacuccugcuacccuagguaaccgagucaauaguauuagaaaccauuuuaagcauugguaguuuuaaacaugcuguuuaaaaacaauuuuaaauuuaccuucacuuuucuaauuggauacuuuacuauucagaguacuaugagaugagggucucgcuuuggagugcaggggacugaucuuggcuuacugcagccucaaucuccugggcucaagcgauccucccaccucagccuccugaguagcugagacuauaggcucgugccaccauagcuggcuaauuuuuaauuuuuuuguagagauggggucucacuauguugcccaggcuggucuugaacuccuggccucaagcaauccuccugccuuggccuucuaaaauguuggcauuauaggcgugagccaccaugcccggccaaacuucuuuugaaauuagcuuguugauucuuccucaccucccaguuguuuuugugccagaauuaauuuuucuccuuguauuauagaauaguuuggaggaguauugaaagaauuaggggguagaguugccagauguagcaaauaaaaauacaagacacccaguuaaaugugaauuucauauaaauaacuacuuuuuuuuugcuauacauaugucccaugcaauauuugagacauacuuauacuaaaagauuguuaauuaucugaaauucagaucuaacugggcauccuguauuuuaucuggcaacccuaacugggguggggauggugaggagggccuuggauguggccagaggagaggugucagagccucaggugucuucuugugggugaccgagguggcugcagcacaguagccuugcucccugggucuggggccugugccuucucccuguagucacuuagaauaggaugauggggguggcucaaggcaguggaauaaauuaauucugaaggaacacacugggccagaguccuagaacaguuuacuuaaugauaguguuauuuuaauuuucaauuguuugccuuucuucccugugauacggaauaaacaugaaauuguaucuggagcggagcaggcagaacuuacaucuuguuggucuuguucugcccucagccucugauguucuacaagguuuauccuuuuguuucuuuuuuuauuauccaaggaaugagauaugccagaaaaaugugacagguauuuaugaaaugcuuugaacuaggugagcuuagagcauaaguaauuuuaggucauuuaucucaucacaacacuaucuacagaguuuuaacccuuaucauaaggaacagaccaugaugacacugacauuaucaacauaacgacacacaugcuuuucuauuccuaaugcuuuggugagagaaacuggggcaucggagaauguucucagccauauuuuugauauggccuaagguauaaugaacaaaagcuuagaugagaaaaguccaucugauugaugccuggcuaauugacagccaauuaugucauggugccaguucuuaaagaaauugacccauuaaucccuuuguguggagaggccagccagcaggcaucugcuuucuuagcaugcagcaguacugaaaaguuuauugaaauaaucgucaccuguccuuuccaaaucuuaauucuucugaguuuaaacauguuuucucuaaggaaagucggauugacaugaaaucacacaugucuggaauuaucucugaguccuuuauaaacagaccaagacuuggaagggcacaccuuagguuacagaguguuuuccugggcugggcuccaaagcuuccugacuauugaacaauaauguguucuuuccaugcuacuuuauauauuuauuuuacagaagccuugugccuuuuauccguucauauccacuuugaaaacuuacuuguggccugccagagcagagguacaaaaaauuccggauuauuuucuguuuagaggccccacacaauacaguauaugugcugaagaugagggcacuccuccuccuccuccuccuccuccuccuuccuauccuaccccuuccuccaccucauuuuucuucuucuuuuuuaaaaauaaucauaagcauguguuuucuucucaugugcuuguaaauauuuuuguuggggauucuugacugggauuucagaauauccugauagggagaaguuggguauuucuucaugagauaaauuccuuaaggagagauuugaauaguuuugaccuuuggguuuucuuuucucuuucaguuuucuuucuaaaaaauguuacauuucuugguuaugagauaaaaacaaaccuauaauuugugauaaugggugaaaaugugauuagaauucacauucuagguuuaauaaugacagacuacuuaugaaagauaagaugucagagcuggaaggcuucuuagauauugucggguucaauauucuuuucucauuagaggaaauggagacucagagacaugaagugacuucuccaaggucacacaguaagugagugaugaagcugggaguaggaccucuuuugccugacuccaaacacagcuuuccccaacuauugaggaaaaggacucaggacaauuuaacauuucaagucauugaaauauccuuuaaaugcucaaacucuaauuuuaaccuuauguguguguguguguguguguguguguguguauaagucguucuaaaguacuuaaccuucugaaaucuuauuuugaccauguagaacacaguucgaccuuuuuucaaucucaucauuaucaacacuguuuugugaacaugggucauugugguuuuaauucaugggugcccuugggcuauucugagucuauaggacuugcccuuaguuacauuaacacucccacaugacaaaacucaugagugcauggggaacuuuuugauauccuuccucauugucaguugucacuuuuugcuacuuucagaggugauauuuauagcauuuccccccuucuguguuguuccuacccacaggauuuuaacuuacagagaugacugaaugaugacacagaggggacaaguccauugaaauaagucuuguuuuguuuuguuuuguuuuguuuuuugggacagggucucacucugucgcccaugcuggaguacaguggcacaaucucagcucacuguagccuuugucucccagguucaagcuauucucccgccucagccuccugaguaguuggacuuacaggcgugggccacuacgcucggccaauuuuuguauuuuuaguagagaugggguuucaccauguuggccaggcuggucucgaacuccugaccucaagugauccuccugccucggcuggugugcuaggauuacaggugugagccacagcaccuggcagaaagaaauuuuuuuuuauuacucacauuuccuaagagaagagggcauuccaugccacacagggccaggaggagaagcaccuauuugggugaagaggaagagaugggagucaggggaaagccgaggccagagccuuuacuggguuuuuauggaaaaggcaaggcagacuggaggaaucagcuugggguuggcuaggcgcugggauggucuuuaguugucaguuccuggcccugagagauuuagggcaggggaaaugugggcuggguaacugagaguuagauaaggagguggcucagcuagaucacagaggagauggaaacuacuuggcuguuaacuugcccuguaauugauggauaccaaauagccaaauacagauucggagaaaaugcaggacaacuucccaggcuuacuuugcugccauucauuuuguggugaaccaaaaaaccacuuacacaaaccuguuggaaggggucucuuuugugaguacugucaaagagagcuaucuagaagagaccuuuuuuugugaguggugagguuuaggcugaauuuuuauuuuguuuuggugcuuuucuguaauuugggauuauuaaaaacaaagacuagaccuuuuuauagauagaaacaaggcucuuuuauuuggaaauaccaugugcauaaaugaugaauaaauagagucagugaggaccuucuugcccucaugauucauuguucuucuccuucuccuuuuucuccuucuccuucuccuucucuuucuccccuuccuccucuuccuucuucuucuuuuuuuuuuuuuaauaugagacacagucucgcucuguuaaacacuuguauuaguuucauugaaaguguaauauaaaaucugaggaucucagacaucuuaggaagaugacugucauuuauuaucuauuaaccaggugagcaacuuccuggcgagugaggggugcggcagggaaggguggagacgcaaaggcacaguucccuuuguaauggagagcuucagcuccugggaaggaucugcaaugcuuaguggggcuguucaucucuaauauaguuaauaauuacugauuuguaugaagcagaacugagggcagggagggaugugggaaggccacaggagauaugaguuugcagccagaguuuaccggugaugaaucaccuucugaucaaagcaggaggcugggaccugugggggaugcacuucgacccuggggugugacccaggaagucagugauuugugaagggcaucauaggucacagaugccuuuccaaaguuaccagaacuugggauccaauuuauuucucuuaguccaggcucagguuugauucccaaucccuugcauucacacgagucacagggcagaaaagugcagacguguucuugugcgaccuccagaugugguguggagauggaagaugguacucucaucauuagagcugauuugcuuuggaauuaaagagagacauacgcacuguguuucuguggcccaucauaguuuccacugauggugccaugugucauuugggguaacauugacuuguauuuccacucagugugaggaaaggaccauaagacagaauuggaguaauuucuggaaaaaagaaguaaaugcuuaguagagugucauacagucuuuuaauaacaaguauuugauaaacaugauuuuguuauccauccuucugcaggaaaagaagccaaguuaauuuuccugaguuuacagauuggaggguuuuuaguauaaccugugccuuuuuccuucacccuguuuccucuuuuacuacuacaguaaagagggugaaauuuaguugcaaaaggauaccauugaaauuuaguuacuuuugcucgucucuugcuaaaagaguuaauaaugugcagucuuuaacuuggacugauuuugguauaauguaguggguuucuaaaaauagauuucuuuuucauguaauugacaauuaacuccauaaguuacuuuacagaaauuuaaguuucucuagaaauuacugcaguacacauugcaugcauucuccuuaaagaaaauugacagaacaaaauuucauccucuguuaggagcuugcuuuucccucacuugcucaucucaugaggggaagcauguauuauaucauguaauugaccucccgagcuguauggcacccuugagugaaccagguacaagcagccuccacccaggcauuuucuuaauguccacaaaggcucgcugacuucaaguuagcuauuuguguccuuuaacuuguugccacaauuuaaaaccaggugagcauuuucugcacagaguggucauaagcagugucuguucugcugugcucggccucuuugucaccuguuccauauuugggcaugaagcacuaggcccauaugccuucaccauuuugcaauguuguucugggacagaguuauaggguuuuugccuugaacaaagcaucuacauucuucauucuuagggagugacaguuccauugccaauauguggauaucaguuuucuucaagcuuguguaccacucguauccacugcuguucaguugcauaaucucuaagauuaaaaacuacauuuugguaaugcuggcaacgagggcacaaggaaauaaauugucuguuuuuauaaacauguagcuacugauauuuuuuuuugaaggugaaagcuuuauuuaaaggaaggucucauagagaguuuuaaaauuuuagaaugaaaaaaggucuuaaauuuauuaaccaaauaguaaacuaauucauucaaccaaaagacuuacugaacacucccugagugaagguguguguguuaggaaaugugcuuacugggugaacacaacagagguguuccccaccucaugauacccacagucuagggagugacaggcaauaauuaaguaauuuuuaaaaauuuauagcuguaaaguaaagcaaacuauggcacguccaugaaagagagguuagagccuaugagcggggaggcggggaccagauggagccugggcucaggggcugccagacacacacagcugccuacgggcaggaaggggccccauuggaagcguuaaacaagugucuguauagaaggaaggcaugugaauaaagaaaaaaagauugaccuuugugaguugugacauccaagguguccaggaacuaguuucuccacuuucuuuuucuccuuuuugucauggccggcaguugggcccuuguacuguucaucagcuucaccaucaaaaucaaaugaaaagaaagagaagggaauggaaugcucacuuucuagaccuuacuuuaaauucuguugaagauuuauuaauauuugggagagaguuugaaaugauaauccaaaagaugucucccuuugaacauauguagaaguuaaucauuuagauuaacuugcauuuaaacacauaauuguaugugaucguauacauuuuuuggcucacuguuuuguguucaaaggcagauuuccuaggguagugcugauuuauucuacuucuuuuaggcuguguaauucaccuuuuuucuaauuuggggaaaauuguggucacuauaguuauauauuuuuuauuuaaaaacuuguaauauuuuauuaaguuaucuacccaaaucuuccuccugaaagauaauaucuuuuuuuccuuuuuuuuuuuuuaauuucaguagguuuuuggggaauagguguccucauagcuuagcucccacuuaggagugagaauauaggauguuugguuuuucauuccugaguuacuucacuuagaacaauggucuccaguuccaucuagguugcugugaaugccauuauuucauuccuuuauauagcugaguaguauuccauuaucuaucucuguauauguauauaucacaacuucuuuauccacuuguugacugauaggcauuugugcugguuccauauuuuugcaguugugaauugugcagcuauaaacaugcgauaacacaguaucuuuucagauauguguccgucugacauguucugcaccacccacuacacugcagggcauuuagguaagcagcauuuauaagagugacuggaaauggcuuaggaaaaaugguacagaauguaauuuaucagaauaaucacugauccucuuagcauguguauucaacagguaacugugacucuaaaauguuauuugggagggaauuugcaaccaaaguuagaaacagcucuagaggugcugggaucuaggggccuuagauuuuuucaucucaguuaaucacaccaugcuuuaggaagcuuuaggauaagauucuggugcuaguguccccgguugguuuugcuucugagaaccaauuuugcaguugucacaugaugaguuggauccucaugcagauccuccaagggucuuacugaacaccaucgguuuaugcuagugaggguuugugguucucagcuucccgcauuggaaugaacauuauuugggccugagcugugacagcuuccuucuucagcuuccuuccuuggguucuucugguugggguauggaccacuucuucuggagaacagcagggugguguucaagcaccaucguacucuccuagucuagagcucagccacccaguacuauagccaauagagauauuuggcucaaaaacacaugagagaugguagugugacagaauaauggaauuguaaauuguauuuaguuuuaaucaaaacuuuaaaauugauauccaauauauaugauuggaacaacuugaauaugugagcuuaccuuuucaucucuaaaguuuaugauaaaagauuuccaguaaaaauuuaauguccaaguugagauaugcugugaguguaaaauacaugcuauauuucaaagacuuaguauuuaaaaagaauaauauacaauaaguaauuuuaaaauguugauuauuuguugagaugauaauauuuuugguacauuagguuaaauaaaauguacuauuaaaauaauguuaucuucuuaaaauugugaugacuauaaaauuugaaauugcauagguggcuuacauaauguuucuguuauugggcauugcccuagagcuaacugaggaaaagaucauagggcaccauuugccauuguugucaguauguggcuuucaguacuaggagguaaaguagauacucuuuccauacuaaauacuaaaugccacuaucauuaaaaaacaacauggcaaaucuugcccuuaaggggaccucauuuuuuccccagcaaaacaaaaccgacagccuguuauauagcuaaagaguagaugaaaauacuuaaacaauauaaaugaacuuuauugguuaauaggugcagcaaaccaccauggcacacauuuaccuaugugacaaaccugcacauccugcacauguaucccagaacuuaaaauuaaauauauauauaaaauaaacuuuauuaguuaugcaaugaaauaaaacagagcaagcaauaccuuuagguucacugaauuuuaaaguuaacaccuucaauacaaauguauauauuuuguauacacgguuaugaagguaugaacauauuaaugagcaaaauaauuaugaauacuuguuccucuuuuguaguuuuaaauauguauaagcaagaaguaacuugacaugacauaaugcugugccaccuugccuauucugucgugggcuccaaauguaaauucaucagaagagcucacagcuuuguugaaucuccugccucuuuggggagauaggcucauaugucucaauuuugaagcaccccucuuggaaugaggucaguuagaccacuccaaggaccacucucuuuucuucuuuguauuuucuggggaaaacguauagcuagcaugcugggacuguuuguuuugaaugaguuuguuuaugaguuuucaaaacaaaauuaugaaaaaaagggaaguuuccaacuccuugugcaugucuugcuggcuaagcagaugaucucuaaaaacagauuacaauaucauuuugaagguaacaaagguaucuuccuugcuuaucuuuaaggcugcauauuuuauuguuuauacauuggccaauuaggaacugaaauuuaagaaagacagucauuuuaaccuauugaagucacagaaugaaaugaugaaguaaucguauguguucccaguuuagcauauauguauauauaugcauugaugaauaauaugauuuguuguaaacaaaugaaaaacugcagaaaccuguaauuuguacauuauuauuucagaucaccguaacaaauauuaccagguuuuuaauuuucuuuaaaaaaaugcauuucuagggcugggcgugguggcucacgccuguaaucccagcacuuugggaggccaaggcaggaggaucacgaggucaggagaucgagaccauccuggccaacauggugaaacccugucucuacuaaaaagacaaaaauuagccgagcgugguggcacgugccuguagucccagcugcucgggaggcugaggcaggagaauugcuugaaccagggagucagagguugcaaugagccaagauugcggcugcacuccugccuggugacagagcgagaccccgucugaaaaaaaaaaaagaaaaaaagauuuucuaaaauuguauuuauacucucugcuccuuccccaucagccaucaacgcuucccucccucccucucccuuccuuaaugauaagcccucagcuuugcucaggacucagccucccaugugguuuugguaaguggucuaagaccugaggcccaaagcgugauuggcugaugcugugauuucucagccugguugcgcauuagaaucacccugggagcuuuagaauccagaugccugggcucuacucacagagauucugauuuaauugguguguugcagaaccugacuugagccauuucgaaaugggucauugauagcuuguagcuguaacgauucaaacauauacaacauaagcagggugaccacagaaguuauucucuaagucugguauguuccuaaauguccucuaaauucuuaucuuccacuccagggcuuuugaaguggccugauccaaacaccuucuuuccgacauuaaaaacauuagccgguuauuuugccucaucagcacuuccuacacuuccuuaggugagccagguugcuuuuaaucucuuggagcugccuucguuaauaggccuuuuuuuuuucuuuuuuguuuuaaauuguauguauugaaaguauacaacaugauauuugauauacauauuccuagugaaguaauuacuacaauuaaauuaacacacccaucauuucacauaguuaccuuucuuuuuuuguggcgagaguaccuaaaaucuacuaucauagcaaauuuguaauauauaaugcaauauuauuaacgacaauacuugugugguacucuagauuuuuucauccaagauaacugcaucuuuguaugcuuugaucuauaucuccccauuuucccugccccucccgauuaugccuuuugaggcaguauagugugacaguuagccaucacugaauucugggggccuuuugucuauuccagggagaugaaauuguuagagaaagauuaggagaaagaauaugaaaaggacuuagagaggauacaaaaucaugaagucacaaauaccugccaaacaaauccacauaaggagaaaauaaagaaaugucagauucauaaaagaucaaaaaacccaaacuguucuuagagggaaaagcaugcacaguuaaggaaacuuuuuuuaaaaaguuuuaauaaaaucugaucucuagugguaaauacuguuucccaauuacaccuagacuuuuaucgugaaucagguuuucuaguugacauuguuguuuuucauuugaaaaugaaugcuguguauucuccuuguuucaauucccuuauguauuuuuguguuaacucccucugccggggagcgccagacucagaugaaagguauuaugacauucgagaugaauaaugacguaagaaggacuuacucuauuguauaucacggugcaguaucaaaacauuuugucccaugaggagaggcagugagucagaaaauccuguuggaauuguauuauaauguagaaaaccauuucagaauuacugucugacauuugggcagcugggacuuugagcucauuccacggccaccccaccuuagacauuuuauuaggaagaugcuauucuuuuuuagggcuaucacuggaucuuuguccucacugaugaauuaauuagguagguaauaaugaaucugaguuauuacugcugacaauuuagucuuauucuuaaaaacguucauuucaugguguguuacucuguucuguguugcaauaaaggaauaccugagacuggguaauuuauaaagaaaagagguuuuauuggcucaugguucugcaggcucugcaagcauggcaccagcaucugcuccgcuaccugugaggccuaggaaccuuguaaucaaggcagaaggcuaagggggagcaggcaagacacacggcgaaagagggagcaagagagagcaagggaggaggggccuugcucuuuuaaccaaccagcucuugugugaacucagaauaggaacucacuugcuauggcaaggacaggaccaagccauucaugagugauccgucccugugacccaaacgccucccacuaggccucaccuccaacauuggaggucacauuucaacaugagauuuggagggggaaaaaaccuccaaaccucaucacaugguuaaguggcauaagaugcaacucuaggaauuuuugcuuuuuuaaaacccagcuucgagcucccuuccauuccuucaucaagauauucaugauggaucugcauugggaccugcuuuugucuuauuguuucccaagacuaaaaaggguuuucagcgcaaguguucucguaauguuuuuguccccaagauuggauguuuuucaguuguauuaucuccccauauuucugacauguacagacgugcccagcuaugauagucuguguggauggucuuaaaaaugaguuaucauuaugaauaguuugauggaaagauuucccaggaagcauuaugcuuugaguguuggggaagagaagccaccagaugucguguaggcccuugucccuuuacugccuuuccucucuguuuguaccccuguacaaggcagcucuugugguuacgauuuguuaacaauuugaguagcucccuuauauuuugcuucuagaguaauuaaacauuguuucuuagaaauguaaacaugggacuuagaauuacgaugcaguaaugcauuuggcagcugaacuguguacugggaaaagaaaaauauccuggagcggguuuaaguuucgcagauaagaaaaauggcuuuauuuagugaauuggaacaauacaagaccugugcccugaagucaguacuuucucuucccagaugaguuuccccaggcacaagaccaacuucuaaaauaaaacuugaaaguaaauggcaaaaaccagaaacagagcccuguaaacuagacuuuuaugcuacggcgccauaaaaauaacuuauuugcuaucaaaauaagcuuaaacagaaccuuugucugacagaugacuuuuccucuccccuuaaccugacagcacccccaacccagucuuuggucauaagccugacagcacggugagauacaaguuccuaguggcaguggaggcugauguuuauuauuuagagaguuucugaaaaugaaaguguaaugucuugagucacuuacuuccaaauucuucccagagaacuuuaaauaguguuguauuaaaaaacaggaguaaacaaucauucguaaaacacaccccagaauaaaucucuuauuucugcaugaaggcaacugaucugaaacauuuuuucuaugugccuuuuagagacggcaccaaauuucaugcgcguucgugugaagagaccaccaaacaggcuuugugugagcaacauggcuguuuauuucaccugggugcuggugggcugaguccgaaaagagagucagcaaagggugguggauuaucauuaguucuuauagguuuugggauaggcggugaaguuaagagcaauguuuugcgggcaggaguggaucucacaaaguacauucucaagggugaggagaauuacaaagaaccuucuuaagggugggggagauuacaaaguacauugaucaguuaggguggggcaggaacaaaucacaaugguggaaugucaucaguuaaggcuauuuuuacuucuuuuguggaucuucaguuacuucaggccaucuggauguauacgugcaagucacaggggaugcgauggcuuggcuugggcucagaggccugacaauaacacagugcucaaaacugucagauagccugugucaggucugaagaugugauuuugguuguuuauacuuggaugcuuuggaugggaauagcccuggagucagcccuucauuucaggcagaggagcagaggagugugaguuagacacaacuuuggaucaggggccaggaaaacuugguugucauccuggaccaguuacuaacucgcugugugggcaagucacuucauuugucuaagucucucuuuuuccuuuuguaaaauaaggaugucggcaaaucuguguggucccuuccaacaguguuuuuuaaguuggugccugaguaucugaagcaggagauacgaagggucaugugagcugcacauuccuauuugcuccgcagggaggcuggcuaagacacccggccccugccuuguaaccaugaacaagguucucgcaggggcucgucucaacugcagguccccugaaggucucauccuuuucuuugcuagagggaauuuggaugucguugguccuugccuaacccuugucuuugaaagauacagauccaaucucuguguagcaguuaagugaucugacucagacauauuuacucagucuucuuagagaaugagaaaacucuucucagaauuuuuaagaauguuccugaaggacaauaaaagcucucauucaggauaggccccaaaacauuuuuuucuuuauaauguggugccauuuccucauuuugcuuuuguucauuuguuuauuccuucaacaaauauuuuugagaauuugcugagcacuagguauuacuagauacuaggacagugagauaaguaagauacagccccuaucuucaauaagcuguaugcccugauaaugauacccuuagugucuucuacaagcuauacggucaugcaucacuuaacgacagggacacauucugagaaaugcauccuuaggccauugcauuguugugugaacaucaucgagugacuuacagaaaccuagauggcguggccuacugcacacauaggguauaugguguaaccuauugcuccuagucuacaaacccgcauggcauguuaccauacugcauacuguaggcaauuuuccucucccccuaaccugacagcacccauuaccugacaaaaaugguaaguauuuguguaucuaagcauaucuagacauagaaaagguacaguaaaacuaaggcauaaaaagugaaaaugguacaccuuuacagggcagauccauuuacgcaaccaccacugcaugcgugguccauuguuaauggaaacuguuguguggggcauaacuguauauaaaaguauagcuacuuuaauuuuaaguuaacccugguaugugggaaaauuugucuucugugcugucuugcacugaauuuugcauugguauuuuucccuuaauaguggcugcaaaaaaacuuauaaauacagaaccuucuucauuuauagaauucuucugcauugaccuggaaaaugacguugagaauuggacguuacacuacaauguaguccuccaaugaaggcucucaaugggcauuucuuuaaggccuaaguuaaagauaaaauagaacaacuuccaucacuacaaaagauaguguacucggaggaacuuguagagauuuuuuuuuucuuguagcuguuuuucucacuacucagguuuccuuuuugaguuuugccccuggaggcucagaguugaauucuguugguagucacuuagaaccuuucuacugcucugucuuuccucaguuguguuuuccccauguggguuuguuuugggaaagcaguggaggggaauuccucuuagguugaaauaacuuuuagagcgauggugccacaguuuacaaauauuuuuagaaaaauccugucagauucuugggaacuucagacuaacuucacaucuaaaguucucuuuucuuuucuuuucuuuuuuccuuccuuccuuccuuccuuccuuccuuccuuccuuccuuccuuccuuuuuuuugguuuuugagacagagucuugcucugucacccaggcuggagugcaguggcacgaucucagcucacugcaaccucugccucccagguucaagugauucucaugcuucagccucccugaguagcugggacuacagguacccuccacuacgccuggcuaauuuuuguauuuuuagucgagaugggguuucgccacauuggccaggcuggucucggacucuuggccucaagugauccgccugcuuggccucccaaagugcugggacuacaggcgugacccaccacgccuggccuaaaguucuuauuuaaaaauuuuucuucugauuuguuaguuuaagaagguagguuugaagcagugaccaggaauuuucgggaaauccauuaaggaauaaauuauucaguaaaacagucucaaagugagggccagagugcaggacagaggcagagagagaugguagcaguuuauaaagagaagauacuugauuagagaaaucauugucagaguaaccuuaugcuuagaaagaaaucacacgcgaagcucuguguuugaaaucagaagggaaggugggcauucggaugaagaggcugucggacuugcauuacuuugaccacuacuguuguuuuugcuguuguggugguuguuguuguuuggaagauggaguaaauugcaagccugguggauuucauguguuuagaauuguagcuaaaauagcuccuuacguugaagcauuuccucaauucuauacccacguucucaguccuuguguuacuaccaguaacucauuuuccaaaaugcagaauugcauuuuacauuuuaguucuuucaauauuuggaucaaauacauguucaguggaaaggguauguuuaauuuccuuuugguucggcacuaauuuaaauuaugaauagagauaacguaauucuaguauucguauuugauuguuaaaauauuuggacucagaagugcauuuacacguuuccaaauuugacaaguaggaaaagguauagaguccaaacuccuucccaggccuauccacagcuacccaguggccuauccccaggcaaccaguguuaccaguuucuugcauauccuucugcauacuaccaauacaaaagcauguuauucuguagccccagcuacuugugaggcugaggugguaggaucacucgagccgaggagcuggagguagcagucagcugagauugugccacugaacuccagccuaggugacaguaagaaccugucucaaaaaaaaaaaaaagcauauaauuuuguucuucuuguuuuuaugcugaugaggacaugcuauguccacuguuccaugguaugugccuuuauauucaguuauucacuaaaaaaaugagaaguauagaguaaaaugaaagucuguaguauucuccacuagaaacaggugugggguucaagggagaguguguauuaauuauugcaaaacuucugguuaggucauuaaucagaacgggagccaugcaguggugaagggcccuggcuaugaucugaaacauuuuucugaagcaguguugaguucuguaacugaaguccauggggacuugcuauuggcauaacuauauguggaaaauuuugcuuuuugaguaggacauucccaugcuucacauuuaauuugaauuuugguaugacuguacuaaguuaacauagcuuuucgcauuuuacagagacauugaguaaaucauugacuaaagauaauuaacuccuuuauaucacaugcugaaauguuaugggggacauaucauuaccuuucuuggcuuauggaagagauguaaucuaauucauugagucugacuguguuuaagcuauuguuuugggugucaucguuggcucuuagaacagggacugggccuuaguccuuuuccuugcucauaccuggccuccuccuagaagacccugcuuuucauguuuuaugccucagaaccaagauguuuggggucccaaaguagggauguguaugagcacauuuuuugauacuuucaucuuucucuuacucucuaacaugcguuccgcuagugucauguaaauacagugaaucagauauuucucugccugcaaaaugccuuuugccaguaugugggagguguguugcagguaccacaguggauuuucugcaucuguucauacauccaucuuucccacuuagcugugaguggccucagugcagaauggugccuuaacucuagagucugguaggaaaugccaugcacauuugucaaaugaauggaaaugcagcugacuugcuagagcucaguucugagugcagggugcuugaaugcuauauaaucaaguugagaucuuagucuggggcagcagaaaacaagaaaagguuacugagcaggagagugacaggcuuucauuuguaucuuaauggguuaauugcaguggcauuagaaaaggggagagauugggguaaggcauuaguuggaaagcuuugauaaagucuaggugagucaggaagggguucugcauugcuuguuucccauugcucuaacuagauuucuuagaaaaaagaaaaucuuacaccagacuuuuacagcguuugcaacugaguaaauuucacuuuguaauacccuggauauuauacaauuauauaaagcgcaguauaauaagagaguuaguagcuucauuguaaucaguaaaaauaauuuuuaagacaauuguuauuuuuuguauauuguauuauaacaaaaaagaagucaucaagugggaggagguguuguuuugagacguuugcuuucaucucuuaauccugcagacauuuaucuagucccuucucuguacucuuaaaugcuagggauuuaaaagacggauaagauacaggcuuauuaugucuguguuccagacacuggacuccaaacauaaagcaaacauuacauuauucuuccuuauguaauagaaauguuuauguaagauuguguguaaaucagucuugaauaaacugaauuaaauggaaugugccaauaggaguugcuauuuagagaagcccugugauaaaacauuuguauaauaauauacuuaucuaaacaagcccacuaauuucuauggguuuuuuuuuuuuuuccccccaaggcgagguauccuguauauucuguguugauugaauuccaguuggccaaccaccugccugguuaauagaguauaccauuaacuuagugacacuagaacccugcaaaggaaauaagacacaaucuaucguuguucagucuccacuauuaaauagauuuucauucacuucagcuuggguggguguaauuugcaucuuuccuaacaggcaagcaucugcaaguguauugccuguagaagcucauuaaaaaucagugcaaauccugacacugucucuagaagcaggcauuaacuugcagaaagugguuuguauuuccagugucaguagagcuuccucacucuuuuccugcuuccaugcaaguuuaguccuaaacuaguaccacuauuuuaguacaacuaguaccacucaaauaaugcugcuuuuuaaauaaauucaaggggaacugcuaaggaacugagaaccuguaaggugacaggaaaaaggaaauucuauuuuuuggggcuaguuuguguauugaaaauaauuuuugcugagaaucaagcuaagaaaauuacuugcuaauuuaaacaacaugacaguccucagaauuuuccagcaacaguuaggagcacugugauaaaguuggcuuuucuguugagaacguuuuaccuuuuugcuucagcuucuuuaaagaguuugaaauuaguaauuucaguagagcagcuuugcuguugcgucguacugcucagagcuuagugagcugaagccuuuugggaaaauagcauuuggggagagacucgugguguaauagcucaucccacuggcacaugucccagaguaagcugggcuggaagcuuuuaguguaguuaaaagaugccagucugucauuugcaugcacuguaauugggcaagugguuucaggcugagcuuuacauuauccuuccacugagagcagcugguggugggcuguagauuccauaugagcuggggacuuaucaucugguguguuuagugcaauccugccucaucuugggagcaauuuuuuauugaaugauaauaauaaugcacaaucuuggugaaagauaaugcuugugguuauuagaauguguagacugaguaggggcuuuggcauagagaugguaaugguggggaaagacauauuuaauaaaaggauuguaauggggagaaaguaaauauuuugcaggauaaggaaagccacaaauaugauuaauuuaagagucuuaaauaaaaugucuauaaaauguuagauuuuuaguaccaguaaggcaaaguggccaaucucuagcuuccuuuauaaagucuacucauccuuggagggucgcuuuuuggugcuuuuuuuguuuguucagagucaacuucuuccucuagggauauguuuaagucugucaccuuuccuuaggaauugugccaaucugaucauuuguuccaccacugcugccccgcccccuuuucuugacucaaagaauaauuuguguacccugucucuguuuuuuuuuuuuuucuuuuucuuuuuuuuuuauuauacuuuaaguucuaggguacauguguacaacguacagguuuguuacauauguauacaugugccauguuggugugcugcacccauuaacucgucaucugcauuagguaugucuccuaaugcuaucccuccccccuccccaucucuguuuuuuauuauuuauuuauuuaucguuagagacagagucucacucugucacccaggcuggaguacaguggugcaguuauagcucacugcagccucaaacuccugggcucaaucgauccucccgccucagccuccugagcagcuagaagugcaggcacaugccaccacacccagacaauuuuucuauuuuuuauagagaugaggucucucuauguuucccaggcuggucuugaacuccuggccuuaaaugauccuccugccucagccucccaaagugcugggauuauaggugugagccacuacacccaggcccuguuuuuaacuugcaauaccuuuucugcaagauugaauuuauauuagauuauaaaguuuguggacaaaauagaacacuccauuauaaaagccuccuucauuuguuuuguucucugguguuugauuugacugauguggauuugaguauggaaguguuccaugccuuauuaaggaaagcacuuugggaauuggccagggcccacuuaacuuaguuucagaauggcagcacuuuggcaguccucaguuucucuuauuuccuaacccaucccuacucauuaagacggggcuauugcauuccauuuucagggaaugcucuuucauuuuucguuggugagagaacaugaaugccucuuaaaauggugguuugagcuugcugagaauuuuaggggauccacagaguugaaaagucuuacaggcuaucagugaagcauggaggguuuucguuaugaaaauguccugagauggggggaagacuggacagaugagguaggggagccuccuugcaaaguuagaauucagcuguuuauacugguaacagaaucugcuuuaguaaggaugaagcaaaaagaaaaacgauauuaacaccuugagaaaaucucuguauugugagcuuaauccaacaacuccaacgauguuagcuacuuuuucaaaauacaucuuagcccuuguuacaauaacauuuacuuguggagugaaauuuuguauuaggcagauucacuguaaucaguaaucuuccuuccauugagauucuuccuguuacuuucuuauuuaaaaaccuucaguagccugcauccucaggguucuguuuacagagacccuuaacagucuauucagccuuacuucugccauuaucccuacucuaggcugaguguuaaccauaccuaccuauguacauuugcagcugugccauuuuaucuguuuggauucuuaacccccucucuugcccaagugccuaguggcgcccuguuggcacguugagggguagcuuaaguguuuacuucuuucccgacucccucaguccguguuagcaguacccucuuccauacucuucuauuaucuucugcauacuucuguacuccaccuaucuguugccaugaaacaggucaccccaaaacaguggcuuagaacaauacuauggacugcguuuguguccccccaccccaacucauauguugaaauccuggcccccagggcgaugguauuaggagauggggccuuugggaggugauuaggucgugaggguggagcccacaugaaugggaugucuuuauaaaagagaccccagagagcuucuuuccucuucuaccauaugaggacacugugagaaaacaucugugaagcagaaagugggguccucaccagacacauaaucugcuugcuccuugagcccggacuccuugagccuggacuccucagccuccagaacuaugagaaauaaaugugugggguuuuuuuuuuuuuuuuuuuuuggucuuguuuguuuguuugagacagggucucucucuguugccugggcuggagcaaaguggcaugaucucagguaacugcaaccucugccuccugggcucaggugauucccccaccucagccucccagguagcugggaccacgggccugugccaccacgcccagcuuauuuuuguauuuuuuguagagaggggucuccccauguugcccagguuagucucaaacuccuggaaucaagugaucugcccaccucagccucccaaauugcugggauuacaggcgugagccaccgaacccagccagauguuuguuguuuaagccacucagacuaugguauuuuuguaucuuccauuguacuuaaucuaugggucuuauauucagcaguauucuauguuauguaaggaguuguggcgugaaaccacuuccuucauguuuuuauguuucuuuuuaauuaaauuuuaagccugggaaucuugguaaugacauauuauaugcaaaauauguaauauuagacuugauuuucaucagaucaguuuuagcacuuuucagugugcaaaggugggugguaauggcuuuuuccaaagcauagucccuugguuguauuacacuauuaaugacuauggguagugucagaccccgagcccaagccaagccaucacauccccugugacuuaaacguauacauccagauggccugaaguaacugaagauccacaagagaaguaaaaauagccuuaacugaugacauuccaccauugugauuuguuucugccccacccuaacugaucaauguacuuuguaaucucccccacccuuaagaagguacuuuguaauucuccuuacccuugagaauguacuuugugagauccacuccugcccgcaaaacauugcucuuaacuucaccgccuaucccaaaaccuauaagaacuaaugauaauccaccacccuuugcugacucucuuuucggacucagcccaccugcacccaggugaaauaaacagccauguugcucacacaaagccuguuugguggucuccucacauggacgugcaugaaagguagcauaauacaauuuuugcugaaguuuuguugcucuucuacuuuuaaauuaaggaccagauaggaaaggacauaugguaaucuaucaaauauauagccauugauauuuucuuuguuuucuuucacuaaccgguuuaugcaagauuuuuuuaaaaaaacagcaaaaugaaaagguucguaauauccugacuuccuguuuuauuauaaaugagaugaacaccagguaguguuaauuuccuuuaauuucuuuaugagucauccucaaauuaauguuugaggaaugguuggguguuuucaaauaucuccgacaucuuuuaguuagacagcauagugaaauggaaagaaauuuugaaucugcuagacucaaguuugcauuuuggcucugucauuuacucauagauguacuacuuggaguaaucauacugauuuuguagaccaauuggaaagauaauugaccaguguuuuaggguauauguauauacacaaaauuugacagacauguaaucacacaaugcuuaagccccauauguuauuaagcccacacuuugguaaauaacauuuggggcuuaagcaucugugugauucuauauaugccgguauuuguaaauguaaaagugauaccagcuaaaucacccaucuuucugggaacuaaguacaaaggaaugguucuguuucuaacccuuuggcuuagaguaucauagaguuuuaaauuuggccagauuuuaauuugacagauaaaaaaaugaggcacagauaaaaaaaucgagaaguugaaugaauuaugaaaacucacuagaggcagaguugaggacguuguccagugcucuguuguaucauuaugucacugccugcccuacuguuuuccugcucuuucccucuucuucuuccucccucucagcccugguccaccuaccuuagugcaugcacacacguauggcaaagaucaacaaggaugcuggguucaggguccuuuucccacuggagucuggcaacacuguuccugccuugauaugguucuugguuguuggccacuuaaaacaauggcauauuuugaagggcugaauagacuuccuucuuuuuaagcuuuucuuuuuauuuauacuuuuuggauccguguaauuucucugagucauccacauuauuuucuacuuuuucucaguuuucaugaccuguauuaccauuacaggugucucugcuauaauucaauauacauauuccugaaaaccucauguucuacaaaaucauacauucagaauaaucuggcuaaugggaaauauugguuuggggcagucuggcuuaugggaaauauugguuuggggcagucuggcuuaugggaaauauuaaguugggaccaaccacucuaaaucuaugcuacuuugcaagcacagcacuaacaaaaacaaugaaaaccaucauaaaacaggagcacaguucagaagacauacuacauuccuacuauauacagauacacuuugguaaauaugacuuuaacucaugaaaauaugcggggcugcuugauggaaggggauguaaggaaggauaugaggcuggugaguacugggagacaagaaugaaacacaccaagacguuugcaugagaucaugcaaagagaaucaugcagaagguacaucuaagacacaaggccaaccgggcaugguggcucaugccuguaaucccagcacuuugggaggcugaggugggcaggucacaaggucaggaguucgagaccugaccuuuaacagucuauucagccuggcaacuauggugaaaucccgucuccacuaaaaguacaaaaaauuagcugggcgugguggcacgcaccaguagucccagcuacucaggaggcugaggcaggagaaucacuugaacuugggaggcagagguugcagugagccgagaucacaccacugcaauccagccugggcgacagagcgauucucugucucagggaagaaaaaaaaaaaaaaaacacaaggcccggcaggcugagaccaugacaggaacgguuagaguggacccuggugcaguguggggugcucuguucagccucacuaugaauuucacauccagcuucuguuacuuggagauauaaaacaguaauguguggagacaaaucguggaugaaccaacuccugaguuauggcgucaucaaucugcuaugaccagucaaauucgcaguauagaaacaugucuuguagcuggacagaaaacauccagcucuacugcugcuaaacaucauggaauguacccauugguuuauccauauaguaaguuuuaacauuauuuuuaauauauuguucauucugaauuugacaguggucugccaagucucccugaacuccacaaauuaaauaaagguaucucagagggccuuucccaagaacuuuaaugccaucuuccuagcaagcuauagaaaacauuugaaaaccccaagggcaaaguuccagggcugccuaggggcaaaaucagugaacagaguaguaaacugauaaaaccagcauagaggccucugugggggaaaaagacaccuuucugcaguuaauaaacaguaccaaagaacacugauugucuucucaggguuuguagcccauuucuguuuuuuauuuuuaaaucucaccuguuauuuuuguuuuuagcuguuccauaguagucugauggaaauacacuuuauguguucuugugugccaaucaaaaauaaaauaagcacaaugaauaccucuaauugcauaguucaugaaaggcuugaaaagaugcagagcagcuggcuaaugcugccaaugagccauuggcuggagccccuuguaacucagccuuugauucugucuucagcaagccccagcauccucagggcccaugugaugggugcucaguggaacuccagacuuuguggagggcucugugguucugcugcuggggaaacuguguguuucugagccuaugggaaugggucagaaagccugggaaaugggggagaauaggagcaggaacacaaaugaggagccagcaaugcagguugcuauuaugucgcaugucacuuccuacgaauaucuugauagauuagcuuccuucaggcccaaaaccuugaauggacaugaaccacaguaucagggcuaaaugaguaacagcccaaaccagguccacucuccagacaguuagaaaagguagacaucucuuguagcuggauggagcaggggucucccccaggggugguaauucagcaggucuuuaaagaaugaauaggauuaaaguaagugaaaauggaaagcugaaggcagggaaggaaagugaggcucagggagaauucugggcaagggaaaguuacagagugauuccuuagagcuugugagucuaacaauuuugaugucaauggaccuuauucuuggaaccacagggcaacugauugacuuuaguuuucuuuuuugcuauauucuugccacucacucaaugacugcucauugaaaauugaugauaauggccauauggaaagucucagagcuuaucuaggauuugagucccugaggcauaaucaguggguggaacagcagauggauggggcagacuauuuuucuguuccuuccugugacaguugauuauaaguuauaaaaaugggcauucucuuugugaucuuagcuuccaaaauuacggaagguuaucacuauuuauuauuacuacuuucucagcaaacucaaagaaucagagugauauugauuauuuagauuuagcaaugggggacuuaagcucuuauaaaucagggucaucugaaucuaaagauguaugucuuucuuauuucagucugaccaguuauuuaagaauccaagauaccuuuacuuuuuauuugaaguuccuuaauuugauaagagcucuaccaagcaguugguucuguuucucuuucaguucucugccaagcuuuugugugucuuaagacacugggacugggaaaagacugcaguguuuguuaaauguaaauuauacugagccuugaggauuugaaugcauggggagagguacauuuuggcuuuccuuccuuuguaaaaugcaguuaaacugauauccagaacaauggugagaaaacaccaauuaacugaauguaugaaagacaguaaaauaaacaaggugggcaguccuguaugugaggcauuuuuaaacucuuugcuguguaagugcaggcuuuuggaaagaucugcuuuucacuuugauuuuugcagucccacaccagcuugcuucugguucugccuucagggacauaugugcucucuagaucugggaaucuuuuugucuggagaccucaagauugggaucugcacccuccccaccccuuccugucugaacucuauuuuagaucugcaguaaagacuugaggcuuuuugcaagcuuucaacucugagguauuuuggaaaacuguaauuuuguuuguucucugcuguaugcaugugguuucuuaaaacacgagugugauuauuuucugcauccuuuccauagcaaacauuucccucaaacuacaugcuccaaaaguagguucucacugcacuugccaugccgucucauugcuuauugagagugacugucucuuuacaacaaaucaacugguuacaauuuugaggcuuuuuagguggcuuccaaacuugucuugggguuugucccucauauguucagcagccaaacaugcucaaugcauuguauauuucccagcaagccaugaagcacuauugacuuauuaugaaacuuaauuugaugauaaugaggcaggucuauaaaauagcacuuuggguaguuuuuacccauaaaauagcaauuuguggaagaccguuaguauguagcauggacucugaagcuagagaacuugaguuugagucucagcuuuucuacuuuuuuuuucuaguaauuuuauuuauuuuauguuuuacuguuaaauucuuaaccuaccuggaauuuaguuugguauagggagucauguuuggaucuagcuguugauucuuuuuaaauauaauuuuuagugauuuuuuuauugugauaaaauauacauaagauuuaucauuuuaaccauuuuaauuuagauguacaauucaguggcacuaaacacaaucacaaguuuuccacuuuuuagcuguguuagaggucaaauuauuuuaccuuucugcgucuccguuuccucuucugcaagugggaauaauacucccauuaaguuguuaugagauuaagacuuaauucaggccgggcgugguggcucacacuuguaauuccagcacuuugggaggccaaagcagguggaucacuugaggucaggaguucgagaccagccuggccaacaugguggaaccccaucucuacuaaaaauacaaaaaguuaacuccguauaguggugcaugccuguagucccagcuacucaggaggcugaggcagcagaauuguuugaaccugggagguagaguuugcagugagcuaagauugugccacugcacuccagccugggugaccaagcaagacucugucuaaaaaaaaaaaacaaaccuaaauucauaggaaacacuugaugacuugauguguacaggacaaaauaagugcuuaauaauaguugauggccaugaggauuugugguacuggcagucccccauuugcuaguuaagaagcauuuuuugagccuggugccauaugucugccccauacauaugccuguguggucacaguaauugccgguugaaucacaguggagaccucgagaauucucauugguaacacuggauaauuuuuucaucauuuuuauguccacuuuagcaugagacuaauauacaguuugaacuucaggggagaaaagaagauuuucuaacagauuuauauuucaaauuguuuacaagacaauugaaaaugaaaagauaaaaccuacuuacucuucaaguucaaggcauaaugcaagaggcuugaagaggguagacuucugaauauauuccauaaacaguaucucuuuucagagguuuugagaaaacccuuguuuaaaaaaaauaugagcaacaauuauuuguuauucaugaauucuagauguguaaauugugugaucaaaaugagaggaaaaagagaagucucaagagaauaagcauuuugucuacauuuaagucuuuuggaaaugauauguuugaaaauaauauacccguuaaauauauuuccuuaaauuauuuagauaaacuguuucuauuguaguuucugguaaacaguaauaugaaaugguuucuauuuuauugucaacaacuucauuacuuuuuaaugcagcaaaaagcuuccaaauagaucuguuaaaaagacugcagaaauccucugaauugaauaaacuauuucuagccuuaacauucaugcuuccacaguggaauauacuauauucagccaccaucacaaaaaaugucuuucuuaucagugcugcccuagcuaaaugugaacuuuaaaaauuggaaaaucaggcacuuuguagacaguucacucuuuguuucauauuuuugggcuaaggaaaaaaaauugcccaaggaaguauuucuggaaggagucuaacuucucaauaaacauaguaguuuagccuacaauauuuuuguuguuuugggaauugauagugacccuaaauauaacaaaagaauauugauuucuaaagcauggaucguguugguuccuaaaaagugagugauaauguagcaauuaaauucugcccuguauuauacacaguuggucaggguaucagcagaaugccaucaucauuauugaauuguguaauaaauacuuggggcagagugccauaguggaaauaaaacuacauuuugguuuaggacuuccugcccuagcccauggccuauagagccaagccuucacguuucaagaaguugugaggggaaagagacaggcauuggccucaugguagcagcugcuggaggguucuuuuccuagcucauuuucuuuccucauguuucacauuuuuccagggugacaucacgugugguaacuauuuguauggaucuuccaagcccgcauuuuagccaagacauuucucaugggcuccagacccacaaucugguggucaacauacucucuacuugguugcuccauagauacccuaagucaaggcaugaauaucuaaacugaucgugacucuccucucucccaccaucaccuccaaaccuguuucuuuuccugcauuuuuuuuuuuuuuuuuuugagauggagucucgcucugucgcccggcuggaguucaguggcacgaucucaguucacugcaaccuccaucucccggguucaagcgauucuccugccucagccuccugaguagcugggauuacaggugugcaccaccaugcccggcuaauuuuuguauuuuuaguagagacgggguuucaccauguuguucaggcuggucucgaacuccugaccucgugaucugcccgccucagccucccaaagugcugggauuacaggcgugagccaccgcgcccagccuuuccugcauuucuuuugagcaucuagcacguuuccagucauucauccacgucagaaagccccagaugccaccagcucuucuuugcuuucaauguuuaauggaacacuaaggucugcgaauucuaccucacaaaugucuucccuggcgaauccuccuuucugugccacccaucuucaccuuauuucgggccuuccucauuucucaccuggaucuuuguaaccauggccucuagagcuggcucccuggaucccuacuggccaucaaucccaugugccucagccguaaugccagucacaguucucaaagagcuauucucuuccucccuuccucauucaggcugugccugguaaucuggagugaauuuuccacuccauccugcagacuuccaaauacuuauccagaggcucagcuuacagcucaaugccucuuugaagccuuucucaaccuuugcagaguugagauauaacuaugcugcuaaauguaaaucuaacucuucauacauuuucucuuguuuaccugucucccccuccugucagagucugaguuacuugagguugugaauugagucuuauuuaugucugucucuaauaucuagcauggugugucucauugauagcagacaucuauaaaugagugaguaagugagccaacgugugggugguuuuuccuggggcgggaaggguugggaggguaccacguagucagugugagccucccuucgggcucuuugacuuuccgaugagcaugcuuacugguagugacuucccuugacccuuaccaguuagauacaugcucugggaccagagcugcagaauauaaaccaguaguuuugaaaaguuauuauuaucuccauaaggauuggguuuuuuauaggcacagguaacaagguugaacacaaccaagugaacccagugaauucuauuuauuucagugaggugucuguaugcacuguggccaucccagaggccuuacuuucaauucauauccacuaacucaagggggcuuuacugccacccagcacucacaccgccgugcucuucugcagagacuuucccgcagucuguucacugcuucauacuuucuccugcacuuaaaccuuuagcauaucuccaucccugccucucagcuaacggggcuugcaggcaauuagaaagagcuucccuguguaccugccaccacaucuucucaguugucugcacucgcuggcuagucucccuugcuguggaggaauuguugaugccccugggaaggccacacccuccacuugaaagauccgguccccucccaccuuuuuuuuuuuuuuuuuuuuugagacggagucucgcucuggugcccaggccagagugcaguggcacgaucucagcucacugcaagcucugccucccagguucucaccauucuccugccucagccucccgaguagcugggacuacaaguacccgccaccacgcccagcuaauuguuuuguauuuuuaguagagacgggguuucagcauguuagccaggauggucucgaucuccugaccucgugauccaccugccucggccucccaaagugcugggauuacaggcgugagccaccgcacccggcccccucccaccuuuuuaagaacaucacuccaucaguugucuccuuucucuucugaauaaucaguuuuccccuggccaccaagcuauucccaucagcauacaaacaugcugauuucuucccccauaccaugccccucuccagcuuccauuuaucugcucuguuuuacuuugacuugccugaacucauuauaacuuauuccucuccuuucagucucucucuuugcaaaguuuuuaaagcuuuuaauuuugguaagacauauacaacacaacauccaacuuaccaugucaaccuuuuuuuuuuuuuuuuuuuuuuuuuuuugagaugaagucucgcucugucacccagccuggagugcaauggcacgaucucggcucacuguaaccucugcuuccuggguucaagcgauucuccuaccucugccucccgaguagcuggaauuacaggcaugugccacaugccuggcuaauauuuuuuuguauuuuuguagagaugggguuucaccauguuggccaggcuggucuugaacuccugaccucaagugauccaccugccuuggucucccaaagugccaggauuacaggcaugagccacugcgccuggcccaucucaaccauucuuaagugugcaauucgguaaugucagguacauuuacauuauuaagccaccaaucugcagaauguuuucaucuugcaaaacugaaauucuguacccaguaaacauuaacaccucauuuuucccuccuccaagccccuggcaaccauccuuauaccuucuaucucuguaaauuugacuacucuggguaaucguccauucucuccugaacccaccuucaucaggcuuuugcuccuacauucccccuccaccacuuuucucagggucaccuguggccuccacuugcuggaucugacagucauuucucagucuuuggcugauuuggcccggcagcagcuauaggaacaguggagcacucccuccucuuugaaacacugucuucacuugguuuccagggaccuugcuggccuguguuuuccuucuuccucacagaccacucccuuuuaguguucuuccucuuguugccucuguagguuggaaugucccagggcugagugcauggcccucuucucuaaucuucacucacuccucuuuagaguugaugucuuuccaugccauuuauacucuuacaguucccaacauuugucccgaggcccagcugugaacacuuccuuaccugcauaucuaauaggugucucaacauuugcaucuccagaaugacucuugaccugccccccaauaucugccauaggcuuccacaucugaggauggcaacuccguucuuccaauuucugaggccaaaauugggaaucauaauugacuacucuuuuucucucaaacccccauccaaucagcaaauucaguuggcuuuacuuucaaaagauacaaccugaaugugaccacuucuugucacuuccacucugccacucaggucuaaccaccaucuuacauugcuuggguugucaccuccucccuggccucccugccugcccuagauuccaaacacaaaucuagcgagaagagccuaugaaaaugugagccacccucugcuccaagcccuccaguggccaggaaauggcagacuuuuacaguggccgaaagcucuaugugauugccuacuccaugaccucauuggccucuuuucuugauuuucucacccuuguccccucgcuggagucccacagccuucccuggugugccugcaguaugccauccugcugcuaccuuagggcuuuucugcucucugucccucuggggaaaggcucagcccuuaaggaucccgugccuuccucucuucuuucugucagcucugcacucagcugucaccuugguugcgaauucuucccuggucacccuguuuaaaguugccacgcuucucccgcacuucguaguuuuuuuuuucuuauuauuuuucuuucuagcgcuuaccacccuguaacaugccguauauuuuacuugucauuuguguuuguaucaccccacuggagggugaguucuagagagcgggauuuccuugccagcguucgcuggauuugcccacugcuuagaacuauuucuggcgcauaguagguacacagcaaguauuccuugaaugacuauagagaagaagcuuucacaaaacagaaaagcguaauuaauugcccacuucagccuccuaaacuguaggcuucauuugaaauuucaaguucuuauuuuauccaaaagagaacaaagcugaauuaaacauugcuucaaacgauaucuuugagucguuuccaagaaggauguauagaugaaauuauaauuuagguugcuauggauacauuuauacauauaaaauauuugugacaaauauaguauuuguauuauauacaagaaaauuacuauggauuugcaaaucgauucauauaaaauuuacuuucuuaugggacauuaaauauauuacaguagcuuugaauuuucugaauuauauuuacuuaaaaaugucacuggcaauaccuuugaggguuacuuuuuuuggauaaaacuuguggcaauaauuccuccuuugacuucuucagcaauauguuaaaacuggcacggaaccuuugaauagcuuuugaauuuuuaucucguuugaaauuaaccaguuacugauguaauuaauaccauaugguauaaauuuugaauucugcaugauuucuacuucaaaaugaugccugcugccuucauucuacuuuauguuuaacacaaguauuuggaaaaccugaguagugguuaucuggcuuaguggaacuauaauuuacugcagguaaaaaggaggauucauuucuuuauguuggaagucuuuaaaaauauacugauacauuuccaucccaaauuagcaagucuguuagagggacaauaauuuuaucuuugcuaacugaagaucuuacauggccucaugccuaagauuauuuacuacacauuguaucaaaauaaaaaaaguuugauaugccacuaaaaggcuuuuuuaaauaggagagaucuaaucaaucacauacguggacgugcuguuuauacuacaaaaccucuagauccucuuuaccuuugcaagggggguggguaguuuuggcuuuccuuauguuuuuauuuguuauuugugaaguauauaauaaaagaaaaucuaagaaauugaggauuaugguuaacugaaguguaauagacuguuucacgguauauuugacuucaacagcuuccagcaaagaaaaauccuggaaaaaaacuuucugguuuggucauuuuuauuauaaaaggcuuucuauuuuccagcaaagaacauuucuuuuaugguuaagaguuucaauauuuauguaauuagcaacucacagcagugccuuguuucauucuugauucuaauccuggaaugauaacauaccagcaaagcagcagccguagcguccacagagccuacuucucugccuuuuuucugucucccuguagagagaaguccacucuuuucucugaucccaguguaguaauguaaauuugggcaugcagaaagucaaugugccuuagcauccuugggauucauuuucuuugcauuuccgaaauuacucaccuuguagcaguugucagaucccuuaauuaguaacuaguuuucuuugaauuaugguaucacauagacugucuguggucuggcugguaagagacuguuaccagcugcucagcuuuagucaggcaauaagguauuuguuacacuucaaauaaucaugugauuuagugaaaggccauuugagcucuaaagccucacaguggaaaguuucugagaccucugcccucccucucacaccccagagaaucccuagucuccugccuuccucucaugcuaucugcaugauugcuguuggccugcucggccaggaagaugguccgacacacaccccuguucacugcccagggucucaggaucccuguccuaggcagagucccaagcaguguuguaccugccaggaagcccuuugggcucuucugcacccuuggggaccagugucccuacaguaaucuguacucauguuuauucccauacuucucucuagaauuuaagucaugagcugugugucucccuuucugcacucagagaguaucagaggaggccugguguccuaguuauauuucauuuuucaacugucauuuguugaacuccagacacugcuaacugcuuugcaugcaucaucuuacuucuucuucccaguguuuauaaggugcaacugaaccaagccauauaguuggcacugugaugagugagggaacagauacauugaucauugaauggagcuagagaaaacuguuaaguaaguugacuacuaauuuaguggaaagagaaaccuucaaacuaacuuacagauuguucacuuauuguacaaaacuauuauuuauuuauuugugucucauggaacccaguaauagcuaacauaaucaugauagcaguuauucuuagagugcuucacucuguggcaggcacugcucuaagggcuuuauauguaucaucccauucaguccuuucacuaauucaauggagccaguacuauuaauguccucauguuacagaugcagaaauugaggcauagagaaauuaaguaauuacuuccaaguucaugcagcuaaguggugggaccagaguuugaacucaagcugucugacaugaggaccuggaaccagccuggguuuccagcaagauaggacagugcccaucuugggcuggguggaaacauggcacugaagacaugggcucuuuguucuggagaaaauauuagggaccuggucagagcucacuuacuuuuaguaauaaauauucaauucaacgaauauuuauuaagcucuuacuguacaacaaugaacaaagcuccuaaucuucauggagcuuacguucuaggaagggaagagagaaaauucacaucuaucuacaugacuaaaucgcauugcuauguuagaagguuauuuaugugcuaagauaaaaagaaaauguagaacagaggaagaagguuaagaugguuaugaaagaaguuuuaaggagaugaucagggaagaccucaugguucauauuggagaauuguugaucacauuucuguuguuugaccugacuucuuuguugaucucuuaagagaugcaggcugagaucuugacucacucaaaacuuguagggaacugcuuaauauuucugccuauuuaacccuggaagcguuggguuguuuggucugcagagucaggggugagucagcccauggguucugcuuuauuggcuggguagcacucccuuacuggggggcaguucugaaugugugccccaugggugcugaguuaugggcuggguggggugucuagaggagugggaagugagggucagacaccgaggacauugcggagcugagagaggaaguucaggauggauagaaagauguagcugcgauucuucuagagagacccuugccugccuaggugaagauagggaugaauuguccaaagagggcacaugacccuagauccuaccucuacccaaggacuaucuucaccaaggcaguggucccaggaagaguagcaagaggguggagauaacagagcagcccccucaguacugggaaaacagcagguuccaugcacuuuuguggugggccagggcuuuagaugagugaaugacagauucaccuuuuacccaguuauugagacaucaugaggaguguuaagauucugaaaguaaauuuccacgauaacauguuuaugaugucauuuggucuuccucuguggaacugguaaugauuuugacuuucaagaugagaucuucucuucugaccauaaaacaagauguugcaaacgagguucccagcuguccuggucugucggcauggcugcucgauggcucugguggcugauaacucaggauguuguugcuggagaguggggaacucguccagauccuccugagacaccacuuuccuuuuucauacaaaaacaacaccgugcuuccaaucgugcugacugcacaccagauuccauugacuguuuuucuacccuacccugcuuauuuuuauucaucuggcuacuuuauuuuagggauuuggaaagcuugucuuggcaguggugacucuuauuguuuuauuucuggcugcucggcuuucaugugaaugcuuccauuaagaggcggacguggggaggacgugguucugggguuccgguuugcugccuagguauguuugcacagauagagcugugguggcccagcuccacgcugcagagccagaccuaggcugggauuccagcaggaaaggacaaugcccauuguggguuggauggaggauacguggcacuaaagacaugugcucuucuuucuggagaaaauuuuaggaaccuggccagaggucacuuacuuuuaguacagagcuauagaaacuuuuuaaugccuggugaccaggcaccugaaaugggucagucauuuuuuuuucuucuacaagcuauacccauaugaacaacugauguugccuguaugcaguucuaugaggcagaaucaguagauucaagacaggacuuuggugucauacaaaccuggauuaguucuuggcucugccacuuacuaacucaguguccuuggacaaguuaccuaaccucuguagucuuuagugccugcacgugauugggaauuguaacagcaccugccucgcuagguugugaugaggauuacgugaggaaaaaaagccccacaaauuuucugugaugauggacaacucaaaauacgcaaaacuccauuccaggucagauucuuguugcucugauuguaucagaaacuagcugaggaguucagaguaaggaucuaaccuagcaaugcuuaauucuggauuggguaagauuuuauuucccaaaucagcuuauuucucagguacuagccugguauccaaaucggacccuuucugggaacuaccucugcucuuaggacagcagcaucuguggaggguugguuuagguagagaaagcagaaauagguugugucgucugcucaccuggcuuucccauagcccagugggaaucaacuggacaucucaagaauccugauguccaagccacgcucuaaaguuucuggcuaugaaccccaggcuuuaggauguuaaaaaaaacucuccgagugauugcagugugccaacaagauugagaaacaauauacaaauagcucauaagccgauucacuaacaccucuauacaagcauauuuauaauagaauuagagcaauaaauaacaaagacauacacaaauucuuuaucugcauguaucucuagcuuuuaaaagcuuacuuaucuuucugucacucagacccuacuguaccuuuucacagccccuugcccauuugcucccucuuauuugguugccguucaagacaaagauacuaguugccuuuuuaauauuuuccuguuaucuaugagcucuuauucuuucugucuuuccugagugggagaaccuucauuacucacaacuugauguaucugucauuguuaguggugcuucuggcauggcucugaccuuucaaaaggcagaguuaggaaugcucauaucucucugugaaccaugaacggacugcccucucaugucuuuaauucaauuaaguccuagauucauuccuuccuuucucucuuuuucucucccuuuuaaagagggaccagacguuguuuuauuucuugguuaucaggacagaaaaauuuugaacauguacguauaucuuucgcucccacuguuuguaaagggauuaucucuucuggauuaucagaaucaaaacaucuugauccacacucacuuccccuucccuucuaggugucuuccccauggugugcucucaaagacacacuaugauuuccacaucagccuaagcaaagcaucaaaaagcaaacaugcccauuuuuuuugcacccucuuccucucuucuguuaacaaaguugaggauuaaaugauacucagagaaaaagcaagucauauauuuggaaaccuauuaaucaaaauagaguguuuauguaagguuaauauaaucagcaauucgagccaagcuucauguuguuacuucuagaauuaagcccaucagcugaccuauuuuuuucaguacuuuccuuuuuuauccaugauuuucaucacuuucuuaccuucugggcuuauacgaagaccaugucgacuuuauuuugguugaauuuuggacacauaaaagugcagugaagauuucauugcuguaucuuccugauaauaaagcuguucuugcuuggccuuauuccauggagaaagaguggucuuguguggggagcuuuauccaucguuagcguugggcacaaaagugacagaagcuuucagagccuuaguuuugucaucuuuagguugguggggcuacugcugcuacaugcagugguuuaaaugaggugccagaugugaagcuccagugucaggcaugcuugaauuggucaaugcgugguaaacuuugccagcugucauucaucuaccuucucccaaaugccuagcucuuuauuugcaccauuuuuaaagcacaauuagggcauccugccuuauguuucauucuggguuugccucaucuuacuuuucaaaauuuaaacuccuugaaaguaggccugaaguaguuuuccauuuccguagcuaucccauccuuaguguacguugaggaugcauacauaauucagcagggagugaacuaaaacuaaacaacaaaaaaaaggaaagcuuuuguuuuucuguuuugcaguuuuguuuuaacuugggugaugccgaucugggcaacuguuuuuguauagccagugaaagugucuaagcuguguguagauuuuguaauauaguuucauccuuguuaauguagaaauuguaacacaaacccaagacaacaggggacccauugcauaggugaauucucacuaacucaguggacaggguggucugccuguuugucccccaguguaggccugggcauggcagaagcccauuguuaccuuauaacuuuaugaauguauaauguguagccuggcuccuuucagaaaggaauccuaaaaaaguacauauagaauagcauaauuaaaaauaagaauuaaaagagaucagacacaacuuaaaauaaugggaaaaugaaggcuuuacuggguaaaccuccuuuuccuuucagcuagcaggacuaaucucauuccuugagaggcucugaccagcccuuagcacagcugcuucugggaugcagucacacagccagggaagaaauuacuuggaaggaaaaaugccagaguuuucccucaaaccuggagauuauggaggaaaagauaagaaggggggagagcaaauauaaucuguauuguaaauaguaaugaaaauaccagacugauacacuaauuagugcaauauucuagcauguuuuuagcaaauuguuauuaaugaugccauuaguaaguguagcccagaauugaauauuagcugaauuuguaagucauuuuguaauuuauuugucuuaccauuacauuuuucccaaguuugaaaacagaacacuuuuaaaauucagauuauaugauggaauauauauucuacagugaaaugucaaauucauuaaaauaaugugccaauauuuaauuacaguauugguggguuuauauuuuauaacuucuugugauauuuaacugcugcuauuaauuaugaugaugaaacaaaauuucuuggauuuugaauauuuuugauuuaauauauuugacuucagaauaaauuugacuuauucacauaaaucuuagcuuugaaaagaauguuagaacucaucuaguuguauauacuuuaauauuaccuauucagaaacagaggucuagaaaauugaguaacuuucucaaacaucucagguggucguagauuuagaacuagucuucugcucucagguuagagugguuucuauuauuaauuuuaugucccauuguccuuuaaaagguucguagcuaugugacaguauugcuacaaaaauacuauuuucuucuugcuuaaagaaacauuggugaugcugaaaucacagaaacacucucauuaccuaaaauaguucuugaaauauucuacgcacauguauucuguaucuuuuucauucaauuagauaguauaguucuagcaauucucaggaaagguuaaguuuggaauguaaacuggacccucaguggaacuuucuuugaguugaaccugaaggaaaccacacauauaaguuuucggggcaaacuuccagcacuguagcacaucaagaccacuaugucuaguaaaguguuucagaaagaaagaacacaagagacuucuggaauucuuuucuauuuagauucuaaacauucgugaaaggaguguugcuuuaauauuuuccuuaauuuaauaugaggaacuucacaguuugcucuugcuucuuaauucuuuuuaagugaaaugaaauucuucguguagagaaagaguaagaaugcugaugggagaaugagacagagauguguauacacacauacacacaauuacauauguuaucauaauauguauauauuauguaucacaaugaaauaagcaaugcguugauaucucuaaaggcacagaaguaucuacagugaguuccucccauucacuccuguccuccuagccagagauccucucuccagaaacaaccacuucaaacaguuucuuguguagcuuuccagacacaaucuacuuauauuuaaauaauuauguaaauauucauuaaaacccacaaauacuauaugcacuguccugcaacuguuuuuguuuuuaaacacuuauaaucuauuuugaaguuuguuuuguaucagcacauauagagcugcuucauucauuuuuauggcugcauaguauuaguauuccauuauggaauauaauguuuaauauuacauucaaucacacaaaauagaauuaacauuacauuaauauugauugauuuaauuuuagcauauuuaugauguuuguuaaugguauauuaauacuuaaccaguccucuauuuuauuugcuuuccaucuuuugcuauuugaaaccauacugaccaggcacaguggcucaugccuguaaucccagcacuuugggaggucgaggugggcagcucaccugagguccgggguuuaagaccagccuggcccacauggugaaaccccaucuguacuaaaaauacaaaaauuagcuggacgugguggugcaugccuguagucccagcuacugaggaggcugaggcaggagaauugcuugaauccaggagauggagguugcagugagcugagaucacaccacugcacuccaggcugggugacagagugagacuccaacucaaaaaaaaaaaaaaaaagaaaccaugcuaaaaguaugucauuugcauauguauaagaauaucuguagaugagaaagacugcuagguuaaaguguaugugcauuuguaauauuuacagauauuaccaaaaaauguccuucauuuacaucaccauggccucagcauuacaauguguuuaucagauuuuuuuauauucaccauucuaauagaugaaaaauacuaucccauuuaguuguaauuugugucacucuaauuugagugugguugauccuuuuuuucauaugauuaagagccauucguauaucauuuucugugagccaucuguucauaucuauuuuucuuuucuuguuuaugauuugucuuauuucugucaacuguagaagcucuuucuguuuauaaaaaauuugccuauuagguuuaggaauuguagaacuuuccauccucccccauuccuugauugucauauauguuuauggugaaguuuuuguuuuaaaaugccauacuuuuuuguguguguugaauuuggcacucuggcuuuauacuauucauacaaagccuuccccauucugagaucguaaacacaacccaugcuguccuggugcuauuacagcuucccuuuucacaguagaucucugauucaucuagacuuuauugagauaaaaggugcgagauagguagucaucuuuuuuuuuuuuuuuuucguuguaaauggcuaucuaguuuucucgaacuacuggccuugugucuuuucccuguugauuugaaaugccaccuuuauugcacacuucagugguucccaaccuuuuuggcaccagggaccgguuuuguggaagacagcuuuuccccagaccggggugggggaugguuucaggaugacugaagcgcauuacuuuauuguacacuuuauuucuauuauuacuacauuguaauauauaaugaaauaauuauauaacucaccauaauacagaaucaauggcagcccugaccuuguuuuccugcucuagaaggucccaucugagggggaugggagacagugacagaucaucagacauuagauucuaacaaggagcacgcaaccuaggucucuugccugcacaguucacaauaggguucaugcuccuaugagaauucaaugccccagcugaucugacaggaggcggagcucaggcaguaaugugagcaguggagaguggcuguaaauacagaugaaguuucacuugccagccugacacucaccuccugcugugcagaccuguaccagucugguccguggccuugauuuccauauguaugucucuugacccauuucccaucuuaguaauucaugccauugaccuucccaucuauccaccacacugcucuaugauguguuuuuaauauccaggcgagcucauccucucagggcucuucuuuguugagaaauacuuuacuguuuucacauuauuuaaccaugagaucuuuagaaucaacuugugcaauaaccccaacaguuuuuuuaaaauucuggaaguauuuuuuuguuuaaauuggaagugccuuaaauuauauagauauaauugagauaauugucaucaccuuuuaaaauuuugccuuaguagcauuuuaaaguuuucuucauauaaauuuugcauauuccuuaagauuugcuggggauuuugcccuuuugcuauuaucauaaauuauaucucuucuuuugugucauuuugcugguguguguaaaauauauaaaauaucccuuaauaagguuguuuaaaaauuaauaccaaaugccuuuuacauauccuugaagaugaucauauaucauuucacuuuggucuauuuauaaggugaauuguuuugauaguauaagauccucguguucucuaugaacccauaaaaaaggacgauuuuauguucuuugcagggacauggaugaagcuggaaaccaucauucucaaaauuauuccuugaaaguuuguuagaauucucccucugaagcuaucucauccugauuuugcuuauuuguauauuuauuuauuggagggaagguggcucuuuaacaucuauuucaucugugauauugacauauuuacauuuucuguguuuucuuuggcuaaggugugguuucuuaaguauauguuacauauuauuuacugaaaaucuucaguuacuguuugagucucuucugauacagggugagguuaucucuuauuguugaguuguuuucaaaaguagugguucuuuccuuauagucuauguuuucuggaauuugacaaucaugucucccauucauuuagauauuaggauauuaaggacuauugcauaaucuuaucaucaggaugguaauacuguaggccguacuguaugauuacgcugcucuggggacugugauugcuuucuuugguaccuuugcccagugguguccaguuuuacugcugauugugcuucauagugucaguucuuaacagauacaauuuaucucagucuuauauauuauaggcucucaguaauucuagugaguaaaguacuugguuauugucuguuauggguucauuuguaaaggauguaaaagacauguuccuacaaaaauuagccaggcaugguggugcgugccuguagacccagcuacucgagaggcugagguagaaggaacaccugagccugggagguugagauugcagugagcugaaaucgugccacugcagucugguauaggcaaccaagugagauccugucucaaaaaaaaaaaaaaaauugaauuaauaauuuugguaaauauauauguauucagauacguuaaaggauagcauuuugcauacuugucugguagaaugaguuggacauaauuuuuaguuacaguaaaaaguucuuuagagagcuaaaaaguuuuagugguauuuuugcuuuuccaaaucccacaugucccagaauuuggcaaggaaauagaaaaaggaaauagaaaucacagugcuguaguaacagaggugcaaaaaaaaaugauaauguuggucaaaauguauaauguuaagaaaaacaguguuugugguuaauaaaaguguauugauuuuguucaaauuuuguugagaaaauauucucuccuuuucuuauagacuuaucuaaaaacagacugguugaaguuccaauggaauugugccauuuuguaucacuggaaauucuuaaucuguaucacaacuguaucagagucauuccugaggccaucguuaaucugcagaugcugacuuaccugaacuugagguagguuaaacauaaaaguuguaaucaaauucagugaaagaaauaaaaaacuuaugcuuucauuucuauccauuuuuuccccuuuuugcaauucuugauuuuucuuugauguaggucacacacagauguuuuaaguaauaacuuuucuaauaaauuuguaauguuguuaauacuguccuuggugcuagacuucccugaauaugaauaagacaagguuuuuuuuuaaaaaaaugauuuauauuauaucauuuauucucuuugucuaauuggcauuuguaagguuguaguuauguugucuucaaguauucauguagauuuuggaggaggaaguauaaaggaagugaaaaagaguuugguugucaggacaaacaaggagcaaaaaaaaaaaaaaaaaaaagagaaagccugggugaucuuuggcaauuauugguaacauugggcuuugcuaccuaguacuaauugagcccauucacuuuaagccuucuuaagaaaguugaggagcacugaacaacucuagccagauacaaaguuugcuaucuaucuuuacaucccgcuaacuuaggucaguguuugcugagcaugguuuaguaaugugcauugauugauuaugcacaacauaauaucauauauuaaugccccugaguagcucugauauuaagaaaaucaguuauuuuaaggccuugguuuuagacuuugcagcuagguucucuggucaaauucuaaauccuuuccccauaucugggaugucaggagagaaagggaagcuguuucaucaaauauaucuuuacggugaauacaagauccccaauugcaagccugaauguagccuuuacucaugucauugcgucauguuagugugcaaaggggagcaagacuuguguugaauaacagauauacccaacaucaaaguucagaaaguucaaugaaccagguauaaugucagugguuuuuuaguuuuguuuuuaguuuugauuuaguuggcuacugaaaauuacugguuuugucuuguuuuccuugcagucaaaaaugaguuucuggccgggugugguggcucaggccuguaaucccagcacuuugggaggccgaggcggagggaucgccugucaggaguucgagaccagccuggccaacacgguggaaccccgucucuacuaaaaauacaaaauuagcugggcgugguggcgcaugccuauaaucccagcuacucaacgaagcugaggcaggagaaucgcuugaacccgggaggcagagguugcggugagccaagauagcgccauugcacuccggccuggguaacaaaagcgaaacuccaugucaaaaaaaaaaaaagaguuuaaguugcauuucuguagaagugcuuuuuuuuuuuuuuugauaugcagucucacucugucacccaggcuggagugcaguggcgccaucucagcucacugcaagcuccgccucccggguucacaccauucuccugccucagccucccaaguagcugggacuacaggcgccggccaccaggccugcugauguuuuguuuuuuuuguuuuguuuuguuuuguuuguuuugagacggagucuugcucugucgcccaggcuggagugcaguggcgcgaucucggcucacugcaagcuccgccucccggguucacgccauucuccugccucagccucccaaguagcugggacuacaggcgccggccaccaggccugcugauguuuuuuuuuuuuuuuuuuuuguuuuguuuuguuuguuuugagacggagucuugcucugucgcccaggcuggagugcaguggcgcgaucucggcucacugcaagcuccgccucccggguucacgccguucuacugccucagccuacugaguagcugggacuacaggcgcccgccaccacgcccggcuaauuuuuuguauuuuuaguagaggcgggguuucaccauguuagccaggauggucucgaucuccugaccucgugguccacccgccucggccucccaaagugcugggauuacaggcguaagccacugcgucuggccaaguguauuuguuuuuuuuguuuuuuuuuuugucaggguugaaaaaaauccuagcagguuuuuaaguagccuuaacuucuuuuugguaaauaagguguagguuacuguuaggauugucuggaggcucauauaucuaaucuucacuuuugcagauuucuaacuuaucugaccauuuugaauuuucuugcuguuucuaccauagugggguguuaauaaccuuggaauuuccuggugcagcaagcauaagugucuauagaauuugggucaguaucuccuaagacaucuguacucuaauuccaacauauacaggggaaagcauguguaguuggucuguuuacuuaccuacuccuguccugcugugugugacauuuucacugcugguaguccuggaugcaguaagucuauauauuuaacuuugcauuguuguauuuaguccauguucauugagaaacuuuuggguauagauaacauuuuacuuuuacaaugauagggauuuuaaaaugcuaaucacacuaaauaaugucaucuuaaaauguauauuauauuuuuagaacauuaguaaaaugguuuuggugugaugguuuccaugucacccccaguugagaauagauuauugcugucuucagauggguaggaagaauauauugcaguauggaucugaggauguuuuaaggcaaagacagagaauucauugaaacggaucauggcugaagaggaccaugugguacguuauaaacaguuuugugaugaauuccuggguaauggaaaggaaaaagaauauaggaagaggcuguuaagcaucuaacucuucaaauaugguuuacagucuguaauuuuuagcuuccugguugcaucuguuuucucccacuuacaugggucauucuguuuuuguucuguuuuucuuugcccacuucuccuacuuuuaauauuaccauguuugagaccuauucucccauacugaaucaugugcucuuugaaggaauuugacaaauagagaaaauuugaggaaaagcuuaucucacagagguauuguauaaagauauaaaaaaaaguguagcuauccucuaaaguuuuugaaagccagauacuauauauacauauauaauuauuuucaaaaccuccuauaaaauuuuuuacaugaguauaaauguauaacauaaaauaguaggcugggcuugguggcucacgccuguaaucccagcacuuugggaggccgaggcaggcagaucccuugagcccaggaguucgugaccagccugggcaacauguugaaacccugucucuacugaaaaaaaaaauacaaaaaguagccgggcgugguggcgugcaccuguaggcccagcuacuugggaggcugaggugagagggucugggagguugaagcugcggugagccgugauugugcuacugcauuccagccugggcaacggaacaagacccugucucaaaagaaagaaagaaagaaagaaaauaaaauaaaaauauuaaugagaguaaucuuuaaaguaaucagaaagcugguccucuuguguuauucaauuacaaggccuuuaauuccuauuugauuacuggguauaguugaaacaugucuucuaggaauuggacccuugaaauugagauauuuaucagauuugauguugaaugcaauauagcuuuugccuaaaagauuuauuaguaucugugaaacagugacugucacauuuguuuacuuccaaauauguaauuguaucuagaaaauaccaguggcaucuaauaaaauucuuuugaagucuucucagauguugaguaguaucauccacaugauaguguugucugugugaguucuuccuguccacaaacuaccaccccacucccagccaucccuaagccugguaagcaggagggacucagaauaucaugcuugugugugaugacaacgugaugucuccuccacaacaaccaggguuagccacgguggccuuuucacgucuuuucugcuccuccuggauauuauuaaguuagcaaaauaaaauauauauuuuguuggguauggugaagggucguaguggacuucauugacuuuugaccuuuggggagagacugccaauccccucacuugaaaaggacacagagacuuaggaugcugcaaacacaccacuuuguagaagagcuaaucuaguguuuuuucuucaguaguuauaaaugggauaguaugccaaagaaaaaacuuacauauccaacauagaaguauauaaucaaugcaggacauuaucauuaauuuugauguauggggaagucggugugaauuucuuaaaauuaaagaaacuguaaauugcuuuugagcucacacuuaagguagaugauaucaaguauaguaugaucugaaagagcuuuaacaaauaggcaaguauaucugauuuuauaaacaaguacccuaaaauacuuucuuuucuguagcacuuagaaauuuuccucuuauuucuauuaauugaaaagaaagacuuguuagaucaaauagugccaagaagcugguuuucaaauuuucacagauuuugucugucuguacuuaaaaucaaugugaccucacuguauuuagauuuuuuucuucucucaauaaauugcauguagaaauuauuaauuuuguauauuccaaaguaggaagaugccauaugaagcuacuuugaauucaugggaaacauucaaaacugauuacacccucugggguauauuguguauuucagcugaguaaacagccauaaauauuugauagugauggugauagugauggugaugauaaugaugaugacuaugaugguggcggugguggugauaugucacucccuaaccagcuucuuggcugauauguugucuuuaaaugucaaaaggcugcuuguugccaacaaccucuaguccuaaauuagagauaaauuuaauuagcacaugaaaaaaauccuuacugugaagugcaguuaaaaacacuuacauauuuuucacauuuucucacaugacagaaauguuauguuuguggaaaauauuaauuuacugcuguuuauguagccuguguuugaaggauuugggcuuuuaaucuuugccucuuggcguucacaacaaaagguuauguuaguuuaguauaugugccacugugucuuuuccuguuauaaagugucuuaauccaagacauguggccaagaacaauaaaaaugauuaagcaagauuuguuccuauagaggaaccaacacuuugaaccugaguuacacaggaaagccucacaaaguuuaaaaucuauuuuaagaugcuagagaguuuguuguugaugagccucaugaagaaaauguaccauaggaaaauaaaauaacccagacuagcaaaacucuuggcaauaguaggaguguugugaaucuaagaauagggaccuugguuaaaaagucucauuucagcguuagcggcugccaagaaaugaaaguucuguauaguauuugaucauauugcuuccagaagucguggugagugcuuuuacuuuucuagggugaaauacacucagcuaggccugguuuauucauuagaagccccaaccucucccaaccuacuaggaguggguuccgaagcauugccuguaaagaacagggcggucucuugaacaaaauguuaucacaccauaaaaggaaucuguuuuggcugcuuucucugcagccuggcauucuuuucggcugcugaacaaugugcagaaagagccagcuuccugaugguccuauaacccguauccccacauuccucugggagucacacugagaagucaucuuggauugggacaagugucuugcaugcuaggguugccuuagaaaacacagacuuuauacuuuuuuuguugugaacuaaaaauuaaauuuaacuacauuucuucuuacuuguagaagaaaugucuucucuccuugcacugacaauucuaaagaaagucucaauuguaggcuaguguuucuucucucuuaaaaaaaugaaagaauugaugaugucuuccuaaacuggaaaggaggaggaguuuuguucaauucgauaaaaauguguaucccacauucuuucaugaagaucuuaccccauucaaagagaaaaugagaacacuuuaguguguauauuaauguauauauuuucgagcuggucuuugguagccagguuuuguuuugugaaaugacagaucagcagaaagacaccaaaaacacagugaacugaacuggaguuugaaagugaacugacuuaaaauuugaaaauauuuuucacaggauagcagaguuggaagaggccauuggagucauccagugcauacgcacggccaaccauguggaguuuacgcuuugccuuuucuagugcucacugggcaucuauuuucaagguggaacccguagccaauggucccuaaaauuauuaauguguuuauaaauuauugugccuguaaaauuauguccauugccauugguagcugacaggcuuuauaaagugugaaugagugaaugauuggcuauuucuuaucagauugaauuccuuuuaggauaguucauauuuggcauaacuuccaaggaggauuuucccauuauuacauaucaccugaucauagcuguuguuuuggaucaguguguauugaaaaaaagaacagagagacacaaaagggauauuaugacuuugauaacuacaguagugucagaauguguugguuuuguuuucaguucuguuucugaucuuaauagaguuguuaagaucuuugugcagcagguuagugcucuggaacugagguaaauacccacuccuaauucaauuguauuuuuuuuuuguuguauauauuauuuuguuuacaauauauauauugucaaaguuuauucugccagccccaaaugaacaaguuccaaauugcauuuauuugucuaaugagacagauaaaaagcacugugaaacauugccauuucaucaguaaucaacuuacuauauauccucuaagaacacugcacuuuaccaaguccuauaacaagugcuguagagaaaaagagagauuuuuuuuuuuaaaacauacauauaugaaagguguggauuuuggggaucaucaccaccaccacuuuuuuucuuucuuucuucuuucauuuuuacuuuuucuuuucuuuucuuuuuuuuuuuuuuuuuuuuuuuuuuuuuuuuuuuuuuuuuugaggcagggucuugcucuguugcucaggcuagagugcaguggugugaucacagcuuacugcagccucgaccucccugggcucaggugacccuuccauuucagccucacuaguagcugggacuacagacgugcgccaccaugcccagcuaauuuuuuuuuuuuuuuugguagagauggaauuuugcuauguuguccaggcugguuucgagcuccugggcucaagugaucugcccgccuuggccucccaagguguuagaauuacagaugugagccaccaugccuagccaccacuacuucuuaauagcuaaauaggauuuaagauuaaccaucacaccaucagaucugagcccuucaacaacccuuaacuuuggauaggaaauaggaaagugguuuaucccuaggcuacacuauuucauaauuaauagaaaugaaugagauauauuucuuugacauuuuauaggucacuaagcacuuucaccucuguuaccuuguugaacaugaucucuauugcauuucaugccccuuaagacaguuucauaauuaugaaaauaguuguuagggauuuuccaagggaacaacaucaguauuuacacaaggaaggccuuuguauuuuuaaaauuucuacuguagcuauaauugguucccauuguuauuucuaauacuauaaauuugugcauucuuuuucuuuauccacuuuuauggaagaugguguguuuuaauaacuuuuuuuuaacuuagcuuuugauuuuggauauuuugcucauugauuaccagugauuuuuucuuuucuuacaggagcuuuuaaguccacaauuucccuguccauagugcuuuagcugacuccuaaaaguuuugcuaugcagugguuguuaaucacucccaggcuuuucuacuuuccauuauuacuucuguggcuugugaguguuaaauuucuuuuuauuuucauuuuuggugaugggcagggucuugcuccaucacucaggccggagugcaguggugcaauuacggcucaccacagccuugacuuccaaggcuuaagcuauccucccaccuuagccuccgcaggagcugggacuacaggcaugcaccaccaugcccagcuaauuuuuaaauuuuuuuauagagauggagucucgcucuguggccuaggcuggucucaaacuccuggacacaagugauccaccuaccucagacucccaaagugcuuggauuacaggcgugagccaccacaccugggcuaaauauuuauagaacaguuuuuaaaguuaucuuuaaaaguuuacuuuuaauuuaguuauauugugucagagaauauuaucuguuugaaauagauucauuagauuggucaaguuuugcuaugcauaguuaauuuuguaaauauuccacauacgcuugaaaacaauauauguuuucuaagucugguaugcaggguuauaguaaguacagcaaauuuaacauuuuaauuuggggcuucacauuuccuccauuguaacacauuuugcaucugcaggucugcaggcagagauaaccuggaaagguacauuagacaaggcaccugguacucuuuuugccuguugcaaaauuguucacaauuuuuuuucugauacuccaaauacuucagauuuauuuauuuauuuauuuauuuauuuauuuauuuauuuauugagacuuguugagucuuguucugucacccaagcuggagugcaguggcaugaucuuagcucacugcagccuccgcuucguggguucaagcgauucuccugccucagccuccugaguagcugggauuacaggcucccgccaccaugcccggcuaauuuuuguauuuuuauuugagacaggguuucaccauguuggccaggcuggucucgaauuccugaccccagaugauccgccccucucagucucccaaagugcuaggacuguaagcgugagccacugcgcccagcccaaauacuucagauuuauaucaccacauacaagaauugugcacuuucaugaacuauuggaacaggucuguaaguagcaaaaaaccaaaaagaacgaaaagaauaucagcagugauacucaguggggauggugaaauguuuccuuucagauuguguguccuaagaacugggaaagcuuguuuguguguggguggcuguggggggugggcugaagcaguagcuaguguuuuagggcaguucauuuacuuuuguucaaucaauaauuugaaugggugaucuucagggaauuuaaguaaacuguuaugaguuguggccccucaaguaaauuagucccagaaccagacccuugugaccucaguaccaguaggagagaacagccugggauuuucagcagaggcaaccuuugaacauuugaccacggugccaaaaaucugcaagcaguuguuuacagaauucuuaggaccagccuggaguccuuucauuccaccuugcaugauaagaucgguaaaggaagucucacuuucuguauuccuuaggagucacuuuuuuuuuuuuuuugagacaggcuggagugcaguggcgcgaucucugcucacugcaagcuccgccuccuugguucacgccauucuccugccucggccucccuaguagcugggacuacaggcgcccgccaccacgcccggcuaauuuuuuguauuuuuuuuaguagagacaggguuucacuguguuggccaggauggucucgaucuccugacuucgugauccacccaccucggccucccaaagugcugggauuacaggcgugagccaccgcaccuggccuaggagucaauaaguuuuuuuaacuuagauuuuuagaaucccagaaggaaauaucugcugccacagcacuuuaaaaauacaugaucggccgucucaaaaaaaaaauguauauauauaugaucaauguccagguaggauguaggugauaccagcuuagagagaaauuggcuagucuuguuagacauaaagucuuaggauuuacacacauuuuguauuuucucugagcuuagaacagguucuuggacagagcaggaacucagcagguguagaaaauaaucgacuucuuuucaguauuugacaugauagcgccuuccuuuguugucuuuggucacaugcuuuccuggucacuuuucuacuuccuuuuucuucucuauuaccguaucuggauauucuuucucuuccugcaacuuagugcuagaguucccuaaagcuuuggucuucaaucuucucuccaagaccuuaugccucuugugucucaaauauguucuuuaucccuuugacucaguugagcacuagcccuuauuuccccgguucccuaauauucaguuccucuuagauguccuagugacccucaaauuccaguauguucuagacuaagcccauuuucuucuuuuccaaauuaguauaucuucgauccuuguuucuguucaugcuccuacuguuuuucuccagcaccccaggucagaaucucagaaauuaucuuugaccccuuuccuccauucauuuuuacauaaaucaaucauuaacuacuaguucaguaucucauugccucgugcuuggaauucugugcccuccuuccacuguuuuccugguuuaccuguacguuuuauuccagaggaaaugagaaaaggcugcacuguguagaggggagaucacagaauuugaucuaaagccugacccacccgguuucaaaccugaacacagaggcacucacuagccaggcaacuuauaaugaauuauuuaaauucucugaaugucaguuuuugugucugaaaagugggaggucuuaguacuuauguuacaagaugguugugaauauaaauaaaauaaucgucuuagugccaacacagucccuuauauauauuagccaagaaauauuuguugacuuguugaauuaaguuuuguggcaugcugugucaucaugcaaauugaaauauggguuaagaagcaaagugucaaaagagcuaguauuugaguaaaguaaguggauuuuuuaguauuuuuggcaaagaguaaaauuuuuggcaaaacuuuacucuguguaaaaauguuagaacacuaaagaagaaucuaguuauuaguaguugucaaguuauacaauagaagcucucugaagauucauuuccuuggagggaugaguaggaaaaaaggauguacguacacuaauauccaugcauguuccacauucaaacauuucuagaaauaaauggagaggaacgcgucuucaagugguaaauggcaauaugcaggcaucuuaauuuuuauuaugaauauuuuuauuaccuuaaugucccuagguaaaaauugaucucaguagacugugcucaccuaagucaguaucaguaucccuuuccuuuuuuaagggggaaagauguuaaaguaaaaaauauauauuuuuggccaggcgccguggcucaugccuguaaucccagcacuuugggaguugaggcaggcggaucacgaggucaggaguuugagaccagccugaccaacaugguaaaaccccaucucuacuaaaaauacaaaaauuagcugggcgugguggugugcaccuguaaucccagcuacucaggagguugaggcaggagaaucgcuugaaaauguauguuuucuaggcuuugguaggugguauggaagagaagcaaaguaggaauaccuuccugauaguaggaaacuaggguugauuucaccuggcacauagcuccaaaaagugggagaauuaucuccacugcccguguaucuuuccuagucauuuagugauaauuuccugugugccaggagcaaugaucugcacaaugguauuuuucaagacccagagcuuaggccgcuacaagucuuaauacuuaaaagcccacaucuacauuguugccucuaaaaguguuugcaaaauuaauauuuuggcugguauuacauauugaguucucuuugaacauccacaguucacuuauuuugaaagcucaauugauuuugagcauucaauuccauuuuaaaauagaggaaauuuaaagcagugguuuuuagagcacaaaauaggccuugaucuuuuggaauugaagaacucuuagaagaaaggagagaaaauaauuaagauagagcuaguuaucaaaacugcccuuugaaaucuaaguguagacauugguagcuuacauugguugcugaccguuggggggaauauauauauaugaauauuuuaagcagugguuuauuuauacucacgaggagauaggcuauuauugugggaaaccaguucaguugcaagaggucaaauauggugcagguaugcauaggaaaaugcacugugaaauaaaugacuguugcagaaauuugccugaauucagacuugcuuuagacacucuguuuuuguuuucuugcucuucucgcaguucucuuuucuaaaguuaaucuuuuaccuucucaacacauggcuuuuauguguuuggagugugaaauugauugguguagcuuucaagacuuguuucagauucaauucaaaugaugauucuguuuuucuagucugaaaacauuuuaagucuucaaaugauugucacagucagguuguaguuagcauaacugcuuucaaaguuagauuuaaacuuaggcucccagauuuaauauacauuauguaauuaagcaccuauaauauaaauauauaagauaauaauaaaucucuguccuaaaaauuaaugucaaauguuauuuuuuagcuuuacauaaguguaaagauagucucuauuugauuuuagcuuuauagcauaaaauuacaguugaccagacugucaccaggcaacugaaagcaaagcuuuuguuguuguuguuguugcucauugucuuagacguguaauuaaugaugguggaauguaggggaagggcaggcaaugaaggggaagcacucagucauuagggggaaccagggugagacauuuugccaugguggauuuuucagaauggaacaagcaggaaaaaggaaaugguucucuauggauauuguucacugcugugugcauauaaagacaacagucaggugucauaugcaaaacagcaaaaaguuacucuaacuuugaugagaagcaaacaggguauucauaaaagagcauaaaaacaaaauuaggugagguauccugugaaaaggaaacuuacuaggcuaaaguaaaauaauugcuguuuacuguaggucgagugccaagcacagacaguaauauucaaaucaacaaugacuggauccuugcuagcuccuuucccuugcugagacucaguauuggauaagcccagaguauccacgcugugaaaccugcccagcuuucucugucacucuuuagauucaggccugugucauuuccuuaauaguuuugugaugguuaaugacuuuacaucauuauuuccauuacuauuugaaaacaaguaguaaacagagauuguaaccccuggauauucaugcuuuuccagugaaauggcaggauccuggaauuaggaaggaugagagagaaaaugucauuuauaggauuauauguuguagucuugguuauccagauuggaauuagguacaugguuuguuugggccugaaauuuuauagcccagccugauucacccuggcaugucugagcuaucucuuuauuuuuaauugguauauguuuucagugagggaaacauuaaaccauauuuuaaagguggcuaaaauuuuagcaauuaggauguacaauaaguaaaauuaauaaauagagucauacaccacauaaugacauuuuggucaacaauggaccacauaugugacagugguauaagauuauaauggaguugaaaaaugucuauggcguagugacauaggcguuguagccacaucuuaacaucugagcauaacacauuacccuuucuauguuuagauguguuuagauacaaaaauacuuaucauugugucacaguugccuacaguauucaguacaguaacguguuguacagguuuguagccuaggagcaaugggcuauaucauauagccuagccauggaguaggcuagacacuuagguuuguguaaguacuuucugugauauucacacaauaacacaauggcaugaugaagcauuuuaaagaagguaucguugucauuaagcaacacguggcuguaaaaucgagcugagcacaccuaugcucucuauggucaccuccucgcugcuuuguuacauuaguggcuaggugagguuuaaucuuuauauauggaugugguguugggcuaagcauuuucacaucuauaaugucguguuagguaggucuuauugucucuguuuuauagcugagaaaaccagagagauuaaaugauuuaccugauuuguggcaaaucaucucuaugguauuugaacccaggucuuaaaauuucacaacagguggccuuucucucuuuaucucuuacuuaaaaauuggcuuagucugggaggggcagucucuugacaaucugaaagguuuuuacaauuggugacuuuucugccacaccaagcagccaauugagugaguaaauuuguuauauaaauuuuucuauaaauuauuuucuaagugaaaauaauuuucuguauucuguuaagugaauccauucacugaaaauacagagguauauuccaguagaauuuaaaaauguggguauuaugcucuguuaauaaaaucaccuguaagaacauagcaugucuuuauaaucacauaucuuaaggaaaauaaccuuuugauaaaccaauaauaaauaauaucagauacuaagauugagacucaaacuauggacaucaauaagugccauagucaaaauacaucaaaauaauacucuaaaaguaaaaccagaaaaagugauuugguuuguaaauuccuuaauuuaggaguuaagugagggauagugguacuugaagccaagauaaauguauccugcaaauuuaggcugccaagaauguuuagauuauauugagcugccuuauuucaucuugaaaugaugaaauagacaaaugaauccagcaggaagucauuuaacugaaaaagauggaagaugaagcauucacaauaauauggaucugguaaaagcccacugccuucccucucuuucucuuuccuccccacccugaucuucaacccagacucugcagggacagugacaaagagacagguuugggguagggguggggguguagacuuggcucuggugauguagcuugucggauacaauauggccuuauuuucaaacguucuuucagcacagagccaguuuauagcaccaaggcugcagaagaccagggguguaggauaguggauuguggccugaggcacuuacuugcuugagaaaaauugcugccagaagagugguuucaaaaagcugaggcugcugcugugguugcuaguggguagaggauuaaagggaaugcagcuuuuccucuccugucuaaauauuugcuggagagcaaaugggcuuuugugugccuguguauuuccuuuuucuauuggggaaauuacaaguaauacaggaacauccugugauaaaauauaugaaguagaggcugagggagcagagagaugaagucgaagaaaugugccccaggucuguggccugcuguacggugacuaaauucuuagcauggugaauugguaagucuacagaugauuaacuacaguguaaacaagacauauauggaacauaaauaugagauaggccauuccaucagcagcuuuuaguguaaaaagcauccguuccccucaaagagaccaugaauguuuucacaagcuuaaauuuuauuuuauuuuaaguaaguacccacucuggaagauuuccaaugagaauaaacccauguaaucucaaauacucacgcaucugaaugagcagaacuuucuuuguguuucucaaaguaguaugauacaugacucucccaguuccauaucugcuaaucugguuagaucccugcaccaacuagugagacggauaacuuagaguguaacucugaguuuccaggcaaagaaauguaggaaagaucuuaacuuguauuuguuaacucugcuaaaaauaggaauguagaacuuucuugaaaauacuaaucuuuguucucauuaucccucuucaaaaggagguuuacguauggcuccaaauaaauagacuugccuuauuaacauuuuuauuugccgauccucacuuuauaaaauugcauauuaacaaauauuuuauaaccacaaguuacauuucaaauuauuugcuugccaccuuuuaauaaacugaguucucuuuucugaaggagccuuuuuuggagcuugaaaaaagcccucacagcaggguaacaggaagacccccuccuccagccaaaagagucccacugagccccugcuggugagagagagccuugggagggaugugagaggcagaaacacaggcugcuggcccuagcuccucccuuccaccguccccagagaccaggagagagugccagugcgggcccauugcccuuauucucuugguccaauccugcuaacuagggaaagugaagagcugguuggucuuuugcaagccaggaaccuaccaggagggcacucaaucuccucccuccuucugcuggacccucuuaaagaaaaaucugccucuuucuggaaauagcuuuuuccaugggucugcacaauggagagaagauaugacuguaucucuucuugcuaaaacauaguuacauggguaauugagugcccuggagcagcagagauaucaagguguugacaaggccgugcccagauuagaaagguucuuuccacagcacagcaccugcuuuuucugagcucaucagguagagcugcccuucaguuaaccagauuucugcucccucauauggaggagagucaaacuucuaauugaagaaugacauauauucagaaaagugcacagaucauaaguauacaucucaaagaauuuucauguucucacucauaggugggaauugaacaaugagaacacuuggacacaggaaggggaacaucacacaccggggccugucgugggguggggggagggggggagggauagcauuaggagauauaccuaauguaaaugacaaguuaaugggugcaguacaccaacauggcgcauguauacauauauaacaaaccugcacguugugcacauguacccuagaacucaaaguauaauuaaaaaaauaaaaaauaaaaaauaaagaauuuucacaaauaggagcacucguaacacauauccaggucacauuuaucauuuuauaaugauguuucuuuccugaugauaaaagcacuuguagaaaguuuggaaaauacaucaaaguauaauaauggaaauaaaaaccauccauuguaccuauacccgaagaggaguaccgauaguauuuugguguauuuccauucugucugucucucccccucacauacacagauacaugcaugucuauaaauacacucacacaggaacacagcuucugaaacuuuaugcaugugugugcaaacacacagcaguuuuauuaaauaguuacacugaaugacauacagauuuuuagauauuucacucugugguuguuggcuucaacaccagaagggcagagaaagaaagggaaacugaaacccaucugucuuuuugcuugguagcaggaaaaaggggcuuuuugugggggaggagauugaaauaaauggcugacauauaaauaaggaugguucguagauuuuauuuaucuaguauuuuccaucuccaugaaaacuaagcauugaugauagaaaguucagaaacuucuggguagagacccucuucuuguagagcagagaugagacaucaacuuagacuuuuuuggcugcucuguggaacuaaaccccucugggcugcaguuccacuuugccagaagaccaacuuuccuuucuuucucuuuuaguuagcucucuugcagauaccaaaacagacuuaaacuguagcaacccuuguuuuaacaaaaggaagcugagucaaaauguuggaaaugagcccggugguuuugugaguugcagcaaaauuaucuuccccaucccuacugcaauggaugaaaugaugccuguguggugcugguugcuuugguccagcugaguuuccugcacacauugucaggagagggcaguuggcaccagcuucccguugcuauugguugugcaggaugugcucuccaucugccuccuggcuggccgagggcucagcuucuaaguggcgguggcgggguggcgggguggcggggggacuuugauggcauuccuuguguugaauaaaguugucucuuugagaacugcccauacccuuauuuuuuauuuuuuauuuuuuuuuaaaaaaagaaaaacauauuuuguuuucuuacauacuugucauuugaguugucacacagaaaauauauuggacuucuuguauuuguaaaaugucuucucagaucacuccuuuuuccuuucuuguuaaaaacagguucacagacaguaugaaguggccuuucuguuuacauguguucuuguuguauugucuuugcagucgaaaucagcuguccgcccugccugccugccuguguggucugccucucaaagucuuaaucgcaaguaacaacaaacuuggaucauuaccagaagagauaggucagcucaaacaguuaauggagcugguauguuaccgauuuuuaagaugcucuuuuuuguugguugacugaucauagccucucaagguauucagaaaaccuuuuugcuacgguuggacaagguagagccucuguuguuugagggcagguauaugauaaagacauuaaguggggagaggaacagcuuugaaacuucacugugacagacacaguuccuggaauuuaaaggcuuccuguaauuuacagcuccugaaguuugcaggauuugccguuuuugaaguuuaugggcuaucauguuguaguuaguauuuucagauugcauauaaauuuguaaaaaauuauggcuaaacugccaaaauaaucuccaaauaaguuaguaggccacacuucaugaagguauaaaauuaagucagaagacagaaagaauggggugcucugauucugucgagauuuuagaaaucauugucgcaaaucguuguaauuuuaaaaugugaccgugucccuagggauagaaaaggagaacaagcuauagaugagcagagauggauuacaaaugugugugaagcugagaugcacuguuauauuucagcucuuucacuacuaauuuaauuauuuacccuuuuucuaaauugggaaagaaugaauacuuucuaaacuuccauugagcuaacauaggugaaggaagaagcaggaguuagcagucaggcugaaaggugauagucuucauuuaucaucuaagcauuggcuuauuccauccugaucuugugucaggcacagggcuugaugugauuaaaugaugaaaagggcacaguaccugucuuucaguagauuccagucuagaacaaugauggccaauaaguuuugucuuuugugccaacuccucuggggccacccggagcaccacggugcuggccugugaggcccagauagagaaugcugugauugcuuagucaugucuuuagugggauugggcuaggagagugauggcacccaugucacauacguaucaacuuugacuuuaauauagaaauuaauaauugcuguagaaagacguuagagcuauagaaagugucuuuuucauggauuauuugauagcauuguccaaaacucauuccagcuagcucacaccaaaagucagcguugguuagaggauacagggguccaucagaucacuuacgaugaagacauuuggucacaggucaugagugacuaggacaagacacuggaauguugugaaggaccauggcagcgguucauuuuucugcucagcuuuuccucuuccauacaacggcagagguugcccaaguuuaaauguucucccagguaaagcaccuagcaagagaccuacuagcaucucucagcccuggguucuaagugagaggcagaucuggucugauguucucgccgacugagucugcugugcccaaggcacauggucacacugcucagauguggcuguugggcugccaccaaaggggguaauucugaaagaagacagauauuaauuugagcagacacugcccauccccccccaacccuguccccaaaaguuucuauuacaagaagcaugugcacgaggcagggaaugauuaauuaauucagucuucggguugugagagguuuggaaaagaagagcccuuugagaggccccuuaaauaagcccaugugggauuuccuaggaggaaaaaagaagucagggacagggaaagcauucaaggagaagggacagcuugugcaaaggcaauacauccuagaaguccaugucgugcuugggaguaggaagccguuuaauccugcugaagucuagguagauagaauggggcugggcacacccuccucaugcccacugccuuagauuuaggccacaggcaacuccuucacagggcauucgaggccuucuguggucaggccccugcucaccucuucggguucaucucuugccacuggcaccuucacucuccaaguuccuaccuucugggaaugcaccuuguucauuuucauuucuggacuugugcacacaucacucuuucgucaugggcuguuucuuccuccccgcuccuuucuugguuaguucuuagccaaguuagaucucacuuuguccaaaaagccuucccagauccuccaagccugaguuaggugcuccuaaggcaagcacuccauacuuauuacucaauuuucauagcaucacaguuguuuucuuacuuggcuuucucugugccagcuccccccacacccugauagcugcuuacuugcuguugcaucccaggugccuggcaccugauaggcacccagcagauguuugcugaauguuacuguugaaugguggaaggugaaccuggaaagauggcuggggcagauugugaagaccgucaggugcugggccugaauggggcugagggggcaggaagacucaaucuugcuguccacauaacucagaaggugccauuuuaacugguucuaggaaacaaaaaauuuccuaggugaaagcuuuggaugaaagugacggucauaugcugcugcuuuuucuuuuaaugcuucuuuuagguaucugauagccacaaaauccaugguugcuaaaauuugguuuaggauuugcaaauacaauaugaauaacaacuaaaaaaaccagacuuuauuuuuaagagcaguuuuagguucacagcaaaauugagaggaagguacaaagauaucccacauacccucuacucccacacaugcacaaucucucugucaucaacguuccccaccagagugguucauuuguuacaaucugugaaccuauccggacacaucaaugucacccaaaguccacaguuuacauuaguguguucacucuugguguuguacauucuaucgguuuggguaaauguauaaugacaugugucucuuucacuacccuacaaauccucugugucaucccucccuccuccucaacccuggcaaccacugaucuuuacugucuccauaguuuugccuuuuccagaaugucauguaguuggaaccauacaguauguagccuuuucagguugguuucuuucacuuaguaauaugcauuuaaguuuccuccauguuuuucuauggcuugacggcucauuuuuuuuagugcugaauaauauuccacugccugcacaguuuaucuccucaccuccugagggacaucuugguggcuugcaaguuuugccaauuaugaauaaagcugacaaguugcuuuuuuuuuucauuauuugaggucccgugcagauggguggcacaugggugagaucaaucuucuggaacuuuuuggugcugauacgugcuucugucccaugaaccuuggguguaaaugacaccgcaugccuuccaucagcugugcucuagagcugugucaaccagcucaucuguuagcagguggcacaugugcugagccugagagucagccgcauacuagagcagggcuuuccucaaauacccuuugucagcugcagggcugacguguaaacagcguugucuccagcgucaggacacacuggcugucggguggcucuaagggacaccccaugcuuuucuugggcacccuguccuggccccagcucuaacgagggcugcccugcauuacaggacugucuucaccugguucuugugucuuuucuccaccagcaauaacugcugaacccacagguucuaggaucuuagagugauaggggauuguaaaaggcauuuaguccaaacucuugacaucuuacgaaugaagaaacccgaggcagaaagccagugcaugacauacggaaggucaccccuguguagcuaaauuguaacauaagcugaaacacccucacccagcgcaguccuguggaaauauaauguaagcaguaaaugugauuuuuaaaguacugguagauacauagccaaguaagaagcaagugaaauuaauuguaauaauauuuauuuaaccugaaauagccaaaacguuauuacuucgucaccuguauaauauaaaaaauauuaaugagauauuuuaggugcuuuuuuuucaugcuaagucuuugaaauccuguguguauguaacucugaaagugcaucacagguuggacuggccacauuucugguguucaguggccacccuccuggauucggcagcuccgucaccuguguucuuuccguucccugccccuguguaugagcaagcgugaucuuuggaaaagcauuuacuuaugaaguuggcaaaaauuuaauaaguggucauuauuuaaccacaaagagggacuggccuugcuuaaggucacggucuaaaaaaaagauuauuuuccauccauucucacuuaucuuucaucuuuuugcuuaaaauaguaguguuacuauagguaaccauaucauuauuuuuagcuaucaauuggaaaaaaaaauucccuggagggccagaaguaauucuagaauugccgugggaggcuucuguuuuguagucacgaaguaaccaacuuauuauaagauuugggagcaccccaagcauucagaauacuugaagcccuuuagcgccgagacagugucucagcuuauuaggcucuaagcauuguuuguuaacuauuuuagaagaaauauuuuuaaauuguucacauuagacucagaguauuccaaauggaauuuuuuuuuuuuuuuuuuuuuuuuuugagacagagucuugcucugucacccaggcuggagugcagcggcugucgccgaggcuagagugcagcggcacaaucucugcucacugcaggcuccgccucccagguucaagcaauucuccugccucagccucccaacuagcugggacuacaggcacguaccacugcacccagcuaacauuuuguauuuuuaguagagaugggguuucacuguguuggccaggcugcugucgaacuccugaccucaagugauccacccaccuuggccucccaaagugcugggauuacaggcaugagccaccaugcuuggucagaauugugaacucucuuuuuuucuaagugugagugaacauuccagagucagcaaucccuuaaaaaaauaaauaaauaaaauaaaaaaacuuuagccaucuacaacaaagcaguuguccuuucuaauuugugaaaggaauuggaguuggaaaaugguaucuuaucuuucuaaauacauuagaauuauauaagaucuuuuuuuaaugcauucccauucagucacugccuuguccugccauuugagacugugcagggaaugucgaaaagcaguuguucccccucccaugaggaagccacaaagagacacuacugagauguccuuuucuugacucaacaagagcagccagguuguauuuccacauuguugcaggugcaggaaaacuuauggaaucuuagcuccauggagcuggccccuccagggucauuucagaugggaaugaucugaaacuuucugaccuuccuggcugcucugaaugacuucuaugugcucuguugccucacugcuguagcaguauggauauguugcuuuguacgucuaucugccugugcuuucuauaaggggaagagauaaagcauucacauuuacugagcaccugcuauauaccaggcacucugcuagguauacauguauuauuucauauagucuugaaaauaagcuagcaagguagguaucauguuuauauuuuacaaauaaguuucaauuuuagaauuacuuagccaaagccacaaggauaugaagagguagagcuggagucaaaaccagguuuuuuaaucagcguccucaccacaauacagcacugucucuucaccgaaacuguaagccccucauggaguggggcugugauuuuucuccuuggaguucccugguuuaacuccuagugguuuuuccauuaaaguugugggaggaaaauguuacaaaaaaaaagguuugguacaaauggucaaugucucacuaauguuuuguuacuguggaaccaagagucagggaagggaucuguagacuuguguuggcuaaaucucauuuuacucauuaaaaccuuguuaacauauuggaaacaugguucuuuuacugcuaaaccaugccugauggaugagguauauuuguuaagagaugcuguauaaaugccauguguuauaauuaacaggcagcuguaaaaacaaacacacuguuagaacacaauaaaauugagagccuuuuauggggcauuugccaaagaagaguuuucucauugguucccuguacauggugacauguugugguccagagauguuuuuuuuucaauucuguccucucugaagucaugcagugugugaaaaucaugucuucuagcucuuaccuucacauaagagaacacaguaucucugauuuaaaaccugcuuuucuaaucaaaaaucucacaaggccuggcucaaguaacgacuuguuggaaggugcauuuccuggccuugauuggauaugcuauuuuuuauucuuuuuucaugaaauguuugguuguguggagaguuuggauucaaagauugauuauugagcagcugcugaggaaaaucccuucuucauuauuugcuuggguagcguuccaaucucugagggagauaacagcggaggcauaaauucacgugcucgccaugcuguuuguccauucauugucucuggaggcgccuccuaaccucugguuucugugggaugauuggaaacccagggcuugcgcaaggcccucugugcuuccauuucugccuuucuucugaagagcagugggguaggccguguguuuguaaacuuaggagaacugugcaacagaguuuugcucuggaaaaagacacugguguugaaaggugauaauuugucaucccagagcuuucuugagaaaguuucaaguuuaaaugaacauauuuucuuuuuaagacagcgaguucuggccgggugcgguggcucaugccuguaaucccagcacuuugggaggccgaggucaggaguucgagaccagccugaccaacauggugaaacccugucucuacuaaaaauacaaaaauuagccaggcaugguggcaugcaccuguaaucucagcuacacagcaggcugagggaggagaaucgcuugaaccugggagguggagguugcagcaagccgagauugcgccaccgcacuccagccugggugacagagacuccgucucggugggguggggggaaagacagcaaguucugaccacaagcauugaggguuuuugacuguuaagaaaucaaaauugacauuucccgguuaguuacauaccuguguuucaaccaaaaucauuucauuaucucugauguagcaaauggacuuuccucauauuggaggauaauuagaauuauuuaauccuuaccuguucuuuugauagagacacagaaaggguaagacauuuaccuaaaguuacacagugagucauacaaaaugcacuuccacaaaagggcauggcuacgugauaggaggcuacuauuaguagcuugcaguuccugucagaacguuugcauuuuauucaauuaaauaaagagcuagauucuuacaaaaauacaucucaagcaguauuaccauaaaccuaagugucagagcaaggucacguguacaaauacuaccugcaguuccaguguguguccuggucuuacuggaauuauucuguaaccaagaucaucuugacacaguauuuauauuguuuuucuuuuuucuuuuuguuuugagacagggucuuacugugucacucaggcuggaaugcagugccauggucacagcucacugcagccuugaccucucgggcucaagcaauccucccaccuuagccucccgaguagcugaaaccacgggugcaugccaccaugcccgacuaauuuuuuaagucuuuuuguagagucaggguuuccuaauguucucuaggcuggucuaaaacuccagagcucaagcgaucugcccaccuuggccuuccaaagugcugggaauauaggcaugaaacaucgugcccggccuauguugguuuucacuagacaucauuccuuaaaaaaauacuucuagucagccgggcacgguggcucacgccuguaauuccaacacuuugggaggccaaagcggguggaucaccugaggucaggaguucgagaccagccuggccaacauggugaaaccucgucucuacuaaaaauacaaaaaaaaaaaaaaaaaaaaaaaguuagccaugugugguggcacacaccuguaaucucagcuaccugggagacugaggcgggagaaucgcuugaaccugggcggcagagguuugcagugagccaagaucgcgccaucgcacuccaaucugggcgacagagcgagacaaugucucaaaacaaaacaaaacaaaaaaaacuucuagucucuuuuaccauauugcuuucugaaagugaguauaaccuaguuuaauaaucccugaauuuauucuccgaauuuaaauccuuguuauuuuugcauucugaaggucaguuagcaacgagcacuuaguaacaaaaauauauuaaacuccaacaugguuuuaauacuucuagagacucuuuuuauugugaugaggagagaaucuuauuucuaaaguuuuucuuuugguuaccuaaaaacaugaugaccaguggaaaguaaguauguguuaagucacaguucaaauucucuauuuuguuuuuuaucuaaaugacaaaguuggacugacuggucuauaaaaaacuuaaacuugaguauuuauauuacuauaauuagauucguuucuaucaaaaagaauaaauucaguaaauauuuauaacaugcucaugauucuuucugaucugccuguguauuugugguauuauaguacuaacuauagggugcuaugauuucacugaaguuuggaaucauucucuaagacauagcuuagggcuaauagaaaauucagaagggauucauuugacuauuuuaauaaauaacugaauauggaauuuauaagcugauaaauucuuacuaauugccgaaguugaggcauuaguguuguuuuuauuuacauucauuuuccuaaaucguaucuucuuuaaaucagucuguaaaauucauaccuuaucuuaggcugaauuugaacaaaaguguucuagagaacaaggccauucuagaaauauugcuuuuacauuuucaaaacaggaguauuuuauccccaaacaccuagacuauuaucuccuguuucuuucuccuuaacccccagcuaauucagauagugacccaugggguuuuauuuuugugaugaauuuauaaccuuuuuaaaacguggcaaguuucaaugccuugugggaauagaguuuugcacuauuucuacaauauugauuacacaguagugaaauguuaucuuaugugcuaaaucugcuugggcguuuuccccccauuauuugucaggacaggaaguaauugacaacagugcagaguacuauuaaaauaauuugaccuucaccauauacccuccaaaaugugaauggacaauuggacuuuguguuuugaauugucuacagauauccuguccucuaaaucagaaggaaaaaaacuuguauuuaucguuacaggaaguuuuuuaaaguaaauugaccauuuucccuacugccaaauaaguuuucaaauaucgcuagggggaguugauuuuuuaauaaggcuauuauguuagaaacauacgauggaaaaaaaucaccuuaugauuagagaaacagcauauuuugauuuccuagcuaacucaaccaugaccagcaaagagcaaggugaguauaguucacacuaaaaaauggaauaaggcuuaguuucaucucaugcugugaauaacgugcuaccuaaauguaucuguuaucuuuuugcuuuccucuccuccuuccuuauuuauucagagaaagauuuuuaaaaaauuaugucuuugaagcuucuggaaauugucaguuucauauugaaaaucugugauuuccauaauuuauauaaggaucuuucucgugcugucacucacaagacugaaaaaacuuguuuuagaugccaauaacguccauuuucucuagagauggcaaauaauuccuucuaauucuuccccacgagcacgcccauuucuccugccaacaacaucacccaagugacuguaucuggucaugaguuccauagaaggauuugauuuccugcauuucuaggacucaccugugugguauuugugugaggacucuuuuaaaauaggauggaauggcaccuuuugcuuauuuguaacuuaguuaaggcaaagaaagcuuucauugaaagcauuugauuguuggcucuugugacugagcaaaggcccccguaauugggaaaagauggcauuucacuguucucuucucccauguggaaauacauucggaaaggcagggcaauuuacugacucagcgaggggcugagagugacugaacacgaucucuggaccuccuaauucuguaauuacuuccuuugacguuuuugucucugcagaugugcuuguggaguuuguuucuguuuuuguuuuaaacacuggaaguguuuuucucaaacuugugugugacuuuucugggccaggagggauagagcaaccgcaguugggggugaugcugcugaacacccggugcucucagcccgugccaccccaccucccccaucagacagcuguacagagaagcuuggggagguaucugcacugugcacacucagccuuuauagaggacaacuucauuccuuuuuagcaagagugauacuguuccucuucaucgggugguauccauugagcacuguccuggugaggacagguugauagaucaccugaagccuuuuagaugagaccagguuagagggcagggaucaacuguguuguguacagccuggucuaaauguggagccuggggguguucacuggauuggucgaugaugaguucaucuuauuugaaugaaagugaaacagauuucugaaacgaggcucugcugccuucuauggugaaaggggagagcuuuuccagguucaaaaguaaagcgggauauuuaaggccuugaucucacuggaaucauuuguaucuuuaguucugugaugccaagugggaccugcaugggauuugguauguauguuggagcauccuggguccuaggguccuggagacagaaggagccacaguauuauggagugucacuguaaguggauuuuagaaguuugauccaacauuuauugaucccuuacuuuauacuuggcacuccaccuggcagugggaggauggaaugaauaagacauggucccucccacccaggagcucauagguuuaaaggggaauguaaacccaugagcaaaugacuuacagugacaugcuaucuaaaggaccacacaagaagaaguggucagucucccugggcauuagaucagagugggagaggugggggaagccucgugaaagauuucacgaaagagguugaggcuugaauuaagucuuuaaaaaugagucagugggacaagaggacaauauuggggacuggcauaucaggcagggaaggagcaugaacaaguuugggaauuaugaaauacugaaaacugccagaagcaguaacauggcuggaguguagguugugaggagggacauucagagaaaaagugcuggagaaauggacagaccucaucauagauacuggccuuacugcccaguuuggacuuuauaguuguugaggagccucugcaaguguuuaagcuggugaacagcaugauggcauuugcacucuggccgcucugugaaggaugcauccaaggcggagacugauguauggaaaccagucaggagaucaugauagcacccagcuaagagagagcacuggucuacacugcaggaguagcugggggugugugggggagugaagagcccagcacggcucccagagccaagaggaagagugggauucagggagauccuaaggauauagaagauuauaaaugucaaggccuccauuucucaugugucaagaggggauuccaaucaaggcuuaauugaguauuugcuuccuaaagcaaagaagacaagaauugcuugugaaguguauggcaagguggucagcuguaagauuucuagccuguggugaagaacuccauuuuaaauaaauagugcauccaaacauugcauuaauauucuaguucuucacugcaaaaugugagaguuugguaaaauaagaugcauuguagucuuguuuagaggcacgaugggauaguggcuaaacggugagcugguaauucauuucuaguguuaacucuggcacuugcaugcuuugggcgacuggcuaaacuuuucugagccccacuuuuugauuuguaaauauuaggcuagcaauauugcccaauggguuuguggugagaauucaguaaaaucgaagcaugucaaaguggcaggccagaggcuggugaagcagcuggcgaaugcuacuaauguccacccuuucuccauuuuucucuccugugagggaguuuaaaauguucagcuuucucuucucugugcugagucuuaaugcuagggaccuggagaugaauauaaaaguguaccuguguaguuguccaaauauuuaaauuccuuaaggagauuucacaugaaaugcuugauuuccuggaaaaagauguuuauuauuucucucucugcuuuugauacaggaugucagcugcaacgagaucacagcguugccccagcagauaggucaguugaaaucucuacgagaacugaaugucagaagaaauuaccuuaaaguuuuaccacaagguaaaaaagaaagagggaaaaugaagaaaaugggagacuugcauuauuuuauguuuugggggguuuacuuuugugaagagggucgaucuuugugugugugugugugugugugugugugugccuacuacuuaauuaggauuugaauuucacauacagauaacaaaaaagugauguucaggcugugauucuagucaagggcuacagcaacaaaaucauuccccuagguaaugcuguggggcacggggguggacguggguguguuaguuugcuggggcuacuauaacaaagaaccacagauggggugcuuaaauaacagaacuucaucuucucacaauuuuggaggcuggaugccugggaucaaggugccagcaggguugguucccucugaggccucucagcuuggcuuguggguggcaucuucuccucccugggucuucucgucaucuccccucugcacaugucuguguccuaaucuccucuucuuacaaggacaccaaggauuagagcugcccucaugaccucauuuuaauuaacuuaauuacccuuuuaaagacccuauuuccaaauacagucacauucugagguaauagagguuaggacuucaauauaugaauuuuggaaggacucaagccagcccgucacaaggggugacaugaauuguuuuggguauggguaugugacguuuuggaacgugaaauuucggggacauacuuuguucuacagauccugucugucaggauuucuagccuuggggaucugggagcacugguugggaacucccagugucuagaaucuguucugaggugagggugcugccucugcuggagugauacuuggacuaaugucucacugguggucuugguaaguuucaccaguggugacagcagaaccucagcauugagacauggcucccaaccauccagcaugaaugccaagaccucagacagcccugcuuugcagccaugggcuuccauagcaugucuguccaguaguguguugaguucaaggcagauauguauauuuauucagaaacugcauaccauuuagagcaugaaagcagccucauaggggguaguggaucugcauuugguguuuggguuuggaccuggaucaggaaugaacggaugaguccuggaacccugaaugcuuucuccaaagcauacucugguuuucagagauuacauugauuuccacuguuuuuguuuaaagucucuagacauagcugauuucaaacauauauuuaaaaauauuucucaaagcaaaacccuguaguacuuggaaacagucagcauuugguuaaucugacauuaauggaacaauuuauggaugccugauuuuaauuauccugucucugcaucuugaucuuuggcuugaaaugcuucauaauaaggcaagaaaauggagcucaugaaagggaaagaacuuugcaaaagguaaugugcuuuauagaugggagguucaaguccgcuugccaucuuucaccuuucucauacugacuagcauuuuagagaagcagaguuagaaacucaacauuuuuuacuucaguacuugagaugacuugguugaaaaauauugauugauuuuucaauuuguccuuguacaaucucauuuuuuggauauacaaaacuuguauuugguuuaagcaagcacaaaaggaaagcuuauuaacagcaaauuuauaugcauacaaccuuuuaugaguuaaagaaaacuuucauuuaaacuuaagcucucauguuaaucauugugaaaauguccuaaauaauugaacucucauuuucaaaaggaaaaauuaauuugaucauuuugcaauugccugucauagucuggaaacauguggaaaguauauucacaaaaucuagauuuuugucucucucugguuccucauuuucuuaccuuaaaagcauuccuuucccuuaaaaagaucaguuauuccauaauuauguuuucucaguuuugauauuuuaagaauauacucaaagcuaaaacuucaguuuacuggaaauuucuuaaaaaaauaacuuccucaauaucaaguuccuuuuugcuucccucuggagaacucuauugacaaaagaccauugaaaauacuuucagucagugacuguaaagacuuucccuauuuacuuauauguuuuuccucuuuggauaccccuccucguaugcuuucaauuugaggaugaaaaaagaaaacaccaaaauuguggucugauuacucauaucaguuuuguggugguuuuacuacaacaacugcaauaagaagaccauauuuuauucuuucuaggacuagaaugaagaggggauuaaaauagccauucauugccucucuuagcaguggggagagagagugggauuuguucuucugcuucuuuuuuuucuuacucccuuucucuacuccacuuuuuuuuuuaccuuuccugggcugguguugcaaaauuaucauuuucuccuucguuuuauuguugugaaacugucugguuccuguuuuccugaacuaugauggcaauugugucccaaacuggaacuagaaaagaaauggucauuauaaaaccuucacuuauuuuauuuaccuguaaguuuucuccugcuauguuuuccaugaacuuagcccucuagucuugcuuugaagucuucauuuuaaguggcaaagaauugcuaaagauccagaguccaguuaaauuuuuccagugauuugcuaagcuaacuuuaauuaaccaucucggagauagguugauauugcuaggggaaacagcuaggagguguuccucuuaucauggaaucuucauaauucuuaucaucuuacaaacaagcugugaggugaaaggggaucuugcuuuuccuauuguuucacuuucaugauuccaggguccuccaggauuaguguggccugaggucaaucccuuauccugccagaggggagacaagcuggguugagcaaugaacuaacuacucagggcaauuuaaaaaacacagucccuuacauucccagagugccuugaauucugagagagguacugguuacuagaaucuuuuccugcuggaauuugacauaacguagcugaguaaagugaagacugaagagcaguguagggguagaggagaaauagugugaauuuuuacuccaggucagugucuucaguuacucuucuuugucuaauucuugcccuucguccacuuuagaauuccuugaguguuuuaaagcgcaauauuccaucccuuaacagaucccauaacaaaaguuccgaggccucguucuggagugaacccuucauagccccucacacagagaucucaguggcuugccugcaucacccuagaugucuggcguggcccagccucucugcucuauggaauauauuugacuuuauuccuagcagcugccagugucguuuugaaugcuugaaauuacuuagugucuacugugccacuggguggggauuuuaagcuaaauguaauguucugucuucugaguggagcuacagaagacuuuuuaaaagcuguagaauaaagucucaucauaccagaauuacagggccugucggaaaauucugaauuggauaacauuuauuuuuuaaaaugcaguugaaaaacucaugaauauauuuaguguagcuaguucugggauaaugccagcccaaauacauugauuagauaagaauauucuguaauuaacguauuacucaugggcuagcgagugcuacugggaaacaguuugaaguuaaaacauaaacauguccugugugauguggcuugcgugauucuuuugcugaaaaaaaaaaguauuuuuaaacaauagauauuguaaauguuaaguguuuccaguuuuuaucagaacuaacaacaauuuaaaacuuuggggcaugcaauaaaagauuuucccucuuuugguaaaauguuauguacacacaccauguauuccuaauguacaacuugccuuugauuauacucaauuguauuuuuccugagaagcagaacauuaauuuuugaaugauuagccauuuaaucuuauugauuucuaagguuuuuucuuucuuuuuuucuuuuuucuauuauuuuagaacuaguagaucuuuccuugguaaaguuugacuuuuccugcaacaaagugcucgugauuccaauuuguuuuagagagaugaagcagcugcaaguguuacuacuugagaauaacccucugcagucuccuccagcacaggugaggggucuugcagcaaagccaaugccccaugggaugugcuguuauaggagccaagggaaaauuuccccuucacccucugaaaguuugcugaaaaucacuaaucacuggcaagcggcagauuaauuggagaaaaggcaucaaaauuuauuaacauguacguggaagccuccagagugaagacccaaagauacaggggaaauuguccauuuuuaugcuuacaaaguauggacagccauguagaaauaugauuggacaaaaagaguaugaucucauguuaauagacugagugaggaaacccagcagggccuguuugucuggauucuucuugggcucucugaggaucauuccuuccuucugggcguggggcaggacccucuuugcgauggggggucuuauggccuacugucaaacaagagaagucagaucauuucuuuauggccaguuuuuacacagaaaggccgagggaaaguuccaguaauauuuugagguuuuaaagggguuuugguuucuaugaccagcuuuggggaagauucaaauuuguaaggcucccuuccuugggagaaugggaccgaggggcaggagggcaggagaggucagagaaaaacuuuugcuucugagaccuucauuuugggguauuguuuucugauucccaaugcuaucaaucaugcuuaagcaacucuccaaaggccaguuuucugauucucugcugaagagaauaauacugaauaaaacuugauuauaaacagucacagugaacccuugagugaaugugagaaacaauaaauugucuuccauugcaucaaauccauucaccagcacuuggcucacuaugcuaaucacuccaacuccagaauuaaaugucuuauuauuuaucauuuuauuugaauuuguuucauggaguauauugauuuuuuuuuuuuuuuuuuuuuuuugagacagagucucgcucugucgcccaggcuggagugcagaggugugaucuuggcuuacugcagccucugccucccaggaucaagugauucuccugccucagccuccugaguagcugggacuacaggcgccugccaccacaccuggauaguuuuuguauuuuuaguagagacgagauuucaccauguuggccaggcugcucucuaauuccugacccccagggaucugcccgccuuggccucccaaaauacugguauuacaggcgugagccacugcucccaaccauauauuccuuauuugaauguuagcuggaaaauggaauuuaaacaccuuaaaacaugguuauugauuauuuagagacaagucuccagcucaaauguuaaacugcaugagagaaaaaugaagugcuaugcuuucagaugcuuaaccauguaaauauuuugaaguuuauuuucuuuuuaaauaauuuaacagcuucuuaaaucuacaauuauuuuuaggcucugaauugcuuucuaucagcucgaaaauaauugugcuuuucucaucuuuuguaacuggaauuucaccaggcuggucaucugaguuuauauuuuuuauacuauauauacuugaauacauuuuuguuagaguuuuauaguuuaaugcaagaaaaaaugggaaauugcuuaagcaugauuuucuauucaaaguagaauuuggagggaaugauucccaaaauucuuacauguuuuggaaaggacggauuuaguguacauugguaggguguuacuuaaaaugaaacugggaaaauugaaauauacagaguaaggauuugauacuuacauuuuguuuugucauugaaaaaugaauaugauugcuauuaauuucuuuguagauuugcacaaagggcaaaguucacauauuuaaguaucugagcauacaagcaugccagauuaagacagcugacucccuuuaucuccacaccauggagaggccacauuuacaccagcacguggaagaugggugagucaugcccucauucaaagccccaguuuaaaauuugccuaggccaaggcccuccagguagcugacuucaaaaucuguuuguuuuaagucaccaugguaucugcagaaaacaaagcaaaacagaacaauuugguuuaaucaccuaauuuguauuuaaaacaagaaguugagaaacuauugggauaugaaagaaaaaacugcugcuauugagaauauuuugguauaucucaaauaucaucugucuccuaaucaauaaucaguucuuccugaguaaauaugugcauacuuauaaauaagaucuagaauacaaaugugaauauuuuuuacuuaucaaaauaacuauauugagcccagacaugccuuuuuagcaauuauuaauguugaauaugccuccagaacaauguuaagaaaaaaaugaaggcuuuauuuuuggucuuuuaaaaaugcaguauguguaguuuugucgccacuuccuguuucaaauggaaaaguuagaacccuuucacacauccuagagcuucuuguggcauaaaucaagccuugagcuuccaaaaaacaacauucucacacugaacacaguuauagaaaugcagguucuuuuuaagaagucuucacugcagaaaucuuuuccuucacuuuuugcuacauaaguaaauuuaaaauuuuggacuacucuaauguuacuuuuauauaaugcuuaaaauauguacacuguuuuauguacuuaaucccuggauaaaaauuuacagaauuauugaaaguaaccacauuucauaacauaagggguaaaagcaguuaugugguuuauuaauuuuuuauaugcuagaugcaguaaaauaagaacauugguaacuauuuuuaagaaacaccuugacaucuaagagcaagccacuugauuagagcauaaauccaugaaaccccgaacacaaagaauuuuaucuuauccuguguuuagacugugcuacugucugauuuucauuagguccaugucuuaauauucuuuaauacuagacugauuuguugccuuaugguaauaauaaaaauuugcguagcaaaauuauuauuagaauauaaauugauguuucuuggugugaacuuugugauuuuaaucuuuuuuaaaugaauucaauauugauggcaucuaucucagcaagaaggauucugauucgggaguuggaagugauaauggagauaagcgauuaucugccaccgagguaaaguuagugaucagauucuuuuccuucuguacuucuagacauaucuaccaguguucauugaacuccuuucuguuaaagggcaucgauucauuuguauauucaugugauauucguaaaagugauuuguauauucaugugauuugaaauccucgaaguguuauauaaauauuagcuguuguuacuuauucugcaucuuuaauaucuuuaauauuuuguaaaugccucaagaguggagucuguaucuucuccucuccuacacauuaucuaaaauauuauugagugcucaauaaauauuacaaaauggcuaaguaguacgcaagugcccgugaagcacuuuuauacauacgcuuauuuuucaguaauagaguaauuuagaaaaacauuguuauacauaugcguaaauguuaaggaaucaacuguacauuuuauuuuaauaguugauccacaggaaaugcauuuaugaguagcuauaguuuuuauaacaauguuuguuuuccucagacucuuagauuguguucuguucuguucuguucaguuaauuggauacaaguuugguuacuugcaagcuaacaggccucacacauuagaacuuccuauagugguuauaaaucaugcuuugauaacugauuuauuaucucacauguagucuauuagaguccccaaaaucuaacacuaauguaucauuaaauggagcuucuuggccucagggaucuagaaaggagugguaggaaaaguaucaggugcucuucuuuuuuugagggaaguuacuuucuguaguuacuaaguuaacauuauaauacugugaaauugcaguuaauaggccagucaccccaucaaagaaacucacauuuuuuucuauguaugacuccaggaaaaaaaccuuucuccaauucuccucaagucguugaauuuuaauagguagcuaagguauuugaauuuauuuuucacaaaauacucuauauagcaguauauuaaaaagugggauucuuuaucuuuaaaaauccuucuaauauagagcauuuugaaaagaagaagaguuaguaggcagagaaggccagugucaauaaaagaaaauaacccauaggaaggcacaugaauaguuuaccgugcuucagugggagagaggggauacuaaacacauugcuuuaguugcauuuuaauucauccucuucaacuccuaaguccucgcaaauggaccauuguuucagaaauuacucacccuaaguauauuuucuguuaaauuaaacagacucugcuuuaucucucuucuaaggcuaauuaaacucauuaauaaaacauuacauaaagaacuucauuauccuuuuguugucacuuaagcauaaguaggaugcuaauaucauucuaaaaggagcccaaggauuuauucugugccuuuuaauuagaugcauaucuuuggaauuuugcuaaauuuuuaagaugagagguggguagaaagagaagggaauacagaaaagauuauauucaacagaaugaaaugcacacaucuugccuuuggccuuuccuugucuuauauuacagccuccuuuccuaaguacaccuccaagaaauuuauuuuuuagagugauaaguguuccaaauuaucuuacauagcuuccuauuuucacuugguuuggcaaagauuuuaccaucuaugaucaggugaucuuacuucccauuuagaugacauugugggguucagggaucacaccucauucuuuuucuuuggcugcugccauugauugauuuagcauuugucacugagagauuaaaaacaucuuuuuaucaagauaaacaggaaaguguggagcucuaugaauauuuguugaaugaaugaaaugcaugccuaauuucugccaguuucuaaacaaucugugcauauguccaaaaguaaacaaggacagacucugaaaaccauaccucaagaacuuaggagcaagccacaaucuccugaaauguguuuuguggagguuccugauuuuugagauuuggaaagcuauuuccuaaguagcaacaguaaaauggagacauaggaaaauaaaccaggcuccauauuucagaaucauagguuuucugaauaaacgucaucagcuacugugggaaaggaagcccucagagagaacuaauccaauuauuaaagccgaagcuuucuuccaaaaaucacacagagcaguucuuuuuaacuacuacaguuguuuagcauuuuuauauaugugaugcagcuuccucagccuaaaacagagaaauaaaacaggcacccguauuaguucauucuuguguugcuauaaagaaaugcccgagggucgauaauuuauaaagaaaagagguuuaguuggcuuacaguucugcaggcuguacacaaagcaugugaccagcaacugcuacuggcaagggccucaggguugaaggugaagggagugccuccugucacauggugacagccagagcaagaaagcaacgagguugggggagagcaacggaggaggugccaugcacuuuuuuuuguuuuuuuaagacggagucuuguucucuugccaggcuggagugcaguggcgcgaucuuggcucacugcaaccucugccucccggguucaagugauucuccugccucagccucccuuauagcuaggacuauaggugugugccaccacgcccagcuaauuuuuguauuuuuaguagagaugggguuucaccauguuggccaggauggucucgaucucuugaucuugugauccaccugccucagccucccaaagugcugggauuacaggugugagccaccacgccuggcugaugccauguacuuucaaacaaccagaucucacaugaacgcauagcaagaacugcauagacccuucuugagguauccacccccaaaacccaaacacuuuccaccaggccccaccuccagcauuggggauuacauuucaacaugagauuuggaggggacauacauccaaacuguguaucaguaccugacaagauuucagcuuaaaacagagagaagaaaacacagagaagcccauaaguguuagcuccaugaauuuucacaaugugaacacacccguauaaccagcuuccaguucaagaaacagaacuuuaccagcaccccagaaagccccaccccgaccccaagaauaaccucuuccuaauuuuaaauaccauggauuaguuuugcauuuuuugaacuuacauaaguggaauugaccuuuguaucuggcaacuuauauucaauaugauauuugugagaaucacaggauguuguuuuauuacauagcauucuccuuaucuacauugauaacacuucucuugaguuaaacagugcacuguaucuuuuuagccuucugacgaagacacuguuagccucaaugugccaaugucaaacaucauggaagaagaacagaucaucaaggaggacucgugccaucgccuuagccccguuaaaggucugagaauaaaaauguggagaaagugcuuguuuuucaguuucaaauguuauguuuaaaauaaccugugcacagauagggcagugauaaucuuucuagaguauguccuauguaccagguacuguguucuucugggaaguugagcugauuuaaaauuuaaaagucaaagauggauacucuaaucaucuccauuuuauaggugagaaaaccaagacucagagaguuuaaguaacuugccauuggucacauagcugauguguguguaguacuacuuccuacgguacauaguagaacuaaucucauucugaagacuuagauaaaauucuuuuuuuuuuuuuuuuuuugacauggagucucgcucugucucccaggcuggauggagugcaguggcgugaucuuggcucaccgcaaccuccgccuccuggguucaagggguucuccugccucagccucccgaguagcugggauuacaggcaccugccaccaugcccggcuaauucuuuaaauccauucuuggaaagaaaauauugauaugauagauauauuaguuaggaaaacucuagcugccguaacauagauucccaaaucucuguggcucaacacaauccaaauuaaguucaaauggaguuagugauuggcagacaacuccccucugaguauugauuuaaggacccaagcuccuuucauaccaugacuccaucaucuuuaacacaggccuuccaaaacuuucauguccaucuguuuuaagccagaagaagagcguggagguuugcucgugggagguuuuuauggacugggucuggaaggagugcccaucacugauaagcuagacuucaucccauggccacaucgcacugcacaugagggugggaaauguaguugagguguguguucaagaagcuacuugacuuuggcccagucaggugaccuugauucccucaccuguacaugagaugauuagauuagguaauaccaaagguccaguguagcuugaaaauucuguggcucuuuaauaaucaucaaaugaccacuaaacacugucuugugugccuucaagauccuuguaauacguuucauaucuugguuggaagcccucauuggguaacauuaaggcgauuuuuugauugccccuguuuccccaugacuuuuaaggaaaauacaagcauuuaguuuuacucauuuguggcagagacuguuucacaguguauaaauagugcagaacuggauuaauauacagaucuucucauaaauaguuggaauuugcucuuauucaugauaggagagcuguuuaaguucacucaaaccuuaguguuggcuuucacuucuuacacuucgguuuuuaaguuuagcauuucuguuuaccugagauuaucaugggaaccauauguugucuaaaaacauagcuguaugcuuuauauacaaauauaacugccacuuuauuaauucauauaaaguuaguaauauuauacacuguaggagguaguauuuuaggcaaauuuuucaaauaaaagaauuauguaauuuguuacuaguggguguucccccucucgucuagauguggguauugcauuggcucagaguguuuaaaggguggcccaguaugguucuuuuucaucuucagaacaguuggaagaguucugcaggguguuccuuuugcucccccaccuccccuggaacacauucuagguggaagugccacaucugggcaugcugucaccucuguguggcccuucuuguagacacuucuuuugcuguuaugauuuggggcucuugccuaguuccccucccacauucuuccuugagauuauuugcuguuuaaggacaggagucagauuuggcugauuuuuuaaucccuaaaauguuuagcauaauaccugccauuuaguagcugcucaauauuuguuggauuuuaaauaugaaauacauaguaacauauuacugagggcaaaaaagccucuuuuauacuuucuuuucuccauuccuuaaaaaaguaagagaaaaucuaauuuuucucauagggaacugagcccagagaggccuugacuuuuuaagcucaguuuggggcuuucugggguuauuuuauuuuuaucuuuuccucccugcagggaagagaaaacuuggguuuuucauauaccuucuucauagggaacacagaagacuugaagugauuagaucauauuugaagaucagcuguguuuugcucuucuguucaugaaaucaugcuuuccaucucucuauauuuuccuaauaggggaauuucaucaggaauuucaaccggagccuucccuuuugggugacagcaccaacucaggagaagaaagagaccaguuuacugauagagcagauggucuccauucggaauuuaugaacuauaaggcaagauuuucaggaucaacuacguuuuuuuacuuauuuccuucuguuuggcaccguacaauuuaaguugaagguugccaauccauccccuucaauguccagcuugcugcacccucccugaagcguuccaaacaucucagcgcucagcgugucuauuugcugaugugaggagcuggucccugcccugugugccucuccauuugucuguuuauggaucugauuuucuuuccgcuacucagugcaucguacaaauuagcaaacucauuagugugaccauugccacgcaguaaaagcugaaauaguuucacauucuuuucaacauguucuagguaaauccuuuucuugggaguauauuuauagugugaagacaaaaguggagacuuuuaaaauugauaaaugaaugucuuuccuuuuuggaaagaucucucugaggacacuuauuccugaacuuuuguaggugccccgaggcauugaaaggacaggugaaguugccgaguugucaggaaaaccuucaucuuggcagcaacaaagggaggaaagaaaaauuagcccuuuacugaagcagauacugaagguucuacuucacaacccgauuaggugcuugguauguuucugccagcccuuuugguucagguuguggugcccaagaaucauaaagauuauuguuuuuguaaaauucagauucacuguggcuucgagguaacuucugaguuauuauguugaagccaagaaugggaucccuaaguacucaucuuuauuuucugagcauuguguccugauggcuggacccagccuaaauuaacaucucugggcaucaccuucaaggaaauggagaggaaaacagcugaauuuuacacuguaggagaccuucgugugcucaggacauguuuauggccuccagauaaaaauaaugaacgugacauauguuuauagauuacagaaguuguguagaaggauaaaacacagucuuaacucuuuacuugcuauauuuaaugucauuaauccauacauccuuguuuuaaaauaggucacacccauugccuuguuucuguccccugucuccauugacauugcuucauuugagccucauaguuucucacuuugauuacuucaggcaccaccccgcccacuccacuucuuacccaaugcugcacccgcgugcaugcaugcauguguguacacacacacacacacacacacacacacacacacacacucuuuauauucugccaccaaacauuuuucuaaagugcaaaucuaaugacauuccucucaggccacugguucuacaaggcuuccccagauuagacccuaucuaucagcucugugggacgauucuuccaugaaaaugugaaaauuggaguauaucgagcauucaucuuaaguuaagaaucuaagguaaagauggaaacccugaagaauguguuaagaagauaucaauauuuaaguucuagaggaaacaaagcaguuaguaagaauaaagcguauuguuucaggaaagcaaauuucccuggauucagagauuucaaggacuuccuggaaauggcugcccuacagaauggguccuguagauggaaacuagaggagcagauaggcguguggaagucaacuuggcaaaggcuuucuggaagauacuucucuuggaaaaucaaaagaaaaauguuaaugauaaaaugaacaucuacaacaaguuaaggaaaaauugugcuugaaaaucaggcccguauuaggcuugauauccaucaacuuuaagucuuucaaccugugcuuggccuggcggagugaaucacaccuguaaucccccacuuugggaggcugaggcaggaggaucacuugagcccaggaguucaagaucagccugggcaacauacuaagauuccaucucuacaaaaaaacaaaagcuagcugggugugguggugugcuccuugagucucagcuacucaggacacugaggagggaagaucacuugagcuugggagagugagucuucagugagccaugacugcaccacugcacuccagccugggugaaagagugagacccuuucucagaaaaacagaguucuaugcuuuacauaauccuguuuucuuuacugaauaagcaucuuggaccuuugcaaccacagucaauuuucauuauucacagcaguuauguugugugacaucacugugcauaucgaauuauccaauacugagcccuaacucacuggggaaauagagggcuggguuccugcacccucugcucacaacguuuuugucaaccaaucagcacacaaccuugguguguguguauuucuguuuaaagauaccuuauuuaauauauauuguuuugaugaacauuacaaccauaccuuauuuaacauauauugauugaugaacauuacaaccaacagcacuguaacucaugcccgaaggaagcuugucuaacacacguauuguccucuguaaggcauaucacaacuuccuugggcuucugaacacaaggcagcacuucaguacuaugucuggggccauuuuaaagugaaaucaccaacaaaaaacacaacagugugaaaacauggcacuaacuagacugugaaaaaggacacuuauuuacaauaagagagcugaaagaagaaagcagagugucaccuuguuccaccucaucugggaacauacacauccugggacucaaauuuuuuaccacucuguagaugucugcagaugaccuccagagcaccacgaauacugguuuugggacuaaaaauacauguuggugaauaggcaaauucacaaaugcagaauccacagauaaugaggaucaacuguaaaaccauuuagcuuagcaaaagcaacccaguacgccuguuuugccuaaugaaaaaaagagacauuuuauacuauuggcuacuuuuaguugugaaacaaaaaaauaaaaagaaauacccuuugcuucuaucauugaaacccaacaaaacgaaguaagaacacguugucuuggucauuucugguaguauauuuuuacccaugaauuuuucugucauuuggaguguggagaguggcacagucuuuuauacguugacuguauuguacaugaaaaguauaaucacuacagaaaaaguccaaguguguucccagccagaguccagcauugggcagcuagccauguccuugggaaaagucuuguccuaacaacacaucuggaggacuggcugguccccaguuagcuaaugauaugccagaaccuugacaccaaaaaugguccuuuuggcugguguucucuccuagcuagggaaauguggcccuauucaggcuggcuuucauucuagccaugagcuggguuaaagcagcguuucucugugucagagaugaacgugcaaggaggccuguggaaggcucauggugguacaugacuuuccaaauagccagugucacuacauugccgcuuugggaaaaaguggggugacagugcagggagaacauuugagugauucuggauguuguacacgugaaaacuauuagaugcaaucagaagcacuuuucuguuguuaagaauguuacacuuucucuuuuccccacuacacacauaugcgugcacacucacacuuaaacacacaucccugcucucacaaacacuaggaugcaucuucacaggugacccacaagcacaggagagggaucucucaauacaagaaggugcuaaaagggcaauaggaaauccaguaaagcuuuaaauuucugaugauaaguuaacagaugcuguggucuugggccacauuuuuuuaaauuuaaaaauguuuaauuaugggaaaauacuuacaaaauguacaccuuagccauuuuuuaaauguacauguaguucagaguguuuuaacuacauuuacguugugcagccuaucuccagaacucuucucacuugcaaaacugacccuguguacccuuuaaauaacaacucccucguuccuucccggcagccccuggcagcaagcauucugcuuucugucuggaugaauuugauuacuguagacaccucauauaaguguaaucaguacaguauuuguauuuuugugacuggcuuauugcacguagcauaauguccuccagguuuaucuguguguauggcaugcaugagaauuucccccuuucuaaggcugaguaauauucuagugcauguacauaccagauuuguuuaucugucccuccauagauggcuguuuggcuuguuuccagcuuuuggcuauugugaauaacgcuguuauaaacaugggcugggcagguuuuggcuccugacuacugaguagccaaugguuuucaggaacccuguguguuuuguccacaggcaagggcagaagacugugaagagcuguuacggauagaagaggaugugcacuggcaaacugagggcaugugagugccgaggccuugguuacaagccaucaucacucaaauccacuuugcaagcagucuggcaguucuguugugauagaauuuugaccugcuuuucugugggcaagcugauauucuuacagacaauauugauaagaaguugccaguuuuucucugucugaugcuuuuugucgugguauugggcaguacaaaccucuuacuuggccuugagucuuauuuguuuugagguugcggguaguaaugugauuucagagaauuagcuagaauuucuagauuggagguucuaccauccauacaauugccugaagaagccaacagcugggccugaagugaucuguagcgcugaucuccuucuuuaccccaagucauccccuucaagaucugagaacaccguagacuucuggucccaagacuucuaacugccagagcuaccauuuauucaacaucaugugccaggcauuguccuaaauacuugacaggccauaacucauuucaucuuuacaacacuccuaacagauaaguucuguucuugucccgcauuucacagaugacgaaacugaggcacagagagauugauuaucuugccgcaaggucacagagggccagcauuugaacccaaggaaucuuguaccagacagauaauccuucuacucuauuguguauaaauauuuauuuagcaagauuuacaggggagggggugugugaucccaucagacaaugaaucauguccaggggaauugaguuuggacugugugacauagaguauaguuuuuguucccaggauuuuuauuucuauaaucugggaggcagguguugacucuccaucauaccuugcaggguuuuucuucuuagugaggauuuaucccauuguuaaaacuuuucuccuuacagaaagucauuggcuuacauucuauggugggaagggcuugcugugaucaaaucucucuugcccuuuaaaaacguuggaaaguuccucucuggucacggucuguauuaccagcuacucacuggauaugcugcugagagccacggaggccuagcuugauuaaacaaucagagaaucauagggaaagaggcacuuguuuuuaaacuauauaacgguuuggaaacuccauucucaaucucauaccuagugcuuucaacccuggcuguaaaggauuaucuguagagcuuuauaaaaugcugaacuccuagucagacccacuuggacauauagggccuggcauguuuuuuaagcuccacagaugauuuugcugcaucuagaguuuggacugagaaccacugucccacacugaaacccuauaugcaugaaaguaauaaaacugguugaacgggaguuggaaggcccagaaguaguacagacucagccaggugauccccuccaugcagcccccuagaacucaguaaagcacaacggugaaagccucucaucuaggccauugccugacugugcacaggggcaguuaggggugcacaggcaugaaaaucuuaugugagcugcuuuacagcagagcugggcuuccccuacucgggcucuucccaccgugcucugccaucccaccccacaagguacaaacacauuuucaccauaacacugaaucugucgaaaucauuuucauauguuagauggauuuuuguaaguuugcuuuuuaagaaauuagaugauauucauguuguauugaucguuuucauucuuaugcuugguuucacguuacagaauaaguucauccaaagaucaggacauggauauagcaaugaucgagcagcugagagaagcaguagauuugcugcaagaucccaauggguguguaugucuccuugguccagguuucauguguaaauaaugcauacuaauguauggaguacauugucuaaauuccuaaaauaccuacacagacgauuuuggcccaguccagcuacuaacaaagaaaagucauguuuauugccuguuuucccaagaugcaaaaguaaaagagucaaacuucuggagggagugagaucaauuuccccuuucaccacccuuuauugaguucauucaccccucaugaaguucauaugggaguuuuugguaaaauucuuagaaaacaaaaauaugguaaaagugcauguuuuauauugcuuaaaguuuaaaccccugauuuauaaaaaauauaaagaaaauguuuuccaaaaaggaaagaauugguauaucaaguaguacuguauuuauaugggguagugccaaauauauguuaacugaagaauauauuucuaaagauuugggauacaggauaauuuuaaaaucugaauuugccuugaucgauaauaggcacuacauucaguggauauguggauaauauuuuucgauuucuuaacuaaugguaauggaauucccauggacaaaauauuuuucagcuaaacaauagcagguaucauguaucggguaauaacuacaugaucucuagagaacuagaggacuugguaaacugauguggucuuauaauaugaugaacacgggaaucacacgcagcaauccuagcuggguucugcaaauuuaugaaaagcguaguuaguguaucccagaaugcugaugagaauauaccaccuaugaugucuggcccugaaagaauaguggcggaucaguuuaguacagcuggaagucuuuugcaauugauuugaaaaacauuucaauucugcagacauuaauugagugcuuggaguaugggaagaucugcagugugcaccuugggggauguaaagauggacaagacacagcucuugcuuucugagaauuuagaauagauagagauugccuugagaaguuauaaguguaacugggccaggcgcgguggcucacaccugugaucccagcacuuuggaaggccaaggcaggcagaucacuugaggccaggaguucgagaccagccuggccaacauggugaaacccugucuguacuaauaauacaaaaauuagcugggcauagugccaugcgccuguaaucccagcuacucaggaggcugaggcaggagaaucgcuugagcccaggagacagagguugcagcgagccgagaucgugccaccacacuccagccugggugacagagugaaacugugucucaaaaaaauaauaauaaaacaaauaaauaaauaaauaacuguaauugauucaagugcuucaaguggagguaaaaaggauagacucgagcaagugcccaaccccaggaaaaggggagauggguggacuggucuuccugaaggauaggauaauggccuggaccuuuaaugacugccaauuucaagaaaaagagaaauucuggauugaaugaaaggcuuagguaaaggcaugaaggucagaaugaauggagccagguugggaaaaucucaggcagaacagaggcucuccauccuagugugcuucaguaucacuuguagaacuuuuucagaacagauaccaggcacuuccuuuggggacuggagucagccagugcuucugaugugcagccaggacugcgaaucaccagagacaguguagaaugaugcaggcgauggcuuuggauguuguuaaggagcugagauuuuaauuuauauuuagagggaggcaaugaugguguuuaaacaugauuauucauguuguuaauucucccuuauguuuggcucguggcauaggcaccuaaucaagguauguucaaagaguugaauucuacaucccaagccggggcaguuagugaaagggcaggaaacaggacaggagagccuguauguguguuuacguguauccaugcauguguaugguuguucauacauguauguuaguacauguaggcaugugcacccguguacauguauucauuauaacgaaucaggaaguaguguggcuuguagaaagaacagacuuugaauuagcuagaaacuuuuuaaacauagcugcaccaucaguuaacuuggguaaguuguaugacuucucugcaucccauuucuucaucuauaagagggggugacaaguaccuaccuuuuaggguuaugaggauuugaaauaauacauaaacugccgguggagaaguaaauuggcaaaaccauucuagaaguaacuuaguauguaaccaagucuagaaacauauaaaacuucggagugaaaucuaagaacuuauccuaagagacaagaagacgugaacaauuuggggaauuugggguagagaaugagggguagguauuuuuaauagcaaauauuuggaaaaagaaauuaucuaacaauuuggggauacuuuaaguauauuauacucuuugauaagacagaaugugauguggccaauauaauguuuuuuaaaguuucuagugauaucacagaaugcuuuuauacuuuuaaaaaaguauauaacuuuuuuaaaguauguaaaaacgcacaauguuuggucccaauuauauagauagaauuagguaccaauugugcaggaaauuuagaaaaacuggaaggaaauauauuaagauggauuuuaagaaggaaauauauuaaaauggaaggaaauauauuaaaauggaaggaaauauauuaagauaguggaagaaaacauucccaacuaaccuuccaagugacacuugauuugcaucuuuauggagcacuauuuuaaaauacuauguuguaaaauuuuauauggauucuuucauuuucuuucuaaaauaauccacuacuuuggcugcuuuagaucauuguuauuuauccugaaauaacuauuauaauaugacaucuaauuuuauaauaguucugugagccaguuuaauagucaugaaaagcccugguuuuguuuuggauauagagaggacacuugaagaugucauuuauuucuaacuacuuuggggcugaauauuaguaauaaaaaaguuuacauacacauuuuguuuuuucuuuuaucucacauuucauagauccaggaauuuuuuucuuuuuuaguuaagccauugauugugggauuaaauuuuucaaguuuaccuuuuaugcaucagaaaauuuaguuggcuauugcuguucugucuuuaucuugauuucuucucuuaaggccuucugauuguuaguuugacagcauuuucauaggccucuauaauauaaaugcaucccuguuuaagaugacuuuguaaauuuuauauaacuuacagaaauuccuggcuuuauaggucuuuaagaacaaaaaaucuucaucucuuaaaauagcagaaauuuagaaacuguuugagacuauuucagaaguaaaaaugcauaucaaauugcuuaugauuuuuuuaagugagagauauaauguauaucucccuauuaaaaccaaaugccauugguacauauacuauaauguaauacucucagcaacuugacuugcuucuguaaauucauaaaguucuaaaauaaaauuuaguauaugcuauacuaccuaugaaaauuuugauuuuauuagaaauuacuauuauauuacaaacaaguuggauuguauuaccaauagcagauggaauauuauauuuuggcaugcagugggaaaauaccaugcacuuugaaauuucugucauaaacuuuuccucacuuaauccuaaagauaaacauaacuuuuuaguaaauuaaaaauuuaaacugaauaagaccaauagaauuuauuaaaaauaaaaguuuaauacguuuacuaauaucuuuuuuuccuacucuuuagauuaagcacagauauuacagagagaaguguuuuaaaccuauauccuaugggaucagcagaagccuuagaauuacaagauucugcacugaaguaugcuugccuuuuauaacaaauuauguuuucucuuuucauaauacauugacauuucuaugcuuuaaauuucacuuuguaucuuuuuuuuucuuuccuuguucucacaguggucaaauacagcuggagacaucuccggugugugagguaaggcugcugguagauucaccagaacucugugcaauauuuugccauggaauacuggccaccacauucuguaaagauuugucagggagugaaacaucuuuauuaaugaggccaauauucagauuuguucaggacacauuuuucaacuuguuuauacguuugccucuuuaguucugcuuuucugcuauaccucacccucuguugaagaugagaguuggcuauuucuauuagauucuguagauuuuuuuaccucagaucaucuugcugagucaagcgauggcaacuaaaauacauagggaaucugccugugugucagaaccuggaggaggaccauucaauguagauuuuagagccaagaaaaggucugggaauuggccagauggaaauuagcuagaaaacaccugaaagacaagaacaaauuauuugggaaugucgaggaggauugagagaauaucaugaagagaaacugguggugauauuugaagacaggguaaggauggguucaguagaguuacauggagugaaauuuggauggcuguaaagaaagcaguuuugacauaacacuagagaugaccuuagaauguccuaaagccagaauguuaccccaggauuagagagagaaguucgagcuggugauuugggaaugaaacauaggcuacaacccauuuccugaauggauuuaggauggcuaauuuaggcaccaagauuguguacaaacaccuuaugccccacugagguguuugcacauguacuauaguaaagcgguuucacgcucuuaacuuugucucuauguuaaagaaauaaggaaaagggaaguauuaauguaaaagggaaagccauguugcuagagagugugguuucauuguuaagcgcagcgacuuggaauuauauuagguaucagucccaucucaaagacuggcuaacuguggggaacuuaaccucucuaaacauucauuacuguaauugggaucauaauacuaccuauuguaaagaucgaauuaggaauucugauucagaaaaugucacauaauauaggguaccuaaauguuagcuauuagcuuacuucucuauuauuguuauugguguggccuuuaaacagaauuacuguaccaccucuucccuggguggaggccucauugaauuacccaauagugggacauuggaagucuuuuauuugcagucuccccuggaccaauuucaucaagcucuuccuuugagauugauuuugguucugugcagacuuaaccucuuuuuuagcuucuuauuuggaaauaauuuuuuuaauuuaauuuuauuuuuugagagaugagaucucgcuuuguugcccagguuagucucaaacugcuggcuucaagcgauacuuccuccuuaacuucucaaagugcugagauuacagguggcucacaccuguaauaauaauuuuaaacaugaaaauaauuuuaaacuuauaaaaguuguaaaaauuugcaguguucuacaaaagcuugcaaaaaugauaaucuuguaaaauuagauuuacuaguaacauuuuaucacauuuguuauauuuguucucuuucucucucucucuccauacacacaguucuuuuucugaaacacacacaauucuuuugcugaaaguaaguuucacacaucauaguccuuuaucccuaaucauuuuaguguguguuuucuaagaauauggauuuuuaucuuacacaaucaauuucaguuaucaucuucauaaauucauggugauaacauauuuucaucuaaucuaucacccauccuccaaauuugugaguuaaucuaaugaugcucaucagagcauuuuuuuccuuucaguguaagauccaguuuaguugcagauacugcauuugauugucagguaucuauaaccuucuuuuaucuggaacauuuccaugaccuuucuuugauuuuuaugaccuugaaauuuugaggaacacaaaccuccuccuuuuuaauagaauguuccucauuuugugucugucuaauguuuccuuaucaguuugaacuucugcauucugauuucgaauacugcacaggugauguugugaccaucucagggcaucacauuuggggccacacacuauguccaucuuucccucuuuggugauguuaauuuaucacccaaucaagauauaaguccauuucuccaccguguaauugcuguuuuauuuuuucguugcaacuaacaagcagucugugacaagauaguucaagaccaucuuagcauccagcugcagacccacuuuugacucuaguaaaauagauggccaccuguuugcaugauuucaggagcacaagaaagacacaaagcuucuggaauaaagauauauccccuccauuuuuaauacacaauuggauggucauuccaauaauuuugucuucuaagauguauauauuccugaauuuuuuuuaaaaaggaaguauuguuacaugccagaucaugugcuuuguauauuacauaaguuaucguuauuucauuucuucaauaaauauucguugauugccucccaugugucaagcaccacucuggacacugagaaaguagcauuaaagacacagagguccuacacuuacgaguuuacauucuagguaaagguauaagugaaaagugcauccugagugaugaugcaggauuugaagcucaaggucaagugacuggccaguucaguuacauguaaaaggcguggcccugcuuucccacugugguauauugccucuucaugcuguagacuaguggcagcacuaagucuugucaugcuuacaaaccuuagugaugccugauugcaucaaaccuuuucuucagagcagaucuuggcagaagaagagcggccauuauacuuaugugugcaugaacaaugcuuccaguaaugugaauggguauggaaggaauaagggauggguauauacuaaauauagacugagcccaguucauaguuuugucuaggucuaguuuucaucccaucuuuuuuuuuuuuuuuuuugaggcagagucucgcucuugucgcccagguugaagugcacaaucucggcucacugcaaccuccaccucguggguucaagcaauucuccugccucagcuuccugaguagcugggauuacaggugcccgcuaccaugccuggcuaauuuuuguacuuuuaguagagacaggguuuugccacguuggccaagcuggucucaaacuucugagcucaggugaccugcucaccucagccucccaaagugcugggauuucaggcaugagccacugcacccagccugaucccaucuuuuaaucuaauagcaauacaugcgcugauuuacuaacuacccaauuccaaugguuauuagaaauugcuauuguuauucaacauuuuggugguuugggaaggaauguuuaaaugucacauuuccuuaauaucagcccaagacuguuuuauuuggagcuuccucccauuuucccaucagcaaaggugaacucuaucuuugcagucaguucuagauuuucaaaauggauucguacuuauugaucuccucuuuauuucuccuguuguuugucuuucucauugcauagcacaaacacuuagcauucucacuugaagugggacccgacucaguaccuaacuacuacacagugaguaguucgugaggauuccuggaagggagggaagaagagagggagagagauaggaaauuagaugaugaggauuaggcuuugguaagcaaauuucaguguacugcuuauuugauguacagaucucugggucuuaacugauagcugcaaacacuccaucauuuagguaaaguguauauuaugucccuuuaaauucauuuccuuguguuugucuaaauugaaaaucaucugacacuuuuccacaugcucauaaagcuucauggguuuuuccugaaguuuaaccaugcuugcuaccauuauauuauguggaaaagccuaauauccuccuaaaguaggaaacuugacuuccaagucauauaucaaucauucagucaguuggcccagcccagcuuucccucuaaugaugagucuguuuguuccaucagccaaggccauuaagccuguagguguugagcugcagcucugcacagguccugugcucagugcugugagggccucccugccagcuacugcacccuugccuccagagugaauuuucugcucuaauugggcagauuguauuacuccucuguacucacagaauguaccagguccaaccuuccuuagcaccuuuauuuuagcaugcuacuuaaaaugucuuugagcuuucacucucauagaguuuuaaaaacgcauauauaccugugcccaugauuucgggagucccuagaagacagaaaaccucaagaaaaaaaaaagauacuuuuauucuauccccaacuuacaauguuuuguguuauuuuaacauaagguugauuuuuuuuucuuuuuuggcugaaggaggaguauuugguauaaggaauucucacuccuuguuuuccuucuguagggcaauuaucuguccuuggcagauacaucucuaugauuuuaaaaaaggaggggaauagcuggcccugauggaaaaaggaagucacaaggaaaagaaaagagaguagugaauucacagggccagugauaaggauuauggagagcuaaaauaugauccuuacuuaugauuugguuauuuuuauauucuuucuucugucucauucaagcagaaaguaacaucuuucagcauagcccuauauuaauucaccaguauuuguugagugccugugcuagauucagccuuguuuuuguguaaaggacuggaagaugaaggcuaugaaguugcccucacuuuagugaauuuuuuuuuaauuguggggguaagauuuagauguugaaaaauuugcagaagaaauaagauggucugcaguccugagcuuguuuuaggugcucagggacacuggggaagggguagaguuuaaggagaggaaaguaaacuuagacuuugggcauuuuuggguuuggcccuguagccaggaggcuauguugagcaagacaccguggcugugggggaucagcucugugugagccacacggaaaggggaggccaggauuaugaagcgguuuguaauugguggcacaucacgugaucugacuuuaaacauacuuuaggugacuguccacaucaaguguggauggcacuggcauccaugcaggaagaauugcaaauugcauggcucauacauaaauaucgaacggggaagggucugcgagacgauaggacaaacuagaggaaagaauugcuuauagaaagaaucaaaccugaaguuacuuguuagcagcucuaacaaagccauuugauugaauagggauauuugugacauuuuauucuaaaaauaugguuuccucuuggauuugugucaaaggugggaagauuuuuaaauagcacuccucaacaaugaauaggaacaggcaucuuaaauguacaauaauuugguggcauauaugaagguguuuuuauaugagcuaacgcccaauuuuuuauuagggaggaucaggggguucuugacuaccuuauaaagaaggcagaucuggguaagaaacuagagugugucccuugugggcuccuuguuucugcgugucccuuucaugcugguuuuacaagauuuugcucucagccacugucccucaauuucuucacugucucuguggaccaucuggccacucucauggacucaggcaccccauaaauaauaauaacuucgaaaccuguagcucaugccucagguuccccucuguaccccaguauucagauuuuaucuccaugccccacaaauuucucuuucucuacauagcuaaacugauacuaucaacuucuucuuaaacugcuccuguguucuccgugguauucagugaugcuaccaucuacccagucauuccugcuggaaaucgggaugucaucuugacuuuucuccaugaccaguuauaaauccugcacauuuuaugacagaaaaaauucauaauuuuuucucuuaaccaguaguugccaaaguaaucugauguugaacugacaacaugagauuugcccaguuaauuugggguccagacguguauuuauugaaugcucccaaugugauucugcauauuuaggaaguacuaccuugaaccauuucuaaaaaucauaauuaaaaugaggaugggaaccagcaggcagcuuggucaccuagcaagguaagcugacauccacagauauuuuggagugaacuccuugcucugggaaguucuuuaucuuaguuuguauaauacuuuaaacguauuuuucuaugaauacagcugcauguuuucagaacguaugaguauggucuacuuaguuacugaacacacuaacuaauuaauucaacagauauucauugugcaccuauggaccggggacaugauggcaguaagaaagaugaauuucuugccucaacaguuucacagucuaauggaacauaccaugcuuuguucuucuuuuuuaaggugcaaagugaucuaacauuacagaguaacgggagccaguauucuccaaaugagguaaguuucuugaagauuaauggaaggugagguguuucuugauggcuggauuggaauaucuuuuacagaaauauauaaucuaagacuugugauuaauuaauuaauugagucuuugggggaauccgucuaacucucauuagcuaucauagcuuuaucugguccuauucguaauuaaagauuaauuuuuaugagauauauuuuuaaaaaccgaauguaggaacaucuuuacaagaaaacagaaugaagaucacuuaaauaggaaacauuuagaaugucuuguucuccauaaaugauucagugugugauucaguauuacugaguucaguauuaucuguuuccucaucagaugugcccucuuuuggauauaaauggauauagugugugugugugcaugcacccaugcacacagcugugcaagaggagugccagugucacguaauuguaaaauguucuuaaaauggacaaaacaaauugagugggucacucuaaaacaaacauucuguugguuaugccauuuaacaucuuuacaaagugauuuuuuuuggccaggacuucaucacacagcagcgaaugcaaaaagggaguaguuuuguuacaauccuugaacauagaaaaccauacauaguucuucuguuuuccuuuuauuuuuuuccuaauuuccuuuccuuccaacaccacagauuagagagaacuccccugcagucucuccuaccacaaacagcacagcuccauuuggccugaagccucgaucagguaaaugaaaaccucagcccauucuuacacuaaauaacucauugcuuucucuugagccuuuuaaguguaugcauuaucaaugugcacauccuugucaguucugcugagccgaaauccuggcaucuacagcuaggggaggccagaguuuguagcuuuguuuucagugaaucagcuaaguccguguuaucaguaguggauauucuaucuucguuugaauccgagcaaagaaaaaacagguggugggagcauguaagcggggaagaaauauucuauugauuuuuuuuuaccuaaggaagauaaaauagcuuuggccccagugguuccugcugcucggcugaguuaaggggcagccugccucuggaaaagugacuccuuucugagacauccucauuugauuucugagucugguagguucuguguguuuacucacauaacagaguggucauuucaaggcuugcaugaguggucaggaguuacuuuuuuaaaaagucuuuugagaaagcauucugcuuauauuaccaauuuuaauuuguuauuaguuuauucacaaaaguaaauuauagcaauguacaaaauaaugguugcuuuugaaaagaaaguacucuguauagaaaaauuugauucuucugauuucuccauuuauuugaaguucuguugcuaaucuuccuucuuuuaggucuuucuuuguuuuaauauuuuugacucuuugguauuuagucuacacuuacuacugaugcuuuuaagcaagugcuaauaaagaauucagacgcuuuuaaauaagaacugguagagaacucagauguucuugaguucuccaguaaagcauuuugacaacaguagagguuauacauguguauauuuugcaaaaaggcacccauaggaaaaacaaagaugauucuuuaauaaaggaaauguuuuucauucuuggggcagguugauugauggguaacaaguggccagguguaaugguuuccuggcaguuugaaugggccauagaagaaaagccauuugagaaagugcuugagugugacaaggguuagugaguguuuuauggagagccaaauuuuacaugaaauaaaacucaaauggcuggucuucucauguuuggagcuaagcaaaugugaucaguuccgggcugaggcccuuggcuggguuuuccuuuccacggucucagguguguccugggaggaauggaggugaguccaggcacaccucaucugugccuucagugacaacccaccaggagacuuauuuuacacgcugaggaccucauguugagcugcagacugucuccuaauccucacagucaguuuuacacaguuuaaaagcauggcauaauugagcaaaucaaaaguugaauggaucuucagagaauaauauucuuuugaauguauaacuugcaauuguagaauuauuuuggugacuuuuuuauucuuuuuauagaguccaaacucaacuuauuacaguuaggguuuacauuguacuggggcuguuaaaccauuucacauucuuuguagcagugaaaaauaaauggagcuuuuauuuugaauagcagaaaacaaaguuaauuuccuuuccaagcuuccagccuuucuauaaugcugacuaaccaauguggaaauuguucuuguuguugaaagcucuauggaguuugguugcuguaaauaaugcuguuuaccuucaggaucaucaagugacaugugggaacuuuaaaaacuugcauuauguauggaaauuuauuucauuuuauuuaauaauuuuaaaauaguauauaugcuuaaguguauuuuucacauuuucuggaaaguaauauauacaguaaucuuaacuggaaagcauauaguuuuaaaagaaaccacuuuugaucgaguagcuuuagaaugcuuaaagccaauuaauuuuuauuuugaaaguauguggauuuaugugauuucuguguuauaaauaaaaacagacugcuuaaauuagcaaguucaaauaagaacuuagauucuuaaaguaggcuggcaguuucuuucauuucuuucuguguuuuccucccgaacaaagacaacugcacacacccaaauauuuauaucuagaacuauauccauuuauuuuaccggcccugccuuaugauugaauaaaaaauaauauagauauuuccuaaauaugaaauugccauauggauauuuagugcaaaaauaagaguuguuaucauuucauaagugaccaacucagaaguucuugaaauugauugaucucuguugauuaauuggauuuguuguuaaauagacuguacuagucuccaacauuuuuuguuuuuuguuuuuuaacugagcaauauugaaaacaguauuuagagguauguccaggauugagaaaagaauuagcuagauucagcuaucuauaaagcaugccaauagaccuacaggugucuuuaaaaagaaauuugacauugcuuuggagaaaaaaaaucacuaaugguaaaugaugauucuauaauaguuuuauuucuaaauaauagauauauuuacgcauauuaaguuuuauucuaugucaccaauuuuuuugugugugaaucauauuuuguuaguuuuuuagaaagucuuugaggaacguaucuggcaggucuuuugcuuuuuaucuaccuaaccuauggguacucuuucuuuccucugaccugauucauuaguacucuaagucugugggcuugcagaacuguuaagauuaacaaauaugaacugcaugcaaaguguaugauugauggguacuaacacucaguuuuuaucauucuuuuuauuccaugcaccaucuuucauucuucuccuauauugugcauuugaaauuaaaccccauauaaaugaaauccacucuucauuuccaugcaaacccuaugccauuugugaaaugcugcugccccuuugguuuuuccugguccuugugcaacuguacgcggacuggcucucuggcuccccugcagacccagcccucauucuuccuccuaucuccuucaacacacuuacacaggcacagacaugggacagcucuagcuacaguguuccaucugaaggagacagugacaaugguagguggcuuuguaccuauucuccaauguucucauuaauaagccaaugcguauacugaacauucaucucugugcagcugaagauagaguauauucaccugcaugcuugguaugagaaauaauguguaagccuggaaagugaaguccagaaaagugcacguggauuguucucuagcaguuugucaaacuccaguuuaauuaacuugacuauucuggauuuggggaaggcauuauaauacuuucuuuucuccccuuuucugcuuggguuuuuugguuuguuugcuuguuuacaaauauuugggguuugcacauuuggauuuaucuccgcuuguuccugcaucugaacuaaaugguuuuagaguuugauauuuuacuauuuaugcuuacugugugagauuucuaagguaauuaaaauguaccauggcugauccuagaguauugcauugaaaauaauguuaacguggagaaauuucugaaaaugaagauaaaucauuugccuucuuuuuuccaaauuauuggcauauuuugacuuuugaugccuucuugaguauagguucaucuuuuugacauucaaggauaguaacuuggccugagaaucaaauguguaaauaaaaaaucgaggacacucagcuagaguucauguggguaucuuuuaauuuugaaucuuauauagccuaagagauuacaauaaaacauaauuauuuagaucugcacaccaccuauaucguaaucuccauucuagucuaauuucauccuagucucugaaauauucaaauuuuaaacauuuuacuucagaauacaaagugauugcagucgaguuaagugaaacagagaaugugauuuauagggaagaguagugagguacaggguauagccacaaugcaaacacaauggaaagauacguuuucugauaauauuuaucuuuucaucuaaguauguuacauguaauaccuggaaaauauauguuuaagacacuugcugugauuucugguuaaaauucaaccaaaaaugcuucuacaauuuccuuauggagaaagacaauguauacuuuggcagaguaguuauaaaaagaauuuuuaauauuucauagauuucuaaauuuuuaaacggaaaauaaauaggauuaaaaaacaacaguuauuaaacaaauggcccuccuuauaccauccaguuguaaauuuuggaaguugaagagggcuaaauggaaacuuucuugauaaacauuuucuuuacuuaaguuuuuuuuuuucuaauggaggggaggcauuuuuguuuuucagaaaguauagcuauuuaugggccuaauguuguuuaaaggaaauaaagccuagaaugaaagauuuaugugugguuugguauuuccuuaggaaugauaucugaaaccaaaggccuuuuuuuuuuuaaaacugggaaacaauuagucuucuuauguagcaguagaauuacuaucuuuauagacgaacagacuaaaaccagaaaggugaggugagcugccugggucacacugugggguugagguggaggugaagcugcaccaggguuccuaacucuggaaucaucucugccgcaucuacauucaggcugcuuucauuugauuaaaaauccuuaaauuuccacagaaaauaaucauuguggaaaucuuucuaaaaauaaaauaaccuugcaauaguuauuuuuucuaugaguaaaaauuccaagaauucacaugcagcuguuaugcuguaccacaauaauaauaaagccaucguuuucaauacucacgguucagucgaucaugucagauguuuggagguugucauuuuuuccuauuugcaauuugucucuacuaugcccugggcaacagaaaaauuucuguaccgaaauagucuuuacaaauauuuguuuagguucccagaucugacuuuuauguuuaucuucauucucuuuguucuuaacuuugaccugugauuggaauacauuuucuaauguaaugcuaucuuuguaaauaaccuuuauaaauaaacauuaucuuauuaccagcucaaccuaacauaauguaacuugacuuuuauuuauacauuuaguuauuauuuuugguaagguuguccuuuuuuuaccuugcucacugucuugcuuuauauaaaauuauccuuuuuuuaaaauucuuucaaauaucuuauucccauucuaucucauuuuaaauuccccauuucucuaaaacuuauucuucaaacagauuuuuuaaaauuggcaaccuggguagaagguccuugggaguuugaguucucaaaguccccaaaguucugccccauaagguggaugaaggaggauguggacguuugucuguagguuucucugggcccaccccuggagcuggaugggacagcuuuaaccuccguuuuuaaccugauaguuuaacuucugcuuuucccccugcucuuguguccucuuacugaaucuuuccucuucccuucacuuugaaguuaaaaaccauuucuaucuucuuuggggucauuuuugcucuuucauuugcagugaauuuguaggugcuaauuuauacuuauugaaaauuaaucuuuaaguuaucaccagagaauggaugaauggaccaguuuacauuagucucugaaauaaccauguaucuuguaccaguuuacagauauuuuccuuaauuuuuuacaguaaucuugcacuauagguauuauuuuucccauuagagaaaugaagaaacugaggauauaagaggcuuuuuaguggcucuuaacucugguuuuauauuagaaucaccugggcguuuuguaaaacuauagucacuuaggccccauagucagaaaugcuaauuuauuugguguagcauugagucuaagcacuggucauuuguuuuacuucuuuuuaugggauguuaugugguguucaaguaagguugacagucacuggguuaaguaaauugucuaagaccauagagaagaaaugugagcauuuugaggacaccgaauguguccaguucaauuuuaggcaccagaagggaaugaaugaaucagcuagugagaguucugauucacaguagccuggaucuaaagcucgugauauuuuuucaaagccaagauacugcugccuuugaguuuguauaucuuaaacaucauguccaguucagguucuuaacuuccaaggagaaguugagagcuacauuuuaaaacuucauguuuccacagagaagaaaucuccucucauucaguuaaauuuagguauaaauauuuuucauaugaagaugcauuucaugcaauaauuaaaugagaaagugcauuugggcaauuuuuagagcaaagggcuuucuuucuuugcuugacucaaagauguucucacaacaaguacauaaaugguuucuuguacacauccuuaaauaucugcugagugccuauuaugugcuacacaugaugcucauuacuauggaugcagcucugaaagagacagccaaaaucucuuugcuuucauauaacauuuauuucagagucuaaugcauucacaccuagaaacuaaguuuaggagauuauucauaagaggaaaaacucaggcgacugaucaucagaauagaauaaucuuugcaaugacguucuccaaacagacugagcuuuaagugagggaguguuugaaacguuuguuucauuuacucguucaacaaacucauucugccccacucacugcuuuguggggcaggaauagaggguacaaguuggaaacagacauaaacauuuacagauccauaauggagcgaaauaucacucuacuguaagauagaaaguggugagugccaugggagagacacagauaaaagaauuuuguaugcucacagaagacagagauuacucccagcucagagaugaggaugggguaaagagugaaagaaaaggcagaaaaugauggaaagaucaguggaauuugaccuauaucugcaaguaugaauuugauauucuacguaagcauuucauuauacccugcaggguccaugcuuaucucuucugcuaaguaaauugcguauaugugcaaaucuuuuucauucuuuaaauguuauuuaugcugggugcaguagcucacgccugaauucccaggacuuugggaggcugaggcagguggaucgcuugaggucaggaguucaagaccagccuggucaacauggugaaacccugucucuacuaaaaauacaaaauuuagccaggcgugguggcaggcaccuguaaucccagcuaucuggggggcuuaggcaggagaaucucuugaaccugggaggcggaguuugcagugagccgagaucgugccacugcacuccagccugggcgacagacugagacuccaucucaaaacaaaauaaaaauaaauguuauuuauacaacauacaguaauuaaacuauaggcuuaauuuaagcagaacuuauuuuuuuuccuucaucuuaaauugccuaccuuggccaggcacgguggcucacgccuguaaucccagcacuuugggagucugaggcagguagaucacuugaguccagaaguuccagaccagccugggcaauauggcgaaaccccaccucuacuaaaaauauaaaacuuagccaggcaugguggugcaggccuguggucccagcuacucaggaggcugagaugggagaaucgcgugagcccaggugguugagguugcagcgagccgagaucgcaccauugcacuccagccugggcaacagagugagacugugucucuccacccgccccccaaaaccaaucaccgccucuucaccucuuucaacacacucauaacacacacucugcucucucacccaucuuuuuucuuauguacacuucaacagucacaggagcauuugacuugaaaaauacaugcucacagugggggcugcuucuuaauauugucucauggccucaaguuaaauuuuauuccucuggauuaaguaagggagcucuugaaauuuagugauaugaaauuaaggaaaagcagaauaauucuuuuguagaucaauuuccugaagccuggacccagaccguucacuggauuuauuauuuaaauaggaauuaaaagaaaagaaaaaacuguagguaauuuaaucagagguacuuuaauggucccggugaaguuauucuguuguaacaaacccagcaaaauaagcaagcacuuuuguacuugguagauuuauuaugagccuaaagagauugccuuaaguucucuuauaugucauaguaaugaauacauucagaaaacuaauagugauauagucauuauuucugaucauuuuauguauuucugauaauuuuaaguguucauuuuaaaaaauacaguucaauugguuuuuaaaacacuuuugguugccuaacauucauagagcaaaugcccacacaugcauguuauauuuuuaagauacaaaggaaugcaaaauuaaaaaaugaugccaggaaaguaaaacccagacaccauuucguuauccugauaucucacauagggcucuaauaaggcaaugugguguugaacaaaagcucaugguucauuuaacuuccugauaguuucauauucagauugaaaucugccaauaaaaacauauugaaaauauuauuagauaagauuacccccagaaaaaaggcaaaggaaaguaacagcuccaaagaaaacauucgauguguuuaaacgguguugaggcgccccuugcuggcauauguguguauuauccaacucuaucugcauuucuugaccuuuuuuugguaaauuugguggugcaaauuaguucuauauuuuauauuuuuauauaugucucuuuuuugguguugcuugaaaugguguaaaaugugauucauucuccaguuucuuccaugcgucuuaauuugucagaguuuuccucaguucccuuuucucugugaacuuuucaucuuucccugccuggucacucuguccuuuuacugaccuuggcuuuacuuuuuaaacaauugguucuacguccugugagguuuggguuuugugggacuuggugacagcccuccugugacugccuuugguguucuuugccugugacuucccucaguggcuuccagcagaggccccaggccacaagcugacuccucucugagauuccagaaggcgacaggccuugcguaccuuaaaucauccucuuucuccauuaacucucaagucgacgauuuaagauaugucaauuuucucaacuuccauagagcaucagaaugugaauucaagaaucuuagaacuaauuuagaaagaaaauacugagaugugagaaggagaaugcauguucaaaggcacaaauugaaauuaaaauauuguaguuaggcgagcacaggacuuuugauuacaccgagcggacucaagucuuuguauccaaaguauucuauuuguaaaucauauuuaauuucuagaaaucugaaauauugaaauagcuucuaaagagguccauaggaaauguaugucaggguagaauaaaaauuacacauucuuucuuauucagcauuguuuaaaucaucaugauugaaacuucuguaacuucaguacaccaugcagccuucuaugugguauggauuucuaacauuggaguucucugcccaaaauuuucugagggacuuucccucccuaccucaaucugaaagucugugggaugggggagccaaggcucugaacagcucuuucauccaucuuaugugcaaggauaaaaaucucuaggaagaaaaaaaaaaucaaguuuaagucugcccugggcuuuguaucauuaaaaaguuaauuaaaacucuugcuguagucauucuccgaugcauagaacauuauuuaccuucuugauuggugucuaaaagguguuuuccuucauagggaagggcauguguuuucucagcucauuucagaggaugccccgcuguuaguuacuauucuuggaagucguaacuucaagaaccugaagccagccaugagcccuucagcuacuuccaaucuugccagccuuccuaaaagguguccuugcucaucuccaaagggcuaacuuuuuagauagucugccagugacagucuagaaggcagaauguuuccaccacacccucaaauauguaaucaucacuuaguucuuaacucaggcuuacaaaaaacuuuaugccaacaaaaacauuaacuugugcuuauuuuuaauacauacaacaauucuagagccuuauuugaaauaaauuaucugaauuuaaugaaaggguugaguguaaauaaaaacuuagaaugaagacagugggaagaugagugaaguaggacaucugucaggcaaguggcuuggaauggucccagugacccagaccuugcccuggguucaguuuauuaucacugaaaaauacagcuuguuaguccacacaaacuaguacaauuuaaaauauugucucuuuuaaaauacuugagccaggcuuuucuuguggauuuggaauuucuuuguuucuuugagugguaaaugaauuauuuuggacaaauuaaaauacuguuugauuuuaauaugaauagcccuaugugacaaggcacuauauaaaggcuuuuuuuccccuuuguauuguaguguuucuaagaccucagagaaauuuggaaucuauagacccgcaguuuacaauccggaggaaaauggagcagaugagagaagagaaagagcugguggaacaacuucgugagguacccaagaaauauuauguaacuaaaggagaauuuaagcaacauucuacauuuuugagaaacagacuuugaaacauugcaagcaguccuaauuucaaaucuagccaggucacuuagugacugcuggauguugggcaagccacuuaacaacccugagucuguuucuuuguauacuaaaaaaauguuuuggccaggcauaguuucucaugccuguaaucgcagaacuuuaggagguagaggcaggcugaucacuuaaguccaggaguuugagaccaguauggccaacauggugagcccugucucuacuaaaaauacaaaaauuagcugggcgugguggcguaugccuguaaucccagcuacucgggaggcugaggugggaggaucaguugagcccaggaaugcgaggcugcagugauuuaugauuguaccacuucacuucagccugggugacaacagugagaacuugucucuuuaaaaaaaaaaaaugguuccaauugaccuuaguggaguuuugugaggaauauaugagauaguaguaaauaaaaaauaauauauacauauaaaugcuggcacuauuucaauuucaauucagguauaguuuaaugcccugucauuuauuuacuuaauaauauuaaauuaauuuucauuuuuuauuuuuauuuauuuauguguuuuugagacaaagucucacucugucacccaggcuggagugcagucgcaugaucucggcucacugcagccugugccuucugggcuaaagugauccucccaccucagccuccugaguaauugagauuacaggugugcaccaccacacucagcuaauuuuuuguauuuuuacuagaaaaacguugggauuacagguaugagccaccgcacccagcugaauuuuuaauuuuuaagagacucucucuguugcccagacuagagugcaaugguaugaucauagcugacugcagccuugaacuuuugggcugaagugauccucuggccucagccucccaaguagguaggcauaaauuaucacuacaugccacugugccuggcaauauuacauuaauuuaacaauguuuauaguuauccucacuuuguaccccaaaccgaccagagauuuuaaaucaauuaucuaauaggcaaaccauuugaguuucuaccaaagaggaagucuugugcugggugucauugaagcuuaaacuuggagcuggcagggaccauggcugucuuauuucuugucguauuucuuaguucccaaugggcacucuguagguauuugucuaccugcauggucuuuuugucagguuaggaagaucauacauaaauguauggaagguuaauuaacaguauaggaaucaaucaccaaggaagaaaacauugguauuagcuacuaaagacagcacguuaugaauugcugcaugaguuuuuaauguucagaaagaagugucauaacugugaacuaaaagagucuaagaaagcuucuugacuaauaacagaacaaccauucaacccuguaaucccauuacuggguauauacccagagaaaaauaaauuguucuaccaaaaagaaaccugcacucauaugucuaucacagcacuauucacagaaacaaagacuugggaucaacccaggcucgcaucaacaauggauuggauaaagaaaaugugguacauaaacaccauggaauacuacacagccauaaaaaagaaugaaaucauguccuuugcagcaacauggaugcuacuggaggccacuauccuaagcaaauuaauacagaaauggaaaaccaaauaccacguucucacuuauaagggaaagugaaacacuggguauacacggacacaaagauggaaacaauaaacucugggaauuccaaaaggggagagauagggggugaggguugaaaaacuaccuauuggguacuauguucacugcuuaggugacaggaucauuagaagccuaaaccucaguaucacacaacauacccauguaacaaaccuguacauguaccccugaaucuaaaauaaauuuuuucaauaaagaaagaaagguucuuggaggagauagauucgauguuaaaucuucuuucaucagcacauguguauugacugucacucucuaccaggcuguauucuagguaauggauguaggagagaacaaaaaggucucugcuguucugaagcuuauagucuauuggggagagauaguaaauaagacggaaacaaauaaauacacaguuucagagagcaaugaguucuacaaaugagcagugagcccuauaaacaaaauuuagauuaaauuaaauuaggauaggucagccucuuuguuauagcagaugauacuuuuuauaugguuuagcaaagagucaggaggaaguaauuuuaaaaagaaaacaaaaaaaccucuuaccaccacuuuaagccacuguggugauugagcaaacacaaagggaaagucaaaccucugucauuugccuggacuaucuggaugugauguaaacugggaaggugaacuuuaugaaaucuaugcaacuaagaucagaagcugagcuaugccccucaaggagugauaucuuacaauuuuaucuuaaacaugggucauauugaucauuuaugucuuaauuuagugauauaaaauuagagccugaaagaguaccuaaaaacaauuguccacacacaggacaguucugaaagaaauuuauauaacacuauuauaugcaguguuuuucaaguuuucauuuauuaaaaucaccaaauuaagucauccuuucauacgcugugauucaguuaaaaggggcuuuuguugcagaagcucuaguuaagguuugaaaaucgauuucucuacuucugcuuccaagaggauggaguaggcauacuuugcccuauucuucccacuaaguacaccuaaaaucccuagacauacauaaaacaaauguaagaacauucuggaagguaaagagaagaagacggacugauuaggguccuugagacuugaggggcgccauagugaugagcuccaggggacuuucuuuuugccucauguauccagacuuggagccgaagucgcugggaacccagaaacaguaaucggcacagacuuuagaaaaacaacaauaaaagcugacuuucucuaaccaaauaaccaggaaagggacagcccagcaagacacaaaaguuuuagaccauaaaugugcuacugcagcugaacaccacaggaaacacugugguccccccucacccacaccagcaagggcugagucaagugagacuucuccccuugcugggguggugucagagaagaccaagccaggagccagaaauuucauccccacuggucaguaaggaagcucgucugcucccagaguuucaguggagaccacgugggaauucuggauucucacccccacucagcaguaaggaggcaccuaccccucccccacucccuggccaguugacacccaguagaaaacccagaugccugcauucaccuggcgguaacaagaugguggcagccaccuuccccugcuagagcagugucaaaaaaaaaaaaaaaaaaaaaaaggcaacuaaaacagagauuuaaauaggauccagagucucauaacauaauucaaaaauguccagguuuccacugcaaauccuucaucauuccaaggacgaggaagaucccaaacuguaggcaaaaaagacaaucugcagaugacaucacugauauagcagagauguuagaauuauuugacagauauuuuuaaaccagccaugaugaaaaugcuucggugaacaacgauguacauggucgaaggaaaggaaaagaauaccccagcagagaacuagaaaauuuuggcaaagaaauagaagacacgaagaaaaaccaaauggaaauugggagcugaaaaauacguuauucauaacaaaaagcccaguggaugggcuccacagcagaauggagaugauaaaggaaagaacuggaaugaaacuagaagagagaacaauagaaaucaucuaaucugaacaacagagagaaaacagauugaaaaaucaguggacacagagccucgggaccugugggaguguaacaaaugauccaacauucgugucuugggaggcccagaaggaaaggagaaugggagcaaggcagaagaggaacuugggggugggaaggaaggggaugucucuauaauuuuuuuucuuuuuuugagacggagucucgcuuuaucauccaggcuggagagcaguggcgcaaucucggcucacugaaaccucugccuccugaguucaagugauucuccugccucagccuccugaguagcugggagggcgugucaauaaaaggucaacaugggggauccuugugcuggugggaauguugugcaucuugacuuugucaaugucaauauccugguuguuuugaaaguuguuaccauugaaggaaauugggcaaaggguacguggaaccucuguguauuaguucuuacaauugcauaugaaucuagaauuaucucaaaaaucaaaaguuuaauuuuuaaaagaaggacaaagauugauuucucagcuaaaaauagucuaagagaaaaacauuucuuucuuucuuucuuucuuuuuuuuuuuuugagaugggaucucacucugucaaccagguuggagugcaauggcaugaucucaacccacugcaaccuccaucuccugaguucaagacauccucccaccucagucccccaaguagcugggaccgcagguacacaucaccacgcccagcuaauuuuuuguauuuuugguagagacaggguuucaccaugcugcccaggcuggucucaaacuccugagcucaggcaucuccccaccucggccucucaaaguguugggguuacaggugugagccaccacuccuggccuaagaggaaagcauuuccuuuuuuuuucuuuuucugucacccaggcuggagugcaguagcacuaccucaucucacugcaaccuccgccuccuggguucaagugauucuccugccucagcuucccaaguagcugggauuacaggcaccugccaccgugccugggaaauuuuuguauuuuuaguagagacaggguuucaccauguuggccaggcuggccuugaacuccugaccucaggugagccacccaccucggccucccaaagugcugggauuacaggcgugagccacugugcccgaccagagaaaagcauuucuuaaucccucuucugccccaugcagacugccugaaccagucagauuugguuuuuauuuaucacgcucaaagagugauuccauuauuccauucauucuauuaaauaaaaauuuuacacucaccuaaauuuguuuuuauaaagagagauuuugauacuguuuggaaagaguuaaauaaugucaguguuuucuaggcauuguuauccuuauuuccuaugaugaaauuagugccucaguucauaaauacccauaaauguauuuuacucacaguuaccucaguguucauauuaacuggcuuccuucugauuuccccaacagagcauugagaugagauugaaggucagucuacacgaagaccugggggcagcccucauggauggugucguccucugccaucuggucaaccacauccgcccacggucgguugcaagcauccaugucccaucaccagcgguuguaaguaacaccaaagggaaacuaacugacauaaaacagaccuuuagggggcacuguuguugguuuaggaugucaauggugucaguaggagcuugcucaaaucuuuuccauugggccccaaaccauuauaaggcagaaaaggaaugaaagaauggccuugaaugaagcaacauuuucccgguaaaaugagagacuauuuuaaaauaaauauauaaaugacagaaacauaauuuuauuucaauaucaagcagaucacuuuaaauaacuuacugggcgggcacgguggcucacaccuguaaacccagcacuuugggaggccaagguggguggaucacuugcgcucaggaguuguauuuuuuguagagacgggguucuaaaauagaaaacuacacaauacaaaaauaugaaaaauacaaaauuuagcuggcuaugguggcacgcaccuguggucccagcaacucaggagcugaggugggaggauugcuugagcccaggaguucaaggcuguagugagccaugauugugccacugcacuccagccuggagacagagugagacccugucucaaaaaaaaaaaaaaaaaagaaaaagaaaaaagaaauuacugauugacugaugaucaaggugcuaacuuuaagacuauaggaacauaaaaauuucuuuuucccaagaguuauuuaaacagugacaagucuuucagaaagcugcuuuugguugguaacuucccuucuaaauugaaucuuuuuccucuauucaucauggaggauuuuagggauagcccugaaaagaugugaguucuaugaaaaauacuaugaauaaccugucaagggguugguuagcagucaugacuucaacaauugcuugaucagucacugcacucaaggacucauuggugaugcuggggacguaguggggaggagaacaugaaugagacuccuuaaugcgcccccagauccucaucucugcuguagaggagauagagccugcacucagggcucucuuccuagguaucacagcauguugugaacuagaagagagccaaagagucaguuuuaugguuguucagaugaaaguggaggaaucacagauaaacuuguccuugaaaccuacacaggauuuauacaaauagagaaaaaaguaucacugcucacccuuuuugcuguuuguuaggagaggcagaagaauuuagggguuaagaauguaagguuuggauuaaaauucuaaaagcuauacaacuuugggcaauccucucuugaacuugauuugcucuucucuauaauggaaauguucuugcaaguaugaaguaagauacuucauguaauuuacacauauauguaagccauuauaaucauuaguguuuauauggcaaguuuuggaaauuuggagccccauaaaagugcaauguucauaaaaucucagagcccaguguguuggacugaagcucacgugaagcuccuccgcccucucccauccccaggagagccucacaguggcaugauuuguccuacuuucuuuucucuugacagcaggaaaaauuagccaaugaccuuauuucaucuuaguuucuuaucuaucauauugaacauauuuuucuuucaaagguucaaccacuuuuuuagccucagaaacauaguggggacaaaaagaccaauuugucuucuuuuacaaaucuaccucuagcagccuuaaugugggacaguaaauucuguuccaugauccaauaugaaacacuccaguaucuuuuacaaaugagguccaaacugccguaaagucaucugagucucgugccagauucucaguaauuuuucccaaauuaugagagagacacaacagacaccucagccuucaauuucaauguacaaugaucauuuuacaagacguaagaggacaucaugaauuguguacccauuuaccuuuaucuucaggaaaaaugcuacauuguuuuagaaaucuuuugguuuucaccauuuugcuuuuuuuaaauaaaaauuuuaaaauuaaacaaauaauaggaaacaaugagugacuggugaaaaaaagaaaauaaaggaaagcaaaagaaaacaaaucauucuuuauucuccuccuacccaaaaccaaucacuguugcuuuuaccauuaugucuucuuuacuauaagcuuuuuuuuuuuuuuuuugguaaaauuaaguuguuuuuuaauugugagcuucucauauagacuaguaauuuuuuaaauguauuauugaaaccuaaauauuuccccaugucauuaaaauucucuuuuuuuucuggagauggagucuccucugucgcccaggcaggagugcaguggcacgaucuuggcuuacugcacccucugcccccaggguucaagcguggcucagccuccugaauagcugggauuacaggugcccaccaccacgccuggcuaauuuuuguauuuuuacuagagacgggguuucaccauguuggccaggcuggucucgaacuccugaucucaaguaaucugcccgccucagccucccaaagugcuaggauuacaggugugagccaccucgcccagccuaaaauucuucauaaaugccuaauuuacugacuauaacauauuuuagccuguuuuauuauauuauaguuuuccuuuuuagaaaugcaguuuguuucuaaauauccacuucuacauguccaauuaucaaaaauucuucaccaagcaucuugaugaccuuuuggaccaggcccagccacgcuguagccguagaaccugcuuuccuucuuucuucucugccguugcucuuugccccaggcucagcacaggcagcucccucugccuagaaagccaugcccccaccugccccccaaaucuccuugguucuucagcgucacuagcucccuuuccuucucuauuucagcauucagaaaacaaaccauucucaacgccuuaggacaggguuucuuccuuuguucauuuuccgucacaccuaccccaugacaacuaagaacuauccuguauuauacuguaccuuccuuuagguugcuaauauuuccagcugcuuuagagguaagugagccuggggauuuugucuuuggcuccacaguuguaucuuuagcaucaaguuuaguaucugacccauaguaaagcaauaaaugcaguuguaucugccagcagcaguggaugagagcaucuuuucuaccaguauuaucaccagcaaaagcauucuaauucuucauucaugaaacuaauauuguccauuuuguuuuugccaaacugagggaauauaguagugaacaaaaucacuaucauugucaguauccuuagagacuauuccuuagaaaaaugaacuuuuucagccucugacaauuugauaagcaaaacauuggcauuucaauugguauaauugguauaauguuuuauuauuggaccaguggugagguugaagcuuuaaccauugcguuugucacaaguacuuuucuaccugaaguuaggcaacaaucuuugaagacgcccucccucacucccaaagagggagaauuauuuuucuguagcuugaaacacacucuccauuaacuucuuuggggcugaccuaaguauuuggaaugauguugggcgucuuuggaguuucagaagagacucaccuaaggacaucuuuggaguuucagaaaagacucaccuaaaucauaaguaaaugaaggaagauaaugggcccaaacgaucagagagaaacgcuagggucuuggcgugaugaaaugccucuugguaccucaucugccagguccaugacccucuguuaucuucagucauguuccucaggucugcuucuguuugcacaaggcuucaugcaguggccuuguccugagacaugccagggguugggcaaaaccaccgaagcagcugcuggcgacaucucuuuagggcccacgugagggacgugacuuccucccuaaucaagauggagaauauuuauuuagcuuucaacuuaaauuguuucacagggcaacagacucuguuuuuggcagggcuuuucuuuuuguauuuaauaaaugcuguacaaauuagauuuugaugauaguugcuuugugccucuauaagacggaaugaauuccgucauucucacaugagcaggauaaggccagucuuuaucacaguugcuccuccaccuacaauauuggaaucagucaugcgucuugcuuucuuuccuaaggaaaauaguggaggaauauuacaauuuagcagcaaaguguucaaaacguaccauguaaaaaaguauaguauauuauauaugaaaugugccuguuacccaucccacaccucagaggccaucuauaaccaagguuaauucaauugugagaagcuuuugguuaaguccugaacauccaccauuuucagugcuguuuaccaugauauugccucuauaucccuggcuuuggugggaaggagguuaauuggccuggugaauuuagacccuuuauauaggaauauauuuguugauggggaaguugauguuuaugguguacuuuaggcaaacuaaaacagguuacacaacaguaugaucccguaaaaacuauauauacgugugugugugcauauauauaaacaauauaaacauacguguguauacauauauacauauguaugcagaaaauuuugcauacauauacaucaguguauauacaugauauacaaacaucuauauauauauacauaggcauauauguauaucuauguaggcauauaugaacacagugucuggaagaauagaaucuaaaauauuaacaguuuuuaaucuaagauggauguuucugagugauauuuuguuuucuucuauuugcuuauguguuauuuucuuuugcuccaauaaacauguauugcuugugccauuugggaaguuuaaaauuuaacauguuauuaaaaugguuucucuuuuaaauaauauauuauuuccguauauuugcauuuauagcccaaacuuagcauggccaaaugcagaagaaauguggaaaacuuuuuggaagcaugccgaaaauuaggaguaccagagguaacaucaaacuuacuucauauaacuguguucuaguaaaaauuuuauuuaauauaugaguuugaaccauugaaucgaugcaaagcuuuguacaugcuuuuuugucucaaccuuucuugagaaauaauauugaauaaauuauauaaacuuuaacuugcucuauugcagugaaaguaaaaugacuaugcaauauguucaauucugaggaaaaagggaaauaauuuaagauuuugaaguaagugugaaauuucagacuugaaaaaaaauuuuaauccgcuugauucuccaagagcagaaauugcugaggcuguaagugaaucuucucuuaggcuucauagaguagaauuuuggagcugaugguuuucuuaucccaggcucugaagaaaagaccugcugauuauugauuaucauucucuguagcuguauuuuccauauguggauaaaaaaaucaacauuggaaauacuauaguuauuguuaucacuaaucguuaucauuaauaauagcagcguuuguguguugcuuuacaguuuguuaacuauuugcauuucauuuuugccuucaguuugcuuugagcccaauaggcaauucaauuacauauaguuugcuauuuuuucucucuccaaccucggacccagccucagccucaggcagauggcugggggcuuuuaaagacuuugcuuuuaggaacauaaacugauuucuuaggcagacaggaggccauccacucagaauauggaguagccauauaaauugaggaguuuauccucacugugauaaacagaaauugauagaaguuuauuucuuaugauuucuucuuucuuaaugccccagggauaagguaauuuuaaaaauacaugcgauacuguuuugaguauaugaagaguuauauuucaguauaauucuacucagugauaggaauuaguuacugagauugacaaagacuuuuuucccuuuccuuuucucucuccauccuuccuuccuuuuuuuuccuuucuuccuuucuuucccucuuuuuucagcuuggugggauucagaggugggggauagcgguagacuucucaucuuauuugaggaaaaggagagcauuauuuaaaacaucuuuaagucagagcuauaucaauacaaggaagcuuacaaauuuauuuuuuaaagaguguaaauuuuauaugauggacugucuuugugaucuauucugcuuucagcaauguuauaaucugucuauuguguguguacauuuuaauauugcauauacauuucuuggcuuugaauauauaugugaacgcacuuacauaccuuuucuaaugauuugauucugucaugggcuaguaagauuucccaugugugaaucaaaacucucauggcaagcuucagaugauaaauuauuugugucugugcuagaaagcacuucaucagugcuuuaggucauuagguuaugaccuaacucccugugguuuuuaaaacucaucaauguguuuuuggcuuacagugauauaaaauaaaauggaaaugcccuuaaccaauuauugugaguaaagauugguaauuaagauuuccuuuuaaaguggagaaaaggaaacuaaauuaccauaaaaauccagagcaaaauuuaucauaauuucucaagaugccccuggcaguaauguacaauuuauaauucccgagaagguucaaauacaggcagugaaugaucuuuaucuggcagugucccauuuaacuauguuuaguaucacuuagcguauuucuggaauuauguuuaaggcuugaggugauuuuccuuuuuuucuuuuucuuuucuuuuuuuuuuuuuuuucgagauggagucccacucugucaccuggccagacuggagugcaguggcacgaucucagcucacugcaaccuccacuucccggguucaagcgauucucuugccucagccucgcagguagcugggauuacaggugugcacuaccacgcccagcuaaguuuuguauuuuuaguagacacgggguuuuaccauguuggccaggcuggucgcgaacuccugaccucaggugauccgccugccucagccucccaaagugcuaggauuauaggcaugggccacugugccuggccaaggugauuuucaaauuugcucuguguguguguguguguguguguguguguguguguguacacauauauauccuaaugaauaauccaauagcauuuuacuggugacuagaguuuaaauuuacuucuacuagacaaaaaguguguuaacaguugaacuucuuuaaugauaauguuaaaguaaguaaagaauauuuagugacaaaucagaaauuccuauugcaaggcaacuggcauuuuccuguauacucaaaacaacauguuuucaucucacagaguacaggaaauguuuuuaccuuaggaauaugacacuaaauugagggaccagaugacuuccccaccccaccuuagauauuuauacuuccuucccuaccuaggaggguugaugacuugaguguauguguggcacaguacaauugaugauuuacacugaaaagguaauuauaucacaagacuucuugcagaaauucuccaucuauaauuagacauuuuaaaagacauuuuuaaagaccuaaaaaaagaggaccuauaucauuacuuuuucuuguugcaucaagcuuaauauuugaguaauaaaauauucacugauuuccuaguagucaguguaguuacuucccucuaauuugcaagcuuuuucuacuucuccaucuauaacuuaucuacacacacacacaagccacagagaucuuaaguucugcauuuuauaagcuaaauaucuaacugacaaugauaaaucauccuguagauauugaaaagucacagcuguguucuuaagccuaaaauuuuuuguccuauguaauagaaucacaguuugaaacuauaaaccauagucagggucagcaguuuguauaauuuuuucacauucauauagauggaauacaguagcuaagcagauuuaguuaaauuauuacauguaaaguaagaaaaugggauggaaauaauaauaaaugauuuucuuuagaaguccccauaaacgcagucccaggcauuugcuccagggugggucaugguucaugacacacuucucuuugcuucugcagcuggaaccacugugugguuucucuaauauccaggaaacaugucugugcagguuguggcaguauacuaccuaaauucacugaauaaauaguaaagguuagugggugagacuaucccuccacgacauuuaaaaaaauuuguuaugauuuuuuaagacagggucucacuguguuacucaagcuggucucgaacuccuaggcucaagacacccuccugccuuugccuccgaaaauguugggauuacggacaugagccacugugcccaacccuuggugguauuuuaagcccacuuuuuacaguaguguagaagacaguaguucuguuguggcugauucauaaaugcagcauuuucacauuggcuacauucagaauuauaagcagcauuagguaccaucccacaucccuuugugcuguugaugcuuaguggucagacuuuguagcugucuucgaccucuagugcaagcaucaacuuggucuugaagacaggccuuagugggcuuccaaauucuuugggauauauuuucugcgucaccuaagaaucugacuccaauuaggccuugaccccaugaggcuuuuaauggacacauuggggcuuccuuugacuuuucugagugcucuuggagauuccugaccucuaaccucuauguagcagauuggcuacauguuccugguagguacaguucaugguugacuauuggagguuuucaaauggauccaaauuuagggauauuuuagggcucuuauuaguauucucucagguugagagaaaucuaauuuaugaagcaucaaaaaauuaggaaauagauauuuauuugguucaccagggaaauuuuucuacuuaauuuuaaauagguaacuuugaucucaaacuucuguaaggcaugagauccuuaguuuaacagacuugccuucuuuagaugaggggaguuagaauagaaauguacucuguugucuaaauguucaguccuucaucuuccuuacuguuuccagagaaaagauagagaagaagauuaaaggcagcaacucagcugacagugguagccuccuuucagcuuagggcuccuuccugccuaucugggcagcucagagugcuggaggaaggagaaaguuuucauuccacaugcaaaagggcaggucacuuggcauccuugagcuucugcaucagccaaagggaguuacaaauaaaacccuaaaguacauucagaugcuaaugaugauugugucaauguaaguggaauuauggcugaguuuuccuuaucuuuuguaauuuucauauucgcauuuuuuguguuaaagguuuuauauaugaaagucauaauagcguucccacuuuacaccucuugugaggguuuaggaaauuacacauaccacugauugaaguuuuuguuuuugaaagacaaucuauaaauugaagcuacuguuuuuuuguuuuaaucuuaagaauaagagaaaugggucccuuaucuucucugagccuuauaccuauuuuucuuccccaagucaaugacuuuaguguuaauuuaaaucauaacuaacacuuuguggaaggaugagauucuuauuacaagauuuauuuuaauuuuccauuuauauugguuaauucuaagggugaaagacagguucauuguuuuacuaacaucaauuuuaaaauucauaauuuauugaaaacagccaaucuaucucuuuucuagcuauaaagaaugcaacuaauuuccaagcuauuccuagcuuucucuaaguucauaaaauuggcaauuaguugucauauauuuggagaagacuggaaauccuuccccaccucucuccucucccugccaaauuauaccucaucgcugaauuauggcuuuaaauauugcagaaugaccaugaacauucuuauauuaugauauuuuagauuaaaaaauacuuuguaagcauauugacuuuuuauauuaagauuauauuuaaguaaaguaaauauauuccaaaguuuuaaauaaaacuucugccuagauauguuuagcucuuagaauuuagacuguaguacacccugaacugcuggaucugucuacuuuucucuuuguauccauaguauuuggggaaccugguccaguaguaaucucggucacacacucugguugugugcaaccuaagugaauuucuuaaccucuggcgauugugauuuuuguucacuauaaugggcauuagcauccgcacuugccucuggggacucuuagugaauuaacuguguuuuacaaauggcuugcagugauuacaaaugcuuuguaaauacauggugaaauuuugccucuuuaaauuuccuuacuuuuuagcauuuuccaauuuuaauuuucauaaagaaauaaaguauaaucucuacgucccucucaguaaggcuaaauuuuggaaagcacaaagggcagaaccucccaggucagaaauuaggaauuuuagcccugguuugcuucauggccccauuucaagggcugaaaugacuguuggcuaugugacauaggguugaaucagagagcaguucucagauggccacagcagcucacacuccacacaaucaucauggugcuucacauuuuugccuacuagacagucuuagauccauuccuuuuucuuuagagauuaugauuuaauuuaaauuaaccacuauaggcugugacucuaggucucacccacuuuaauuaagcccagagucuguggcaucgugaaauuguuuccuggaugagaagaauggucuguguugccugcccccaugaggaguguacuacugaaaacugccaaguugaucugacucuaguucucugauggugcugccagagagcagaccagacauguuccuuaggguucugcgaaauguauugaaauacuuggugaagauagaaucaucugcuuuuaacaugaaaauacuaguuuugugaaaaucacauuucaguuugcauaucagccuucugucuuaugacugcuuugcucggauuucccuggucaagcacaacauugcaauagaaaauucuuauugcaauagaaaacuuuucuuagauguuuccucaucuauuaauccaugagcagcaucagucucccagugaaauccaauuuauguguagcuguuuuaauucuugggagaacccuaacagugguagcuugauuucuccagauccacugagaaaagauacaacaucugaauacauauaacaugauuuauucaucuuaaaaauauuuuguuaagaguaucucuaacuucauuaauaaaauaaaauuagaauguuuuuaaucuuauucaaccaaccuaauuuuguaguauuccuacuuaacugaggguaucgagcuaacuucagaggacacaagugaggcaaaacuucuaacuuagaaacaucuuucagucacuccaugaugugcagcugcuuagcagugaggccaaaauaaaggacaaaauuguagcaaaguauguaaaauauacauaacauauaucuuaaaugccucaccuaauuuguaaauaaaacugcauuuaugaaauagaucacacguauuuucaaucuuuguuuaauuuggaaacagaaccacagcuuuuauuucuugcuaauauaucaauuauaauuccuguuaauuuuaaacuguggucauuuccgguucaggaauucagcaugugagacaauuguuugcuuucugacagcaauaggcugcugaaagucaacgcagaaaacugagccucuuaguuugcaguuagcugagaaauagguguucugcuuccuuacauggugacuguugaguagauaaaacacagaggucuacccccccugccccaauauaccuguuuaguagugaagcaauuuacauaguaacuccauguggggguguacuuuuacucucuacucucacuacacauccaagaagccuccccuagacuuuugguuaauguguuguugcaaaaauaugaaauguaauguacuuucugacacauguagggacauacuuagaacuagcauugcccagaguuuaucaagcguaaaaugaaaaaaaaaauuaaauguguguguuaacuuucagagagaacuacuuuauauccaagucuacauagaccaggguaaaaaaugcacuaagagaauggagaguggggguagggauuccauuuuaaacuuuauaguuuuucauuuaguaagguuaaguugaaaugucccacgugaaaaucuuauuuuuaugccacugaugagcacaugauaccuugaauauuaaaacugugugaaaggcagaaugauguguaaauugcagaacaggccguuccuccauggcgagauugugagugaaggauuucuuugacccauuggcacaaaauagguauucuauucuacuauuaugauggauuaaaaaaucuuugaugaugaaagggucuuaccugcuugaaauaagggguuacuccugccauuugcuaguaaccaaaaaugugugcuucuuucuagcuguuccuccguguauuuuuaauuguaugcacugucucuuucuguucuaauggcugcccucggaauaggcugaccucugcucuccgugugacauccugcaguuggauuuucgucacauucgaaagacuguugacacucugcuggcacucggggagaaagccccaccaccaacuucugcccuccgcuccagggaccuuauaggcuucugucuuguccauauucucuuuauagugcuggucuauaucacuuaccacuggaaugcucuguccgcauaaugucugcacgugcauccaaacgcugugcucugucgcccucaaccuuugcaggguccuuccuaccuuugagccuuugccuugcaaacuuccaucccugucaugucuucaguuaucucucgaguuuugaagcugaacaguagcaaaucagauuuuccagaagcacaaacuuuguagaauacaguuuaguauaauuccucucacuuacugaaauacaacgacgacgacugcaaaguguaugcacaccgcaugcuuccucauccacauagugccagcagcagugccacgcaguuccuccucucccucccggugagcugcugcccugggcagaggggaggagaauuccaggacaagagugucaaggacagggauuuagcauauggaagucuuuccuuugggucaguauugaacuagaauucuaauucgggacugggcaauugagcuguauaggggccaccuugcagggaggacagaaaacuaacauuuuggcccaacuugaucuauacaaaacuuuaauaauaccacuacugaccaaguuggacguguacacguacucacacugccuugauggccauucgauuggauuccucccaaauuuccuaaaaagggagccgcgaagggcgcugggcaguguggccgccaacuuccaccccggcaagccccucuguccuaugcagaagggcgcucaagggaaggaagugucguugcuguuagagccucacguggaggagucacuuaaacaccaguuuuuuacugcuuaauuccuuguuaggucuucucuugaggcucuuagaaaagcguuuuccagagagauuucuauuuuugaacaauggaacggaucacugcuuuuuugccacaucacauaguaacugccgguccagaaugugacggauucgacucuauucauuuucaaauaaagccaugagccguggaacauucuugguccuggugcuuggguuaugauggcaggagucaagaagaagauuacuuucauucuagaagaauguaguuucucuaauuauuugaaauguucauuuagccuuugauuuucacugauauuaacuagcaaacugcuuuaagucagcucaaaggauuauauaguaacuauaucugcauuuggagcaaugugaucaguuugcauuuaaaaggaaaaaaaagaauuuuaucuuagccagaaugucccuggauucaggggugucuuuguauaauaugagagggccuuguuccaaggucaaggcagccuccuuauuuuacaugcuguuugccaaaucuuguuucuuagcuuggggagaugauggacuuagcuuccucaagauaaauuucuaguuuauuaagaugcaaacagcucucauagauggcuacuacgaagaaaaucuuauuuuucugaacauuuucaugaauccaggggacuugaaaauauggaagacccacauaguuagaagaauauauuuauaaagauuccuugcugcuaagucagaucagauuugcuaacaggaagcauucuuuacaugacaguaucuugaguuaugugaguuuuuuuuccuccugacuuuguguugauuggugaaaugcaggguauguggaaguuaucuaauuaaccucaguuguauaugaauaacccacagauguacugaauuacuuuuggugcuaucuuguacucuucaaucuguaacacaauaaaaucccuuuguacgaugucuaaugagcacccugagccauaaauugcuuaauaaacacauuuugggugauuauuccaaguuuuuaucagcccauugauacauguauucaugagcucucagcauucccauccagcucugcagugcauugaggcuucucuuuaauggucaccacuguggugguuuuucccuucuuucuggggagaaaaugggaaaaaaaaaaagaaaacuuacuggguugccaccuuaaaauaauaucaauaaaaacugaguaggacacucauguaagaguagauuuaauuuucaguguugauauaguucaauuaaaacauguuaaagacaaauuaaaagacauuuauauuuuaauucuggcauccaaaguauucuuuggacgcacuuugauuuuuuuugugucauuaauuugucuguacucugcugcgcugcacuucuugggauuuauuggaugauguuuuuucauuaguaguaugguaacuagcagaacacaauuaauuuaguccuuuaggcaaaaauuugaaugaacuguucuguccauugccaacccauuaauuucuaaucagaauauuaagcuucucugugguuuuucuccaagguacccgugcaccagcccauaugcuaacuggaugccugcggaugccugcccuugcagcuugacuggggauaccuggcugaccuccuuagagucugagaaguagucagggaugucacugagugguuuauugugcugaccaaaucuccuccucacaagaaagaccguuuuuucaguacucccuuccaauguuagauaaaaggagccaaguaucuauuuacauuuuauuuugaaauagccauuuguauucucuuucuccaguuucuccaacugguggcaacucuccacucagugucaggaauuccaaaauuugugacaccuaauuucuaaucaucuuuccuauuuauggauuucugguuuguuauuuuuagggagagacacuuaugaaauggggcugguggaaaggggccccgcagaacuacaauguaugauaaucgaguauaaauuucaucaaugagaguagauaaauaaaggcacuugauagccugcugcuauuuguuuguaagaaauuaaaacuagcgcguggugagcuggguuaucucucgaaaacucauguagaugccugauugagucauaaggacaaaaggguguuuugccuuugccuguggggaaaaaguagggaugauauuuuaaaauuuuaagaaacugaaaguuguuuuggauuaggugaaaaauacuuuaauaugauuuuauuucaggagacuugauuuuuaaaaauuaggcuucguauuucaaaauuaguucucaauaaacaaucaauuugguauauagaaugugcccuuuuuuucuucuuuaagauggucagagucuaguugccuggcuuuucacugugacuuuguucauuuuuguguucauuccuucauuccauaaauauugaaugagcaaucucugcaaggcccuggggauaaaaaagucacugggacacauggccugguccucaaaaagcuuacagucuauagcaggagucugcaagcuuguuucauaaagggccuaaaggaaacauuuuaggcuucuugggccaugcagauucuguugggauuacccaguucugcuuguguaccauaaaugcagccuuagacaauacaucaaacauagguguggcugugugccaauaaaacuuuauuuacaaaaacuggcugcgggcuggauuagccuguaggccauaguuugccacccuugaucuaguagguccuuagacaaguaaagaggaauucaagugauaaggaccugugguggaacggguacaggauucuggaaaagagaccugacccugauggggaauaggggaccgugaacgcauccugggauggugguguuuccacugagacuuagcaaacguucaggaauagccagguggaguggggaggggagagggacuaggguugaggcauauguguguguagagaaugaaguguucuagggagaggauggacuagaagguagcaugguugcaaaguaaauaauccagggaggagcaacaagaaaucucuguaagauguugaauggucuccauuucacauugaagaaacugaugcaggaacuuaaagcucucguacaucaaaauaacacacagauaguuuuaaagcucaaacaguguagugccaggacuuuauauauaagaagcagccugaacaaaaugaaauaugcuggugggaugaugccauuuuaggcuaguggcuggcuuagaagugugggucucuuugggagcauaagaaacuguagaaggaggagagucaggcagugacggcucauccuguucccagcagguguuuccugccaggacaagaugagcugaguggcagagcuaacccugacacugaguugaggguucgcuggucccaucugacauugaaauugaugggacuagccaucaaaaaacuccaggggccacgggaccucuuccuauaucaugaccgcagaccuaacauauuuaaccauuaaguaagagauuuaugggaggaggcauaguauuguggaaagagcccuggcucuaagacacauguaguucaaacccugguuccaggacuuaccagcuguuuagugucacaaaguuacuugaacucucucucuauauuaguuuucucaucugugaaauggagauauuaaugucugucuugcaggguuaucauaaagaaaucaccaauacaaaccuguaguguuggugccaggcacauaggagguagcccagaaguuuuucaaagcuagcauuuagucuuuauggcuugccgucuuuuccaaugucguuugcuguggcucagaaggguggaugaggggauaugggugaaccuaacagauucuaccauuggagaaguaacuugaagcaugaguucuucaaaggcggucagaagcauuauuuuuaugcaggagacuacuucaugacuccgcuccguacuuuaaaaagaaacacaacaaaaaaagcccaugggcaaacuaagagucuacugucacguucucaacaaaaaucuccgggauccuauaacagugcaacuuaaauucauuucaagucaauauaaagguacagcugucucugcuguaaguccauuaugaacaaggggccugcuggaagggccacuuuaccugccugauccuuagagggcccuucucuucugagucauuccucauccagcuguaaaccuaccaugauucauuccuaaguccagcuucugugcacacuucaaggauccccccacucugugggagaugcaguguccugacuggugugauggcaaauggcccugaccccuucuugggacgccuccugguuggaagccuccccuuggccauccuuccaaccagcaccucaagguguaauucccaccagagucuucauuccaauccugugauagaauaaccagaauggccaugcuuguauaagguuucuguuuuccugugugagucuucuuacaucccuccaaccucagcaaaguaaucugagggcaccucugggcuuccucagggggucugaaaagaggcaggaagaauuugagggguaucuuuuuaugucuucuguuuacuccucaucacuagccauacaagcaggagggaggaucucggacucugcaccuggcuuggaauguggagaccaggaaggcgaggaaugcugcuugaaaaaacaagggccugggaaagagggugcccuucaccuaacucagucugugaaguguccaaauguccuguuggcaggaggcugaggccucgauaccuucccauccccguuucugugaagcccccagccuuucccucgcaugcccuucagcuuagaacccugcaggccacuggagccacugcucaucaggcccuggggucaguccuucauuggaggacacaugccacucuccuuucaggacacaggauaggacaccuugcuccauauaagcugugucguucacagagauuaggcucuaugggaauacucgugcuagaauucaggcacauucuagacuacacauaacuaaacacugagguugaaaagcaaaaugucgugcugcacugccuuaggcaaaucccucauucaaaaauugcuguucacauuccuugcccaguguucuguugauuuguuaguguuuuuccuacugauuuguugagcuuaugugucauauaaaaugcuuuguaauuuuuuuuuuuuuugagaugggguauggcucuauugcccaggcuagagugcaguggcacaaucauagcucacuacagccucaaauuccugggcucaaaugauccucccaccucagccucccaaguagcugggaccacaggugcacaccaccauguccagcuaauuuucuuuaauuuuuuuggagaaaugggggucucacuauguugaccagguuagucucgaacucuuggccucaagugaucuuccagccucagccucccaaagugcuuggauuacaggcaugagccaccauacacauuguucccuuuguaauuugaugcaaauacuuuuuuuuaaaguguuacuuaucuucuuauuaaucgggcuuguuuuuuuaacacauggaugcuuuaaauauuuagguaaucaguugcuuugcucuuuuccuuugugacuuuuucauaaugcuuuuuuagcuuaggaaauccuuucccauccauuuaucagaaaaaaguacuaaauauucaccuuuauguuauugggagggguguuguagauuuuuuuuuuuuuaauguucaacucuuuauuugauuucaaauugauuuuaacauaugguaugaaguaaagaauuguuuuccccaaguaauaucuggcaccaggaacuuaacuguacuuaacagccauuuacaauuuccugcaaagccagaugucgacuugggugcugucagagccaauagaaugaggaagacauaucuuugcccuuauagaaccugccuuaacagugaaaugccagauucaagugauuucacaagcccguggcagauggugccggggaggcuggacacugucaucaggccacagauaucccucaccaugccgcaaaaggaggcaccauuguuaacagccuggcucacagcucacaacucagacagaacucccccauccuuucucagguugauacuuggcuaauaaauugucaggcagcaugaacuuccaugcucaccugauacgccauugacaagauaauccuacuuugauacacagcaaugacaugaaaccaugguuaaaauuguucuuuaaagaaucgacugucuucuguugacagggggccaucucuuaaggccuagguuaaagucugauguucucugaauuugccacaagguagggaagggugaaaagcagauacgguaagauggugagagaguaagacccacugacauuugagacaguggaacaaguuauuggagaugucaugucauguccuuugaaagucuuuuaagcacagagugccugugucuccgguaauuuuuggagaguucugcauugaggcagcaagaagaucugguuccucaagcaagugucacguggaaggaagcccuuccuugcagagcacaccaauuggcuuccugcugaacagugacuccaucaccuagggcuggaugcagaucccacuuaaacucuccuucaaaacagcgcuacucagccuuaaaaagaaggaaauccugucauuugcaacaacauggaugaaccuagacgauauuaugcuaaguaaaauaagccaggcacugacagacaaauacugcgugaccucacuaauacguggaaucuaaaaacguugaauucacaaaagcagagaguagaauggugguuaccaggggcuggguggggagguggggauaggaagauauuggucaaaggauacaaaauggugacuauaguucaucauaauguauuuuauacuugaaaauugauaaaagacucuauuuuaaguguucuuaccaaaaaauaaguaucugagauaauggauaugauaauuagcuugacuuagccauuccacaauguauacuuuuaucaaaauaucaugcuggacaccauaaauaaauacaauuuuuuuuuuccugucaaagaaaagaaaaaagaaaaaguaaacauugggcuguggaaaacacacugucaucaaguagauaaaagaauauuugccguggugucuuuuuccagccaaggagacacacccuggaagaagauucucuugaaugauaucagaccagggugaaauaacaaagguggaaaauuauuucauuguguuauucuguaaacugguuuguggagcaugaaagguucugcacacaaggagggacucacgcuuacuguuuuucuuaaauaguauguccuggacauuucccaagagcaaaaaugcagcaugagagaguagcaggacauaugugucuuugacaguuuuaugaaagagucuugaaagggaggcuauugagggcuguaguuauaauuaccaauuuauaaagacuguucauaaaccaugaagaaaggcugccaguccacccacuugccugcguuccagaggucacaggaaguaaaaugaacucaaugaaguucuauggucaguauaacaauguguggucgguacaaaugaauauuugagugccuuuaaaaugugucaggggcuauuugcaguuuugcuuuauaaaaauagaagcuauuauauucuugguguaugcucucugacugacucuguagcucaguuauuuaguguaaaacuuucuuaaauauuuagaucugcagacuucauggugauuaggagccuuuuugaaacaaacugcaugugugaaaaaucauuauuuucucugcaaacauagaaaaggucuuugcaguagguugaaagcaaaggaaggagcuugguguaggugaucaaacaggcauacuagaguauucaaccuaacuuugaugucaucaacgauguagcaggauuuuacaaugagaguacaaucaucuaaaaauugauguuuuauucuuuuuccuuuuaggaaaagcuaugucucccccaccacauccuugaagaaaaaggccuggucaaagugggcauuaccauucaagcauuacuagacaucaccguaacgaaggcucuguucacaugaaacuaccccuucuccauugggggcucagacucugcucucauccaggauccugaacucugcuccaggcaccuguucaacccucucucccacccacugccugucacuucacugacuccaguuacauugaaacaauuuucagucuaagggaggauuuucuaccuuucagagcugaccuccgacuuuaagacuugacagguauuuaucuugaaaccagagagggagcuggaggaaaaaaaaacugagcagcacaucaaugccuuuuccacccuccuucauccuuuccacacucaccgacugccauuaccaaaacgccaagcacaaccguuuugcagcaagacgcauucguuuuauuaaaaccaaacucguuauguauuuaguggggggaggggggcacaaucagguuuuucaccaccaaauuuuucgagagguuucuugagaccauugccuuuuaaaaaacuauuuucgacauacaaaauauuuauauaaauauuauuuauuagugaguuguuauucauccuuuggaugcaaauuguaaauuaggaaacuauuuuauuacugcuuuuuugugguuaaacacuuuauuuuaauauaaauguugaguuauuuucuauccucuuuggugugcgguaguuuaggucucaguaauguuucugguauauaugauuccaaaaaaaagcgaaaaacaggugcuuuuaggacacaacuuuucuggggaggcaauauugacacuuugguuuguggaacguuggucuuauuuauauuucugcauuccauccaguuuccuacauuccagcagcccucugucccccaauauaaugaacugacuaaaaucaagagagcaccccaaaguuauuuguaaauagcugugauggaaaaaaaaaagacauauuaaacuugaagcuaaaaugugaacaauuauuuuuuggauucauacuucuuuugcuaugcacaaaacauucacguuuuaacacaaagaaauaauaaguguuagcaucgugugucuugaaguauacuuuugcacuguaacuuggguuacguuaaagagagcuuagcaccaaagguagauaaugaagaaauggcauaggaaaguggagaugauaaaaaguugauuguugaaccaaaaaggguuugaagggaagcuucgacugaguaucagaaauuacuuaaggcacauaggaccugaaucaggaaaccagcacuucuuacaacugccaguuuuaaaagaggaaaugauucugagaugugcucauuuuauuuuaauuuggugguuggugguuuuccaaguagucuguaaaauccugcaagauucacagucucuggugugaaaccucagaagugagucguugugagccugugggcagcaccaccaaggcaggcuaaggggagggugcaguaaguggaguuugugaggcugaguggcugaggagggagcaagugcaacaaaauagggcuagagaagaaccagccaaggaguggaacccaugcugcucucagagauucacggaacacggcagccuucugcaggcaguuccaugcaugugcacucacgcugcaaucacagaugucccaguaauuaaccuuucuaagucuugugaaugcugacugcacuuucaccuccucgaaaagccauuggaaguuuuuagagcagcagcagccacaguuuguaagacaaauguagagggggacgcaaaagaaaagacaccaccaggaggaggauucagugugcagucagcacagaccaacaucaaccaaggcaauggcugcccuccacucuugggaagauggggggagguuucugaaaacggaaauuuggauuggcagcuagcaguuauuuccuaucagauguacugugcacuuuaaccuaacuuaaaauguauuuuaauauuuuucuguacugcacaaauaccuguuuugucaaauagcauaaugauguaaagaaacauuuuggacaaagaguguauacaauuuaagcaacauucaaagguugacuauauaaguaggaguuuagccugcugcaccuucacgggcauucagaaugcgggguccugaaauauuuucuuacguguauauaugguagcaugaagcuuuguaaucauuguuuugagagauuuuuuuuucaaaauuaaaguauuucuuuugauauuaauuuuuauuauuuucuugaaguugguuguguaauguaaauggcuucagucuucuguaaaauugcuuuuuuuucuuuuaaaugcaguccuucuauggcuaagacgucuucaagauccuuguacacuguuuauaugugcaauaaaaugcauggccagcugacaguaucgucaguggacagaauguauauagugcaaauauccuuccuuuuauuauuuaacagccauuaaaaucuuggauuuguacaaaccacuuugugauugacuuacccaucaaaaagguugaccccggucacacacacacacacacacacacacacacacaucauagggugucauugcugaaacagauuguagcaaucauguauauuuauguauaugugcacauaauauguauaug

SEQ ID NO: 17665 - RNA, 25220 nt, Homo sapiens
uguggccugagauugccuucuguccaaucugcucacugucccuaagauccagucccaagaacacuguugaccacacagggccaguacugguuugagccaagaucaggcaguaaaauugauggaaacagaauugcucacugggaugcaggccugaggaguaggcauggaacagacuuauuagggagaccaaaccuccuaaaugcaccaguucaugagaccacagugcacuggaauaagacaggaaguaguguggaaaucagggucagagggguaccuccucagacaaaggcacuugagggaggaggcugcaucaggagcucacacuuggcugcauuuucauuauucacugagucagcagcaugguguaguagaaagcaugggaccaagauguaaaggaccugagcucugcuccuggcuccaccaccagguugcacaugaccaugagcaaaugcaaaugcucugaaacuuggcaauguuuuuucuuuucuuucuuucuuucuuuuuuuuuuuuuuuuuuuuuuugagauggaguuuuguucugucuugcaggcuggagugcaguggcaugagcauggcuuacuguagccucaaccucccaggcucaagcaauccucccaccucagccuucauaguagcugggacuacagguauacaucaccaugccuggcuaauuuuuuugcauuuuuuguagagauggggccucaccauguugccuaggcuggucucgaacuccugggugcaagcgauuugccagccucagccucccagaguucuggaauuauaagcaugagcugccacacccagccaacucagcauucuaauagguaaaauagagcaucauaauuaucucucagagcugcugagaagcuugaaugagauuauugacauacuuuuuaaauggcaaaaugauaucaaauguaaauuaucauuaauaguucuuauauucucacuuuuugauauguaaaauugaaaugaugaacuaauaaaauuauggggagacuacagaaaggauguuucagagaguucuuggugagaauggguugucuugaaagguacugggaaaacuuaguggagaaaagcuugagguuuagagaaaaacagagguggguuugaacuccagcuucagugaaguuuagcaguggaucuuugagcauaaaaaguggaucuuuuuuaugcuuugcuuuccggauuuguaaaggggacuaagaauagcagcuaccucagagggcuguugaggguuaaggaaauaaugccagcaaaguaucauacgcggcucacagcaaaugcaaaggugcugcugguauuacgaugagugagccuccugucauugaaaggguucaagcagagguggaaucucaaccccuccaaggguuugaugguguaugaggucguuuaacaaaaugauuucuaaguuuccugcaaauucaaaguuucuaugaguuucucacauaaaaacacaauuacgggaaauaaacaagaaaugaauuugauccuuggaaaagaucauuucacuugugugcaaaaugagaaacuauauaugacuguaaccccaaaaacuauccuccaaagcugugucuuuuuacuggcacugaauccagccuauuauuuagcaaagcccaacacaaacaacuagugagcuuguucacaaugcccugggcuuugaagugucaagauuucaacuucuccugcucuuguuggguuggccccaguacaagauaagggaccagaggaucuuguuggcaaguuaaagaaugaaaacaguaacagcaguuaucaauguaacugugccauuaguccuaacugaaguuguaauugcuggcagacagauaaaauuauuuggggcagagcuaucaauguuucucacuuugaaaaaaauaaaacaaaacaccauucuuccuauuaaacucaucuuuuaggagaaaggaaagacagcucagcuuuggacacugagccaaggggaagugcaacccagcuuuggacgcugaacccuuauugaacuggagagagaaaaauucucacuagcaaauguaaauuucucuuugucagagguaaaguuaacugaaaacuucaauaaaaacaaauaacuuuuaaauauuuuucuucauauauucuuggcuucacauucauuuuuugagcaccaacuaugugcugagcacauugcuaagccuuuugcaugcucugcuaggcaugcuccauuugcuuuuccagauugacuuuuccuccuggucuggcacaagcugaccuuucauagaugacaucauuugagcgccacugacugguucauaguugagcaugacuacugggaggcaacaguuagaaggacaggaggcaaaagaggcuaguuuauucauccccagccugagcuucggguacugaaaauucaggaccuguauuaggcuauuaguagccccgggguagcuuacaacccugugugacuucccuuaacccugcucacacuuuuguaacuaauccaucaaacagauggcccuuuagagugugccaucuguuuuuuguuguuuuuuuuuuuuuuuuuuuuuuucuguaaacugacugaugcaugugauuauuucugauggacuauaaccagaaaugacauagucacuuugaggccaaaguaguaaaaagccaguguggcuccuccauucgucaggaaguaaaagccucuuagauguuagauugccauuuggaagaggcccagguccuugaucacuuuuggaggagagccaccuuuuccucccacccucaacugugacguaagcaagaaguaaauuuuugucagauuaagccgcugaaauuuugggguucacuuguuaaugcagcagagccuaucuuauccugacuaauucucucauuuaauccuuauaaccuccuuaugaaguagauacuuacauuaacucucauuuuauagaugagaaaacugagauguuaugagaaaacugagaugcagagaacuuaaguaacuugcaaccagaccagaaggaacagagcugugcucaaacucaggucuuucugacacuaaaguccaaacucuuaacagaagauagcaugguuuuccccuaaaccacacucuuuuguguggcauggaagguaugucucuucuucacacuuaggaaaaugcacuugcugucagugaaucuugcaaauggcaugagaccagaacaggcauacuggucgggcaaagcaguugauccagcaaauguuuacaggacuguccuaaagccuggaaacucauaacuagcccuguaauauccuugcuuagcucccugaccuggaaaagagggauauaggauuuacuuucuugccuaaagcuuaugacauuaucucugugugaguaucauacuuuuccauuuuccucugauauaaaaacagcccuucucggcugggcagaguagcuuaugccuguaaucccagcacauugggaggccaaguuggguggaucaccugaggucaggaguuugagaccagccugaccaacauggugaaaccccaucucuacuaaaaauacaaaaaauuagcugggcgugguggcgggcaccuguaaucccaggugcucaggaggcuggagcaggagaaucacuugaacccaggaggcggagguugcagugagcugagaucgcgccacugcacuccagccugggcgacaagagugaaacugucucaaaacagaaaaaaaaaaaaaaaaaggaaagaaaagaaagcagcacuucucucuuuguugugccuguugaguacauuucuuuagagagacuaggggcucauuuauagcuauuuauuuuaaaaauaaauaugacucagugcacuucaugcuacuguauuguagauuuuaaaaugguaagaaugguaaauuuuaaguuauguguauuuuaccacaauagacucuucuguucaaucuuagcuuuugauugauuaagguacagaauugcaccuuugccauggauuauuugcuuuggaaaauacauguccugugcauuuucaagguuucauugucagcuggaggaaacaggcuuugucauuugcaggaaaaaauuauugacuguaggucagaucaguuccuugcauucaacaauaaugacuguuuuucuguuaccaaaggaaauucagcuacacugugacuucugaaauuuugugcauaggaaggaaaagccaaaggggugcuugcuggccccagccggaaaugugaccuauugagcuuuccuaaggcgaugaggucagagaaguccuuuauccuccuaagcuagauguaguaagccucagcaguuugcauucuaugguuuuguugaggaugaacuggaagacucaaauucugacucaaaugcucuguacauuuucccauaaucauuuuguacuggcuucuuucacugagcuuucaauggaucuggaguaggacuuuguguauggaaaccuuccuauccuauuuauauuuucuuugacaugaugaugguucuuggaauagaaugcaggaauuuacuuuggaaaggccaacagcccuauuucgaauagugucugaaccaauacauauuugccuagaauccuuuaaagaauggacauguuggguaaagugggaguuuggggucagauucucuguguggugucugaagaucaaauacacagggaaggagacuagacugugguggcuuccacaucuaugauucacucucuauuuggccuguccgugccucgguggucaauguguccaacagaccaugccaaaggauugccuuuuccccauuuuguacuuagggaugacauguuuuaaaauauucaugcauuucuauaaagaggaugagaacugucaagccaguaugaaccucuuauuuuacagcuuaggcacuacuuauccuccacuaaccaacccgauucacuucacacccuguuccugcccugcucuguuccccaagaaccccacauauauuacaucaugggacucccuugcagguaaauuuggccaaccuuauucuucaucgaggggagaaugaggucaggguacuucucaccuaccaccugcuuccuugcuuuggcaccauggucuggcaggguccaaggauuuccucuaauguggcuucagcaccuguuguguggucccccuugauggcuccagguuucaccagguucccagcccuucagacccagauguggcaaugacuuccugcugugcuugucucuauauguuucuagacccgcuuugggucucuuaagccugccuguggaaacaguucuguccuucaaaucucuaagucucgagagaggcgugcucucugcagccugcagaggccuuggcuaagggauuuuuaguuccaaugagcccuugccuuuuugggucaaaguucuugaugccaugaaguuguaacuguauaaccuggagacuuguagagccuugggccacuuuuaauguuuuaauauugacaguccuauaguuuguggcaaagaaauuuuacccugaaagauauuaucuaaccccuugcuacccaaaguaugaccuguagaccagcagcguuguccuugccugggaaaugcagaugcugaggcuccaccucagaccuacuaagucacagucugcauuuuaacaagauuccaagccacuaagaugcacauuaacauucuuuuuuucuuuuuuuucuuuuuucuuugagauggagucucacuuuguugccaagauggagugcaguggcaugaucucagcucacugcaaccuucgcuucacggguucaagugauucuccugccucagcuucccaaguaagcugggacuacaggcacaugccaccacgcccagcuaauuuuuguauuuuuaguaaagacggaguuuugccauguuugccaggcuguucucaaaacuccugaccucaggugaucugcccuggccucccaaagugcuggaauuacaggcgugagccaccgcgcccggccaagaggcacguuauuauuuaagaaguacucaugaaacccacagauuacugagaucauugaauauuacuccacaggaggauccuagcucugaaagggcuauuucaacaggagaguggggcauuuugugaaguagcccaaugauugcuuuguguacuccaggcugaggaaagcagaaaaaauugggguuguguacccuuuuaacacucuuuccuuucagauaucucaaguaauccuguucaguuuuccuucuuuagccuaacucuuaaaaaaaaaaaaucuaaaaaagucauucucucuauaguauaaauuagugggaagauccauuuuauauucaaucaaaagcaaacauuaucauuauuuuuuuuucaagauggugucuugcucugucgcccaggcuggagugcaguggcacgaucucagcucacuacaaccucugccuccuggguucaagugauucuucugccucagccuccugaguagcuggaauuacaggcacgugccaccacgcccagcuaauuuuuuuguauucuuaguagagaugggguuucaccauguuggccagccuggucuugaacucuugaccucgugaucugcccaccuuggccucccaaaguacugggauuacaggcgugaaucacugggcccggccccaaaccaaacauuauuuaagugucuauuaugcaccaagcaguacuauacagcaagaaaugauaaaccagcaauggaaaaagagaaaaguggugggaagaaucaagaaauauuuaaaaagugaaauugccagaauuuaguaaugggugacaugauacuaggguaggaguugggcuugaaggaaaguguggagauaagauauuuucugaaucuuuagccugugugguugguguuggcggugaugcugauaacauaaaugagauaagaaagaugaaaggagaagaagcaaguuugggaagaugacauacugaacuagacauuuagugggcauuuagauguaugaaccugaagcuuagaaaauuaauaaaaaugaggaacuaaccaggaaauauaugauugauccggagcugcagugguggagugggagagugaguggcuuguuccucuaaauucaagcauauaauaaaggaaaugcccuccuaaugaucugcaaguuugagaaaucucaggucaccucugcaccuuguuuaccccccuuggagcaggucccaggcacucaaagcucuuauuaugcuagggcgcuuccucccccugcaccgccucuugaggauccucucuccugccaggaugagacugggaugugauugccccagcuucccauuccuugacauuccugggcacagcacauacaacuuugguuuuucacaugaaucuuuauaggaaauaagagaacaagagaugucagagcaagaaccaaagcagucucuuguguaguauuucuauuaggaguaauuagaucuucugaacaacucagcuuggcacuuuuccuggacaccaaaagugccacuugggaauuaaaugggaacggaaacauguuggcugacucuauugaggguaaauacaaaggaaauccuaauaaugaaaaugauguuauguguuuucuuccaggauuaauagguugcucucuguuuuuguuuuguuuuauuuuguguguguguguguguguguguguguuuuuuagauuuguuuaguuuuggguuuuuuuuuuuuuuccuguauucuuacucacuuuucucuggggaccaaaccucagcuauuguauagaaucccauggauucagauuucaaccugugaggucucuucauugcuuuggagaaugaaaucggagacuccaaccuuaggcauucugaaaacaaggcaacagaacucagauaaaugaauuccaaaugcuacccugugcgugacgaauaacaauuccuuacacuaaaccagauuuaggauuuaugugacauuuugugcugauaaaugaaaugucacuaacugggcaaauggcuuguggguucucuacuuuuuucucaaauaauaucaauguucauuuuucucuucuuuuugauaaagaaagggaaaauuugaccaucaggccugcaguauuaggcugguacaaaauauuuucucuacgugcugcagaagggagcagaguccuuuaguuuuacucuuuagccugccuuagaagacuguguguagcacaaaguaaagcugguaauuuuuuucaacgaaauucaguaguaaaaagacuaaucuggaccacagguucacucaguuagcaaucuucuacccucaagugccagacuuccaggugaaagucauguaucuugaauuuaucagaguaauuuguuguuggaauaugaccuugguuugggagaagacuucagggaaaaucuuuggaauuggucaaauuagaggcaaacauugccuguuacauuugauugcuagagauaacugguggauuuuccuauaacagcaaaaauuagugcaauuuccuuccauguuucuuucaauaacauccuuggacaucugugauaaacacauauuaugcuugguguggagagauucucacccuugggaaauauaguuucuuggcaggagacagauacauagugaugguaacaauaugaugagugauguaauagaauuacauggaaagggccaugggggcaugaauuagagaaguuguacuuucgugaggagaugaugugaguaguaaagcuucacaguggaggugacagugaagcagggagugaaagaaugagcaggacugugggaguuggcaugggaagggaaagagucaaggggaacagagcgagaaaagcacggguuuaaggcaaguguguggcuuggcucacgucuguaauccuagcacuuugggagguugaggcggguggauugcucgagcccaggaguuugagaccagccucggcaacaugaugaaacccugucucugcuaaaaaaauuauuaaaaagaggggcgccucugcccggccgccccuacugggaagugaggagccccucugcccggccagcugccccguccgggagggcggugggggggucggccccccgcccggccagccgcccgguccgggagggaggugggggggccagccgccccguccgggaggugaggggcgccucugcccggccgccccuacugggaagugaggagccccucugccccgccaccaccccgucugggaggugugcccaacagcucauugagaacgggccaggaugacaauggcggcuuuguggaauagaaaggcgggaaagguggggaaaagauugagaaaucggaugguugccgugucuguguagaaagaaguagacaugggagacuuuucauuuuguucugcacuaagaaaaauuccucugccuugggauccuguugaucugugaccuuacccccaacccugugcucucugaaacaugugcuguguccacucaggguuaaauggauuaagggcggugcaagaugugcuuuuuaaacagaugcuugaaggcagcaugcucguuaagagucaucaccaaucccuaaucucaaguaaucagggacacaaacacugcggaaggccgcaggguccucugccuaggaaaaccagagaccuuuguucacuuguuuaucugcugaccuucccuccacuauugucccaugacccugccaaaucccccucugugagaaacacccaagaauuaucaauaaaaaaauaaauuuaaaaaaaaaaaaauuauuaaaaaaaaaaaaagauaagguaaguguguaugguguaugguuaggguaagggguguaugaguguaugaaagggaaggaauaggaggacugggaccagauuguaauugucuugugggucaagccaagaaguuuagauguuaucuuagagguagucauaagccacuaaguggauguuaagcagguaaguauugccucauuuucaagaacacauccagaacuucuauuauuaagagaagaaaauccccauaggaucuuaauaucugagguucaccuucccuuuugagugaguccccaguggucaauaccaauauuuuaggcaaaucucagagaucucuagaccaagcuggagagagggcucuuccaaugacucagugauucucuaagcucugacaaggacauuaaacaagauuauaauucaaugauuaacugaaucaaaagaacauucaacaagauauuacuaaacucucauucuacagaaauaaacaaaagauagaauaauccaguuuauaaaauggggcuuacuuucaggaugugcagguuuggccccauccaguacaaggucuguucuuuuuggguguggacgagaagugcaccaauauacuucugugcagauguacuuuugugaaugggggugagguauggagagacuagagacggggagaaauguuaagcggguacuuccauggccccggaguuggauguauugucuuugcguaacuuccaacaaagggacgggucccuaauaacaaugucugugcuguguaacccuguucucagccacaauggauuguuuuaggggaauucuucucaucaaaguaaaccagauuccuuuacuugaaaauuugaaacuuggaagagucacaaagacugaagauccuuugagcuaguucgguaauagcagagcuuuagagagaugcugcugagcuccuugaggcugucuugcuuucugcccucugaagucuugauuguuaauuucuuccuaagcuucaauuagaagcauuaguguccuuuguaaaaccuuaagcaauuaauuaauuuuuaugagugagcaguagaagacccuauacaaaucugugaaguauaacgauagacauauagaccaauggaaucgaauggagaguccagaaauaaauucucacauuuacagucaauugauuuucaacaaagaugcuaagacaauaaaauagggcaaagaauagucuuuccaacaaaugguucugagcuaagugaauauccacacacaaaauaaugaagcugcacaccuaccucacaccauagagaaaaauuaacucaaaauugaucagaaaccugaauguaagagcuaaaauuauaaaucucuuagaagaaagccuaggcauaaaacauugugguuuugaauuaggugacuguuucuuaaauauaaaaccaaaagcacaagcaucagaauaaaaacagauaaacuggacaccaacaaaauuaaaaacuuuugugcuucaaaggacaccaucaagaaagugaaaagacaacuuauaaaauaggagaacauuuuugaaaaucacauaucuuauaagaaacacauauuuagaaucuauaaagaacucuuacaacucgauaauaaaaagccaaaguauccuacuuaaaaugggcgaaagauuugaaaagacaucccccaaagaagacguacaaauggccaauacacacacaaaaagaugugcaaaagaugauuauuaaucaucaggaaaauauaaaucaaauuaacaaugagaucccacugcacacccacuggaauaaucuaaucaaaaagaaacuaauagaugucagcaaggauguggagaaaucagaacccuccuacacugcuggugggaauagacaauggugcagucacuuugggaaacaggcuggcaguuccucaaaaggcuaaacauagaguuaccguaugcuccuauaauucuucuccuagguauauacccaacagaaaugaaaacauguguccaugcagaaaauuauacaugaauguucauagcagcauuauuaauaauagcuaaaaaguaggaacaacccaaauguccaucaacugaagaauagaugaauaaaaugugguauauccacaugauacaauauuaucuggcaauaaaaagaaauuauguacugguacauaccacaacaugaaugaacccuaaaaauauuaugcuaaguaaaagaagccaauuacaaaacacgacguauuauaugauuccauuuauauccaaugaucauaauaggcaaaucuauagagacagaaaguagaucagugguugcuuagggcugaggggaagaggagagagaaguguguuggggguaacuggguagggacugcuaguggauuucuuuuugcagugaugaaaauguuuuaaaauugauuguggugaugguugcacguaucuugaauguacuaacaaacacugagcugguuuacaugguugaauuuuaugaaguguaaauuauagaucaguaacacuuuuuuuuuaaagaaucuacagagaaguggcuaucaaaaugucuucaugaacuucucagcaagucuggguguucagcagggacucugcugggguucaaggcucaggcuuacuauuuaggaaucugggauguggugacagccacuguauugccauccuguguggcaccucuaggacugcuuucacggcaguuuugugucuucugaucccagggccucagaccuccagggaacagauagauucuggcccugaaccugagacccaggugcuaggagaauucuuggauucagcaucuagugaaguuucauuuggccuuugaccucagcagcuggagccuaauauucuucacgcagaaaauaaaucagugcacucuagcuuugauacgacgaucaggacagaacaacauuaccaucugaggccggugcuaucugccauuaaucagaauaaaucagaauacccaagauagaccucuguagggccuacacugucaaauuaaugaauaggaaacauaaaaauuacguuuccagaccuacuguauguaguuugaaaacacagucaugccauucagaccaugugauucuccauuaauauucuaaagaagauaucuucgaaauggaaugugcucaccccaaaggggccacagacagucuacugcgguacaaagcacauuguaucagaauuucuguguauuccuuauuucaucuuuuugaguuuauauuuuuguuucuguuuuuaauauacaugauacuuuaguagaauugaacaugugcacugcuuauaaauugauaaauuaauguaaaugaaaguguuaaaccuuuucauugauaguuguuugcaauuuuaauaaauguccaagagacugcugcucgaaggauguuuuggcugccagagagagggguggaaauggacuuaagugauaccuugauuuaccuuggugaccuagcccaaaacaaaaaacuagucgagcauaccuguuugcaaagaaagaucaauuuuuuagugugaauugaacuuagaggccaaaucucuagaguucaguuuucuucccacaguggauggggguaagcccuaaguuggccagcccugcuuggguuucuaaacuccuuaucccuauucucuaccaauugggcaauuauuccucuaguuauggguucaacccugcccuagcccgaaaguuccacucugacuuuaaacggguggauuuaacgugcucuaggucaauguucuuggccaaguauucacucuuguugcuagucccacuuuaguaacaaguucauccucaauucugagaacugagcuaguguauugauccugagacauauucccaaucaacaccuugguucuaguaguugaauccucuuuuguucccugugucuaccuacuacucagugcuacaaggauggggaccaccaauccucauauucucuagguauauaauuagggucuggguacuugcugacaaguuuucaguguguuggguucuuggaauguuuacauguagauaacaaaaugaagcuaugcaugaucaucuaagguacacuuguaccuaauuauuaacaucauuagcaaccagaaguaauguucaugaucagcauauaaaugucuucuuuaaugaacaaaacucauuguucuaagaaaacaaagcuguugcacaacaccaguucccuuuaaauguaaaguaaaaucaaugaaacuuuuguauguauccaaucccuagcccauagauagcaauaagccgcuaagaucaccuuugaaaacuaggcacuggcuagaaugggcagaaauucaguuguggucaaauagacucccugaacuuuggacaccuguagauuagauggugucccauguccaguuccuucuggguggauccucaaaaacugccuuuauaaauuaauucacuccaauuuccauuaccaguguuuuucucugcuucuuaacuguuuucacuuuucuuacacucuccagauuuagaaaaauuaacuuuaagaaauacacuugaguuaccuucugaagaggauauagauuuguuuuacuuguauguccuggcucuuguuuaacuccuuuauggccugagcacagacucuucacuggguucaugguugaguaagagaacuggauuucaaaaauucuaguucagguggaguccuguugauggagaaccauuccaccucguguagucauuucuuucagagaggcugacuugaucgccaauuaccuaacgaccaggcagcuccuggagguguuguccaggaguuacuacacccuguagaguugcuucaucugucaguuuccucaugucuuaaauugcuauaauuaucuaccucccaggaugauuguuggaguaaagaguaaguguuacaaugacuacaaaacagucuuacuucccaggugucacagcagcuaaugcaacacgugucaaucucuucaaauuauucauagaauauuucaugugaauauuuauccauauucuuuuuaucugacuguauaggauaaaauuucuucuugaugucuaccuguauuagacaguucuugcacugcuauaaagaaagagguaauuucugaagcuggguaguuuacaaggaaaagaggucuaauuggcucacaguucugcaggcuguacaggaagcaugaugccagcaucuacuucuagugagggccuuggggaaguuucaaucaugguggcaggugaaggggagccagugugucacauggcaggauggagcaagagagggagauggggaaggugccacacuuuuaaacaaccggaucuugugagaaaucauucgcuauugugaggacagaaccaaggagauggcgcuaaaccagucaugagaaauccacucccacaaccuccaccagggcccaccucuaacauguugauuaucuuucaacaugagauuugggcaggacaaauggccaaaccauaucaccaacuuaaauuacucuccuagucuaucaccacugugcuggcuagcagugcuuaccgucacugagaucacacuuuucagugcauagaaacugaacuguggcuuucuccaaaguucgcccuaugauaaguaacacuugaaucagaaagaggucacuuaaauggcauaauguuuucuauuuuauuauugacacuucaucuuuuggagcauaaacuuuauaaguugccuuugaugaacaguaaaacuaacaggaaaguuaauggaaagauuugaaauuuugagaaaagaaacuaaaauaaaaaaggagaguaaaacuguuagggugguccaaaaguaauugcaguuuuugccaacuucagggggccacaauguugacuuaccuggaguugaauuaccuggagguuugccuucuggcuggauaagcuuuggaaaguuguaugaccccuccaagcuucauuuccuuaucuguaagauggauguaugaguuagggaaaguuaaucugcuacugcaaagagaccuaaaaauacuuaaaguagaguauaagcauacucuuauaagaaauuaaaauacuggccaagagcaguggcucaugccugucaucccagcacuuugggaggccaaggccgguggaucacuucaacucgggaguuugagaccagccugggcaauauggugaaaucucaucuccacaaaaaauacaaaaacuagccaggcaugguggcauaugcuuguagucccagcuacuugggagacugagguaggagggucacuugagacuggcagguugaggcugcagugagccauaaucacaccacugcacucuagccuggguaauagagugagaccuaucucaaacaaagaaagaaagaaaagaaauaaaaauacuuaauaagcuuuuauauaagaauauaaaagaaauaaauauaaaauauaaaauaaauaaauacaaaaauaaaaauacuuaaauauguuuuuuuugcaauaauaaaacuugaaacucauauaugaugcugaggggagggggcagcaaaaauuuuucucaccaacucacuacacaggacagcaaaggggugaaaagggccugaagaaggaaaagccaggaaacuuugagaucagcagagggaaccaaggaucaaaaaauaagagaugcugaagcugcaaugaccagcaucauuuucuuaagagaacauucaaggauuugucaugauggcuggacuuucauuggguguuaagucuacaaacagcaucuucaacugaaacugccaauuaagguucuuaagauuuaggaagugguggagcuuggaaaguuaugagauuacgaaauuccuucaaguccauuagaaaaaccacaggaugggggaaaaaaaaaaaaaaaagccagaccacaaagaaggcuucagaggucccugcugguccagggacagacaccuguaguguccagcauuacagugaacaugaucugcuuucaaaggcagaggguuuaaggggaggguaggugggacugguggaggcaaaggcucuccccuuccccaccucaguuuuagguagggcuuuuaauuucacuuaagggcaucucucaacuuggagaauaauucagcccucaacagcacuucaaaugugcuauggcuuugcagcgcagcagcaagaauauuuaauauacaguaaaaauuucacccaaaaaauuaaaauauucuugcaacccccuccaacaccaauuccuguucuaaaguuaaccuaucacuugugcugucaauacuugaccaugaauugucccuguuugcagauuacaugauuguauaucuagaaaaccccaucgucucagcccaaaaucuccuuaaucuuaaaagcaacuucagcaaagucucacgauacaaaaucaaugugcaaaaaucacaagcauucuuauacaccaauaacagacaaacagagagccaaaucaugagugaacucccauucacaauugcuucaaagagaguaaaauaccuaggaauccaacuuacaagggaugugaaggacaucuucaaggagaacuacaaaucacugcucaaugaaauaaaagaggauacaaacaaauggaagaaugcucauggauaggaagaaucaaaauugugaaaauggccauacugcccaagguaauuuauagauucaaugccauccccaucaagcuaccaaugacuuucuucacagaauuggaaaaaacuacuuuaaaguucauauggaaccaaaaaagagcccgcauugccaagucaauccuaagccaaaagaacaaagcuggaggcaucacgcuaccugacuucaaacuauacuacaaagcuacaguaaccaaaacaucauggugcugguaccaaaacagagauauagacuaauggaacagaaaagagcccucagaaauaauaccacacaucuacaacuaucugaucuuugacaaaccugacaaaaacaagaaauggggaaaggauucccuauuuaacaaauggugcugagaaaacuggcuagccauauguagaaagcugaaacuggauuucuuccuuacaccuuauacaaaaauuaguucaagauggauugaagacuuaaauguuagaccuaaaaccauaaaaacccuagaagaaaaccuaggcauuaccauucaggacauaggcaugggcaaggacuucaugucuaaaacaccaaaagcaauggcaacaaaagccaaaauggacaaauaggaucucauuaaaccaaagagcuucugcacagcaaaagaaacuaucaucagagugaacaggcaaccuauagaaugggagaaaauuuuugcaaucuacucaucugacaaagggguaauauccagaaucuacaaagaacucaaacaaauuuacaagaaaaaaacaaccccaucaacaagugggugaaggauaugaacagacacuucucaaaagaagacauuuaugcagccaacagacacaugaaaaacugcucaucaucacuggccaucacagaaaugcaaaucaaaaccacaaugagaugccaucucauaccaguuagaauggcaaucauuaaaaagucaggaaacaacaggugcuagagaggauguggagaaauaggaacauuuuuacacuguuggugggacuguaaacuaguucaaccauuguggaagauuccucagggaucucgaacuagaaauaccauuugacccagccaucccauuacuggguauauacccaaaggauuauaaaucaugcugcuauaaagacacaugcacacguauguuuauugcggcacuauucacaauagcaaagacuuggaaccaacccaaauuuccaacagugauagaguggauuaagaagauguggcacauauacaccauggaauacuaugcagccauaaaaaaggaugaguucauguccuuuguagggacacggaugcagccggaaaccaucauucucagcaaacuaucgcaaggacaaaaaaccaaacacugcauauucucacucauaugugggaauugaacaaugagaacacuuagacacaggaaggggaacaucacacaccggggccuguugugggguggggggaguggggagggauagcauuaggagauauaccuaacguaaaugaugaguuaauggguacagcauaccaacauggcacauguauacauauguuacaaaccugcacauugugcacauguacccuagaacuuaaaguauaauaaacaaaaauauauaaaaaaguacuugaccauguacuuaauuggaaaccuagauccaaaagacugaaacugaaucuucaccccaaaauggaaacaaaauaaaaugaauaacuugggguuuauggcauauaguuuagguaaacacacauaugaggagaaaggggaagaggaaauggagguuuugaagcaaagcugagugacagaauacauucagucagggcagaugucuauacagccugcaguggaacaucaggaaaagcuccauauggauucaugugcaugcaucuggaggcaccagaucccuccauagcagauccaagaacagggagcuaggggagaaggccauuccugucauuccaguuuuagaagcuccauaucgaagacgagaguggcauguggugggaugaugccugggugcccagugguaccguaggcauaaucuggagauguugucaguuugucucucuggcccacacucuucugagcaaccccuucuucccaaccucagaucaccuccugcuugccuagcauaaacuuaaagaacuuguuucuguccaggggagaaugaauuuucuuuccaccuucaagcauaccgguguagugcaacacgcagcucuggccaugcaucgggaaggugcacccuucuccuggggagaugguuuccacccacacucccgcagcggcaguggaugcugggcaggcagucggcacgacccuaaauaaguauuuuuaaaguaacccuaugauaaguaacacucaaaucagaaagagaucacguaaaugacauaauguuuucuauuuuauuauuggcacuucaccuuucggaacauaaaccuuauuaguugccuuugauggacaguaaaacuaauaauaaaguuaauggaaagauuugaaauucugagaaaagaaacuaaaauaaaagagaagaguaaaacuauuagauaggugccaccgugccuggcuaauuuuuguauuuuuuugcagagaugagauuucaccauauugcccaggcuggucucaaacucuugagcucaagugauccacuggccucagccucccaaagugcuggguuuaugccuguauuucgaucacacauaauaauuccuagcugaguauucagguugguuaggcagcuuugugcugcacaguaauuuaaggauccaguaucauauuaaaucucacacaaccccaugagggugucugcuagaauucauucuucauuuuucugaggcauguggcugaccaucuaugcaguguuuccuacuuuauaacaugaaguggcaaagaacuccuccaacacagucuugaaaacauaaacuguaaggcaaaauucaacauuuuugauuacagaaaaauuaaaauuuuuuugugacugugccguaagaaccccaggugacauggagagaccauggguagauggacucaggcccagcugaacucacagucucagcaccagccaucccuucccagacacagacaugugcaugaagaagccacauccugaaguggcuccuccagcuccagcaacuugguggaugccacagggaucauuacuaaccacccagcugagcccuuccugaauuccugaugcacaaaauauaagaaaaacaaaauauuuaaguccuaaguuucagaacaggguuuaagacaaagccuaagcugaaaacauagaucugaggcucacagccaugcaagcgauuaucaaaaaguccuggaauauuucuguagcaaagauuaugucauuugcaauaaagacaguucuacuuuuguuuaaaacaaacaaacagaagaagaaaagcccuggaaauagagacuaucacccauggauggagaguaggaacaaauaggggccaggacaccaauacuuguggggugucugaggaggaggcaucggcuaaggagacugggaagaaacacauagagagucaggaggagacagauaauaacaauugcuuuauugacuuauuuucacuaguuuaacucucagaggauuaccugaaacucuaaauucacucaaaucaacauauuuauucaaaugauauagaauguauguaaggcauuuguuaaaaacuugggguguuaccuagcugagugugguagcucacaccuguaaucgcaggacuuugggaaguugaguugggccaaucacuugaggucaggaguuugagaccagccuggccaacauggugaaaccccaucucuacaaaaaauauaaaaauuagcugggcaugguggcgcaugccuguaaucccagcuacucaggagggugaggcaggagaaucacuugaacccaggaggcagagguugcagugagucaagauuguaccacugcacuccagacuggaugacucaaaaaaaaaaaaaaaaaaacuuggaguguuacaggcagaccugaccuaguacuccaggucuuugcaaugugacuugagcaauuacaucguguguuugaaucucagguauucuuucuuuuuuuucuucaagguaugcaguaaaaugcauaaauauucacccuuuuuuaguguauaguccugcauauguugucaaagucacaucauugugacuaccacuaaaacccgguguccccuuagaauugacccuuucccaccacaguuaccuguuuucugucccuauaguuuugccuuucccagaauaucauauaaauggaagaacacagaauguacucuuuuuuggucuagauucuuucccuaacacaaugcucugagauucauccacauuguugcguguguuacuaacucauucuuuuucacuacugaguauucuauugaaugaauacuucuugccauaagaaacccaggucauaggaagagacgauggguagaugcucugauauccagucauggauauuuaugguauacuguagcuuguuuauucauugagaggaauucguguaauuuucuguuuuggguaauuacaaauaaaguuacuacaaauauuuacauacagguuuuuaugucaacauacauuuucauuuuauuggucaacaguuaggagugagaguguuagguccuauguaaguguauguuuaacuuuauaagaaauugccaaauuauuuucuaaaguggcuguaccaauuuguauucccaccagcagcuugugagaaagcuaguaacuccuugccuggacuugguauugucagguuauugauuuuguuuuagccauccuaguaggugugucucucacugugguuuuaauuuguauuuuucuaauaucuaaugguauuaguaaugaccaccuuuucaggcgcuuauuuaccauucaucacuaauugucuguucaaguauuuucucuauuuuaaaaauguuguuuguuuuccuacuauugaguuuugagaguucuuuauauagucuggaucaguuauauaauuugcaaauauuuucucuuggucugacuugccuuucaauucuuuuaauagcucuuucaaaaaacagagguucuuaauuuugauaaagucuaaugugucuuuuuucuauaggaagugucuuuuguguaguuucuaaaauauccauuuguaacccaggucacacagauuuuucuccuauguuuacuuuuagaaguuuuaguguuuuagcuuucacauuuagaucuaugauacacuuugaguuaauuucuggagcaaguuucauguuuuugcauauagauguguauauguuucagcaaauuuguugaaaagacuauucucucuccagugaauugucuuuccaucuuugucaaaaaaaaucaauagaccauauauguaugggucuauuuuuggauuuggcgcuguuguucuauauguauauucuuucuccaaaaccaagcugucuugacuauuguagcucuacaugaaauauuaaaucagauaguaagaauuccccucauaauuuucuuuacuguguauuuugaucacaaugaagcuaaggaaugguagaauaacaauuaugcuaacaaaaucaauuaacucaaaucagagaaaaucaauagaaagauaauuaacauuucuuucuaaacucugacauggauagaacauguuucuucuaagucagaauaugaugaauacauaucugcagcaaauaugagucuuuuauauaauacauaauauguacaaaacaauuuuaaaauaaaaaacacagcuauuggcuuuauaauccaauuuccacucucuauucaauugcaucucuagaauucccacaacuuaccauuauaauuucuuuaagacauagcaggauuuaaacuaagugguacuuuuaugcucuugcugacauagucuacugugauuucaaacagcauaaagagaaaaacaagauaaauaaauagaaauaauaaauuuuuuuuucuuuuuugagauggaguuuugcucuugcugcccaagcuggagcgcaauggcaugaucuaggcucacugcaaccuccgccuccuagguucaagugauucuccugccucagccuuccaaguagcugggauuacaggcgcgcgccgucacucccggcuaauauuuuguauguuuaguagaaacgggguuucaccauguuagccaggcugcucuugaacuccugaccucaggugauccgcccgccucggccucccaaagugcugugacuacaggcgugagucaccaugcccggcccaugaaauauuaauuacuccaacuuuuacuuuuccauggcagcauuauugcuucaugauuauuccuaggcugaaaagagauaauguaaaagccugaagucaaccucagucuauuuuauuuuauuuauuugagauggagucuugcucuguugcccaggcuggagugcaguggugcgaucucagcucacuacaaccuccgccucccggguucaaguaauucucccaccucagcuuccugaguagcugggauuacaggcaccugccaccaugccuggcuaauuuuuuuuuuuuuuuuuuuuguaaagacaggguuucaccaugcugaccagccuggucucgaacuccugaccucaggugaccucagccucccaaagugcugggauuacaggcaugagccaccgcgcccagcccagcaauuuuaauaaccuacacacauucaguuuuuaaaugaaaucugcagcaaagagaugaaggcagauggaacucucaguagcugugcucuuuuuuuacuuuuuuuuuuuuuugagucucacucuugucgccaggcuagagggcaaugacaugaucucggcucacugcaaccgcugccuccaggguucaagcaauucuccugccucagccucccgaguaccugggauuacaggugccuaccaccacacuggcuaauuuuuguauuuuuaguagauaugggguuucaccauguuggccaggcuggucucgaacuccugaccucaggugaucugcccaccuuggucucccaaagugcugggauuauaggcaugagccaccaugccuggccucagccgcugugcucuuaucauccuccugccuaucgacuguccugacuuuaacuagcagccuguuuggaaguaaaaauaguucaagcccauggaacaucaagccagugacucucaguuugcuuucugugacaaagcaauaauaauauuugcuauacagaguaguuaaaaagacuaacugaaauuauauaugugagguaccuagcaccacaaucaauauauauaaaaacucaguaaguuguaguaccauuauuggcuauuuugugagaggcagcuuauaguucucucuauugaccccagucgugacggcugacucuaggaaacucgacaguggggacgagcaaagaccuguugaccucggaggaagaggagcccaugagggagccagagauggaaacgugagagaggggagauccuugaauaggcucaaggggaaagagaugacaggaggauaauaaaugaauagguaaagaaaagauagaaagucuuuucaggugucugguuaaucccuaacuggucuuccuccaccuucuuccacccugccaaccuugugaaggaccacaguaccucuuuggagggcucuaaaauaaacugcucacaccaaaagagguagugggaaaaguagaauuuacugaguguuucauaaggcagguagagaaaagggaggaaucacacuccucuaagcacacaaugucaccacuucuucucggaugaugauuuucucagugaccagcucucucaggcuccuccucacgguguguucuuccacaaggcacucagcuucuccucaacagcuccccgaaauucagugguuuaaccugcuauuuaaggacaagacucaauaguuucuuuccauccacauucccaaucugagccacuuaccaagguaagguaguucuuccaaccacauaccgaacucucugagaaggucucagaaacacauuuuucuccauuuuuuccauuuuauuccaaaagggaaacagaaaaaggagagaaacuggaaggccugcaugcuuaaagaaaugacaguucaaaauagguuaaacuugaaaauacuuaguggcaaaagcagagggagaaagaaagaga

SEQ ID NO: 17666 - RNA, 975 nt, Homo sapiens
guuucagaagacaagaucuuaaucucaucucugacuauggcuguguggccuccccagaggguacucacuuccugugcuucacccuguuccaucaaaagucugucccuucuacuugggagaggugcuaugaaguacuagaaagaagggugccuguuaaucuuugggcagauguuucugaagggcagaggucaucugagggaggucuagagaucaagcagaagagccggucuuccauuuuggcuggagucauucccuucugggguuccuuaacccuuuagccagaacaugucaucaacucauucaggaaguucuggccuuuaaaauccacaucuccacgacuguaagaagcucucaaagcccucaaugcucuauuacuuuuacagcucacagaaaacauuuaucuuugacucuuugccccaugaaaguaaguaggaaacauaaauauauuuauuaagaaacacacuaggccaacuaacucuagcccucugguaugggucuagaaaucauagccauuccaauucaucacagcuuguccuacagugcacaguacaagauuagcaaaaccagcccuucugguuuuuaacuaacugauuucuauuaagcaaauggugccaaaccggauuuguuauacucauggcuccacuuucaaccccuguggucucucacuuuaacuccuuucagaaagcugguaucaucauugaccccauuagugcugucuucuuuuuaccuucacuggggacaucaagugucucacaacuauguacugccaauguccucagucagugaguguacagggugaggcacuuugcuuuuucuuuucuuaaguaggaacacuuggguaaagugauacaccaaguuacaaauccucuggaagcaaucccuucuaauguugugagucugggagagaaguagggaguugggaagaaaggaacguucuggcuuccuuugcucccacugagagcaguggugacccag

SEQ ID NO: 17667 - RNA, 4426 nt, Homo sapiens
gucccagaaguagucuccacuguagaaguuaauugaugaguaguagccuacaaucaggcucuagcuucuccaggaacacuacaggaucaauuuaguuuaaauaugcauuaaacuaaaaggcauucucucaaaugaguuuaaaugcauuuuauuuuuagacaaccuacaugacauguuuuucuuaaaaacaaugccuccacuccaaauaaaucacagucaaaauaaaugaagagcucaagaugacaucagucccauuugucuuaaguccugguguuguguggaugacaagcagaagccaguuaugaugacaggugauagauccaaaauaauugccacauuuguuacuguaaaagcaaaaacuacauuaauauuuuucaaacauuacacugcaaaaguuacauuaccauuaacaugcagccuacauuuccaggcuaaagauguauuccccaauucaaucugggccgccacaaagacagacagaaagcgcagggauuucuuucuuuugcauccuagugcaaaccaaaagaacaacaguaaauuguucaaggucuaucaguggaugcagaacacccuuaccaaaucagcgguagcucauuuuucagaaggcuguggcauguaccacccacacccugcucuaccaacaaaaaccucagauacugucugaauaaccccuuugguaagucaucuuauacuguucuaaguaauuucugucuacuguugacucuaaucuuguucaguauagcuuuauguuuuucuucuuccuuauacagaagccuaugaaaacuaggauaaugaaugccuuuguuucuguacagcuuccagcaguuccuuccauagaagacaccaaguuauuuauuauuaguaaaacaauuugcauaccaguucagcagucagcucuauuuacuaagcuaguacugcacuaggcuuuucaaugaucagcugcccauuaucaguaaaccaaagugaaaaccacugauacugauccauacguauacagcaaaauaugauuaugaagugaaagugaggccauaucuagaggaagaucaaugguguucucugaucuccuucagcauuuaaacucuacuguauuuuuuugagacagcaccucacucugucacccaggauagagugcaguggugggaucucugcucacugcaaccccccucccagguuuaagugauuuuccugccucaggcucucgauuagcugggauuacaggugcccgcugccaugccuggcuaauuuuuguauuuuuagcagagauaggguuucgccauguuggccaggcuggucucgaacucccaaccucaggugaugcacccaccucggcgucccaagugcugaaauuacaggugugagccaccacacccagccuaaacuguacuuuauuaugccccaucugcacucaacguuuuccacaaauaagauucuaagccuuuuuauacccuaagaauuuuuuacauaugaaacacaauucucuugauccccaaagagaaaacuaaaaccauguuucagaacgcuguaaaacucauucucagugucacaaaacaauugcaaaucacaucuaaaaugucuuuuuuacauuauuuauuuuaacccacuuccuuguacuuacacauuuuuccauuucuaaaccauccuuaaagaaaaucauauauggggucacaccauccucacgguaguccaauagagcaaccaugccaucuggauucauguuuucaccaauaaagaacuugggaagcaaacaaaauaccuagaauuagacuauuacauacaaauacaugccauucaaaacaaacuacaguacaagggaagguuuagaccaccacaaaaaucaaaacuucaguacccaaaagcucugaugcucacuuaucauagacaucuguucacuggauuaaggcaccuuaauagugaccuaaauagaaaaauaacguacagagcaauccaggaacacuaggcuuucaggaaaccuuuacucucaauccuaaauacaaucccaaacccuaaagcgugcuuauauagucaaccacagggaacauaaggcugacagugauagaauauaucauacagucuggaaguaucuuauggccaggggaugcaugaagcuggaaaauuagaggaaagggaaagccacugacauuuuccaaaaguagaauuaacaagcucagauacauuagaaggaggaccaguagcaaugagacacauuaaaauuguaagcaaaaaacugaaagaacacuuaggugguuaagcaauucacaaaaagaaaaacugagaaaugucaucugggaagcaaauuuucaaucagaagacaagauuuggaaacaccugcgagcugggaaagccacuuucuacaccuggaauacuaguauagaauugaagauuaaucaacuuaauuuuugcucuugcaguuaaaauuguacaauccuuugauccagauacuuaagguauuuaccugguaguuuuugaaauuagcaaggaugugcuugauuuguucugcagccccugucauaaaagguuuuacucuuucuggucucuguucuucaaguuucccuuugauucuaaaacaacauuucauuaacagguugaaguauugaauuuucaguaaaaucaauuuuuaaaguaaaaaauauccaagcuuaaaaaaagaaaacacugaaaaaggcaaccagcuguuaagaaauuacuaguucacagaagguaucuuucaagaauguuuacauuucuuguugacuauuuucaaaauacuauucuaauucuaaacggaaacagacugcaggcuucaguaugcucauauuauagaaaagcaaccacucuuuuccgugaacucauuaauaaaaaagcaaggacuuucacaaaaguauacccacugcgaaagaaccucaaaaguuagccaaucuuuaaauccuguaagauucuagacaucagcuagguacugccaguaucacuuacgauuucauguaaucuuugauguacuucuuguaggcuucuuuugugaaacuuguuuccugcaggugaugguucaugacaauaucgacaccagugauuacugugcuuucgguaccuucgcccucggggccuucagcggaggcauuuccaccaaugagcgagucaucaauguuaccuucuguccuacugaccaucugcauuaagaaaaagcaguauaauugcaaaagacacaaacgcauccaaagcaccuuccacgccaauaguucacggauaagaaguauucuuaguucuugcugaaaauaaaaaaagcaccauuuugggaauaaaguugugacccguggauuucucaaaacgaccuaacuuaaaagaguugucuguuggccggaacaaaaaauggggucauuaaaaaguuguuuccaguugcgggcaugugaugccuccgguugguaaguggggacaggacaaacacgaaaggacuccaggcuccuaagccggaagcaucaugucccggacaaccccgggaggaggaugggcgccgaggcggcgggccuauuuccaggaucagcuccgccuccaguuuucuagaaaaacccaagcccggaaagagcgucuccuccgccaggaggcggcggggaggauugcacaaccucaggcgggggagcggaggaaacccgagcccgcucggcccggacucccccacgcgcaggcccgaccgacucaccuuccccuccaccuccaggcacaacccguccgcgaucucccggaucuuguagaugucggagaacaucucaucgucugccggauacacagagccgcccaucaccgugcgccuggcgccgccauuucccgcauuucccgcgccggcggccgcacgcgggaucugccccuccguagcacaccagagcugggcgcgagccccgggcaccgaccccuccgcgcucggcuaagaccgccggcguccccuaggcccgcgacggcugcgccuuccccgcccccacccgcaccccagacccccgugugcggcaguaaggauagugcagugaggacucacggcugaugaggucccgguagauaaucaugauggcgacugaagggagacgacgacggcgcuagcuuagcacgagccugaaacucggagcgagcgcggugcagccggagcggcgcucggggggaggggggagcgggcggaaaaggccgacucagccgcuccccaaccucauauagagggcacgucccucuacgucaucgcccgcugcgccuccggaagcgacgcaggcggugacguggcacgaagagccgcgcgggggcggggccacagcgggggcgagucggggaggugagcauccggggacuugaggcggagacacaaggcuccguuccacugggcacgccagcggguaggggugggggcggggaggugcgcgcgcagcgugggaggaggccaacucucggggcgcucccuagcccuggguggguggag

SEQ ID NO: 17668 - RNA, 2025 nt, Homo sapiens
uuucuauaaaacaaaagguaguaucucucaaagagcaaaugugauuuuuuuuccucuaaaauuaaaaaaauacaugauugcagggugauuauuaucuuuaaaaauaaaaccgucuauaaaauccucccaguaccgcugccgguaagaacuagauaauugaaaucaagacacucgaagucuuacaguggugggacugggcaugcccaguagcucagacgguucggguuacaaauaggaagcuuucgccguuaagcagccgcgggacacagcuccggggaccggggucugacucccuuaaacguaagcacgugugggggcccccauaguauuuuucagggacccuucacauuuucugccgaagcaauggcccaguguuuugaggccgccguggaaaccuccgaacccagcaccccacucccucugagcacggcccgcgccaggccagcccaccccacgagcgggaucuggagaaugggggcggagguggggguggggggaggcggggaagcagggaagcgggaggaccuggaagggaguagggggcggucccaguggcgugccggccaaucggcgcagcucuuuccugcauauauuuugcacuaagacugggaguccuggucuagagcugaguggagcccggcugcggaucugggaagcgccucuucacggcacugggauccgcaucugccugggaucaucaagcccuagaagcuggguuucuuuaaauuagggcugccguuuucuguuucucccugggcugcggaaagccagaagauuuuaucuagcuuauacaaggcugcugguguucccucuuuuuuuccacgaggguguuuuuggcugcaauugcaugaaaucccaaugguguagaccaguggcgauggaucuaggaguuuaccaacugagacauuuuucaauuucuuucuugucauccuugcuggggacugaaaacgcuucugugagacuugauaauagguaaaugucggcuaagauaguuucuuuaaauuuauucgugggauacuuauaauaauacaggugaaagauagccaggcgaauuccuuuguccauugcugagagauuauggugacauggauguuguuuuucgaaauguuaaaaaaccuuauuuuugcaagucuggccagagaacaggcuuuccccacauuauguaauuuaguccuuuguggcuuacuaaaauagggagaugccuggauauucguuaguaagagaggggcuggcauuuucuggagggugauacauuacauaguguuaaauaacauucaaaauaugaugcuagcaauaucacaaaauugggagauccuuuuuaucuuggaagcuuaagauaaauuccauuuaucgaugaccuuuuucccuccucuuuuucagcuccucuggugcaagugugguagcuauugacaacaaaaucgagcaagcuaugguauguacugaugaaaaaucauuuauacuaaaugugggcacagcacaaaaauaagauguuuuguggaaccagugcaucccuaaguucagaugaugaugauugcucuugaugcgcguagaaaugccggcgcugucuccauucggccagcguggagccaccuaccacggcagccguggagggagaaaggggcccugcggguauuaaauggucuucuuccccggacugguuucacacgacgggauuuucucacggugacccuuuuugcuggggauuuauuagggaagcgcuggccaacuaucuccuucggcuggucgugagcacaccuuuagcgauguggcuuuacuaggaauccuaauauuuuacuagggagccgggagguggggagggccccagaagucgggauccuggauaagggucuucuagacggugcacaaacggguccccgguggcgcgggcuccuucacaaugaagaagaaucagagaaaaaguuuuguuuucuuagccugcgccuggauuucuccuauuuuuuauuuccgccuuggccguucuuuguuauuggagcagcgccuguggcucuucucacgggauucucu

SEQ ID NO: 17669 - RNA, 2025 nt, Homo sapiens
agagaaucccgugagaagagccacaggcgcugcuccaauaacaaagaacggccaaggcggaaauaaaaaauaggagaaauccaggcgcaggcuaagaaaacaaaacuuuuucucugauucuucuucauugugaaggagcccgcgccaccggggacccguuugugcaccgucuagaagacccuuauccaggaucccgacuucuggggcccuccccaccucccggcucccuaguaaaauauuaggauuccuaguaaagccacaucgcuaaaggugugcucacgaccagccgaaggagauaguuggccagcgcuucccuaauaaauccccagcaaaaagggucaccgugagaaaaucccgucgugugaaaccaguccggggaagaagaccauuuaauacccgcagggccccuuucucccuccacggcugccgugguagguggcuccacgcuggccgaauggagacagcgccggcauuucuacgcgcaucaagagcaaucaucaucaucugaacuuagggaugcacugguuccacaaaacaucuuauuuuugugcugugcccacauuuaguauaaaugauuuuucaucaguacauaccauagcuugcucgauuuuguugucaauagcuaccacacuugcaccagaggagcugaaaaagaggagggaaaaaggucaucgauaaauggaauuuaucuuaagcuuccaagauaaaaaggaucucccaauuuugugauauugcuagcaucauauuuugaauguuauuuaacacuauguaauguaucacccuccagaaaaugccagccccucucuuacuaacgaauauccaggcaucucccuauuuuaguaagccacaaaggacuaaauuacauaauguggggaaagccuguucucuggccagacuugcaaaaauaagguuuuuuaacauuucgaaaaacaacauccaugucaccauaaucucucagcaauggacaaaggaauucgccuggcuaucuuucaccuguauuauuauaaguaucccacgaauaaauuuaaagaaacuaucuuagccgacauuuaccuauuaucaagucucacagaagcguuuucaguccccagcaaggaugacaagaaagaaauugaaaaaugucucaguugguaaacuccuagauccaucgccacuggucuacaccauugggauuucaugcaauugcagccaaaaacacccucguggaaaaaaagagggaacaccagcagccuuguauaagcuagauaaaaucuucuggcuuuccgcagcccagggagaaacagaaaacggcagcccuaauuuaaagaaacccagcuucuagggcuugaugaucccaggcagaugcggaucccagugccgugaagaggcgcuucccagauccgcagccgggcuccacucagcucuagaccaggacucccagucuuagugcaaaauauaugcaggaaagagcugcgccgauuggccggcacgccacugggaccgcccccuacucccuuccagguccucccgcuucccugcuuccccgccuccccccacccccaccuccgcccccauucuccagaucccgcucguggggugggcuggccuggcgcgggccgugcucagagggaguggggugcuggguucggagguuuccacggcggccucaaaacacugggccauugcuucggcagaaaaugugaagggucccugaaaaauacuaugggggcccccacacgugcuuacguuuaagggagucagaccccgguccccggagcugugucccgcggcugcuuaacggcgaaagcuuccuauuuguaacccgaaccgucugagcuacugggcaugcccagucccaccacuguaagacuucgagugucuugauuucaauuaucuaguucuuaccggcagcgguacugggaggauuuuauagacgguuuuauuuuuaaagauaauaaucacccugcaaucauguauuuuuuuaauuuuagaggaaaaaaaaucacauuugcucuuugagagauacuaccuuuuguuuuauagaaa

SEQ ID NO: 17670 - RNA, 7776 nt, Homo sapiens
uagauauauuuguucauuaacacauuaaauaauaagaucuacuaucaggucucauuaauuacuguaauuucaaagccgugaugagcuuaaugacauuuaaaaaucucugcaacaacuguaauagaucuaaaaacaucuaugauuuucuucuguugacaaagucacaaaacugcuaacacuaguauggacuguugccugcugcauuuaucgucuaagugacaaagauuagugaaacaaauaugccuuuuuuuuccccauccaaauucaugcagccacugaauuccaucccugguuaugaacuuccucagccuccuuaccagguauucuugcaaaggccauggucgcugaggaagaggcauaccugagaccaggcccuccugagccugugacugaaaccauugcaggaaggucagguggggaaaccaaguuacuggaguuuagaauaauuuugguucuuugguugcagaaggaaaugguagagacaagucauuugcuuugccuaagaccaugcaggauuugccuccagaaaaaaaaugacuggguucagaagcucuaauggauugaguagguuccuggcuugguggcauuuaagcaggccucaacucugaauuuucuccuuucaccucaguggacaagaacucaaugaaauccuuguauaaauaccuugcguuaccagcaaucggcugaagaauuuuguuugucuccucauuugucuucugggcuguguaugaacuuagagaugaggagaaaagaacaauaaaaccucgaguugauugagaguguguggaaacacacagcauuucugcauuuggcuucacauuuccucacggcaguuuggcaacauguaccccaaaccuuaagucugugcacauacuucgguauaguaauccugcugcuaaaauuuuuucuuaagaaaauaauuauuuuucauaaagauauguauacaaaauguuuauugguguuuuaaacaauaauacaaaauagaauaauuaaaacacaaacaaaccaagcaaaagaagaaaaaaagaagaaaccauuugcaacauauugcaaaaagugcaaaaccaaaugcuaccaagauucaaaagaguauuaccguacaacggcaauuuggaaagcuaaaacaaauauacaucaaaaaugcuagaagcacuuacaugaaauguuaacaguggucaucuuugccuggugggauuccugaugaguacuauuuucuccaugugcucuucuagguuuucuaaaguucuugcagggugcauauauuauguagcucagcuagauguauuuauuuuugagaaaaugaaugcuaaguuuguguuugaaagaaggaccagugcauuugcuccaaaaaauaauuucuucacaaaauuagagcucaauucaaaucugucaucuaucuccuaacagugugaauucaauaagacaaccugguuuguuuuuugagacagacucucccucugucaccaggguuggagugcaguggcaccauccuugcuccucagugaaauaacuuggaaaggucuggacgggaguuggccugguagcuccccucuugagguuccuccucccacuaaauaagggcagcaagcucaguggugaagcagguccuacccagcucuccuauuuacuguuguuauaagcgagcaaggcuucugggcugccaucugcacugagacguggacaugagaguggugagugucuccuggggcuuaaggacuacugggcucauugggccccuccacacuccagagcucucacuuccuccuucucacguggaggaagcagagguggcagcaggaggacccaggugacuccugcagggaacacaggcucaucucgcuaaaacuguagccuucuggaauucgcuaacuguacauguuugaaauuccugaugcucuucuucggccuuacaaaccuuuccuuucagaggcugaucacaucucaguuguaaauaauauuuagcguaccuuugugccuucacuacacaaaucuccagugauuguuuucaucagacagagcaaaccauguguagcucccuccuggaccguugggccccucugccccaccaucaacaggcagauuccaaucauucuucccacuguggcugagggacgcccuucgggugaggaugaggggagggacugauguccugggcucuguggaggccccauucgggugaugcuggaggcagaagggggcuuugaugagggaggaguuggucaggaaugcuugucacgggcacagcaaugaguagcccaugcaggcugagagcccugcagaaaugggccggcccagugugugcagagcugaucgguagggcuuuaugccugugcuagucaggguucuccagagaaacagaaccaaugggauacauauacauauacuguacauauacauauacauaugcacguauacacauauacacauauauacauauacuauacaaauacauauacaaauacauauacauauacuauauacaaauacuuacacauauacauauacuauacuauacauauacaaauacauauacauaugcauauguaagaggggaauauaagaggggaucuauuaugggaguuggcucaugugauuauagaggcugagaagucccacgaucugcugucugcaagcuggaggaccacagaagcuggugggguaauucagcacgagucugaaggccugaaaacccagcgcucugacauccaaagucaggagaagauggauaaaucaucucaagcagagagagcgaacucuuccuuccucugucuuuguucuacucuuuguucuacuccggcccucaguggauuggaugagacccacugacacuggggagggccaccugcuuuacgcagcucaccaauucaaaugcugauuguuuccagaaacccucagagacacucccggaaaucaugcuuuaccauccaucuugacauccuuuagcccagucaaguugacccaucaaauuaaggaucacaaugccucucauucuuucacuccacccaugcaucugaaugugaugagauaucuauggaacuacucuauauacuauauagcucuggaugccauaacauaguuccuacugccugggagcagagaaaagcaaguaaacaauugucaucuagagaaaguccugggugagugugaguuuaagggguagccugcuggagcuaaagaggaagugacuagcucugcuggagaugaggggagggaggggauacaaggggaaggaaggaagagcgguaugaaagcagagccacgugaauugggacagccucucagggaacugggucuugcagccaaagccgaggcugcucaccguagaagaggcuggcaacauggcaggcggcaggcuccggggccaccgagagagcugaggcaggcaggcgggccugugcccagacuccuugggaauccuauguugacauucgugaggcaguguggguugggggccagggccugggcaggggccacggcugauacugcagcacagaggccacuugggcagcuguagccauggacacuggcaggagggagcaggucugagaaauauuuaggaaugaaaggguggauggaaugugaugcguuaggaaagaaagggagggccaacaacgacuggugcugugugggcaacccgcguguuccgggucaagaagcugaguucaguuuugaguugguuacggggcagcccuguggggaaaccagcaggcaguuggucauugggauuuggagcugggauggggaggagcggcugccgcugagcuuuacgcauaacaccaucccggggaaggggcccugccgcaucccagugcaccgccuacaacugugggcaauuccuuuccucucucugugccccagcuuccuccucuguagcguggagugcauuagguuggugaggauugaaugagccaugcucggugcguguuagcuauuguuaugauuguuugggauucugcagguuguuaagugguggcugaaaccuuggguggaugcgacagcccagggacagaauugugagugagcggggagaggccccaggacagcgacgagccucggugggcaagaauguuuucucacuccgauucugaguaucugaggcaaaaugaugcagagagguuguggcuuaaaaucucuuuaaaauaaauucucaccagaccuauaucuaagcauauaaauaacugaguuuuauaagcaaucugaauuaaacauuuacucgugauguuucugaacgaacaaagcgacacaguaaacacuguauaggacauuuggaggcacccagggacacugcugaauucaugccucgcugguaaggaguugcaugacauuggggagucaaccgcacucucuaagccugaguuuauucaccguaaaaugaaucgguuggauuagaaucauugcuugguuuccuuucagcuuugggucuagcuuuuuuuucuucuuccaaauggagucguccuguugcccaggcuggaaugcaauggcacgaucucggcucacugcaaccuccgccucccagacucaagugauucuccuggcucagccuccagcauagcugguauuacaaauccugccaccaugcccagcuaauuuuucuaauuuuuaguagagacacgguuucacuauguuggccaggcuggucucgcacuccugaccucaggugauccgcccgccucgacuucccaaaguacugggauuacgggcgugagcgcuaccacgccuggccggaucuagcauuaagggcaacgaaacgugaagcugguuuuaguuacccgauauacuugaaaguuaaaugucgggucuucuuuaagagcacggauacggaaggcaggcggaaggagacaguggagcggcuggcgcgcaaaucuaggaaucgggcagccgcuaggcugaggccacuccgacucugacccugacccuggcugguucccaguguuaccagaagggagggucggugggucagucggucagcagcccagccucccagacgugagagcugcugugcuggaagcgcgcacacgcccacuguguccggaauugguggguucuuggucucacuaacuucaagaaugaagccgcggacccucacggugaguuuuacagcucuuaaauuaauguggggcgccuggaguuuguuccuucugcuguucggauguguuuggaguuuguuccuucugguggguucguggucucgcuggcugagaagugaagcugcagaccuucgcggugaguguuacagcucuuaaggcagccugucuggaguuguucauuucuccgggugggcucgcuggcuucaagagugaagcugcagaccuucgcagcgaguguuacagcucauaaaagcaguguggacccaaagagugagcaguggcucauuugcaaagagcgaaagaacaaagcuccaaaguauggaaggggacgugagccaguugccacugcgggcucagggcagccugccuuuauucuguuaucugacccuacccacauccugcugauugguagagcccaguggucuguuuugucagggcacugauuggugcguuuacaaucccugagcuagacauaaaggugcuccaaggccccaccacaggagcuagauacagaguguccauuggugcauucacaaacccugagcuagacacagggugcugauugguguguuuacaaacuuugagcuagauacggagugccaauugguguauuuacaaucccugagcuagacacaaagguucuccacguccccaccagacucaggagcccagcuggcuucacccaguggaucccgcaccgaggcugcagguggagcugccugccagucccgcgccgugugcccucacuccucagcccuuggguggucgaugggacugggcgccguggagcagggggcagugcuccucggggaggcucgggcugcacaggagcccacggagggggugggaggcucaggcauggcgggcugcaggucccgaggccugcccugcgccaaggcagcugaggcccggcgagaaaucgagcgcagcgucggugggcuggcacugcugggggacccaguacacccuccgcagccucuggcccgggugcuaagccccucauugcccggggcggcagggccggccggcugcuccgagugcgggguccgccgagcccacgcccacccggaacucacgcuggcccgcaagcaccgcgcgcagccccgguucccgcccgcgccucucccuccauaccuacccgcaagcugagggagccggcuccggccuuggccagcccagaaaggggcucccacagugcagcggugggcugaagggcuccucaagugccgccaaagugggagcccaggcagaggcggcgccgagagcgagcgagggcugugacgacugccagcacgcugucaccucucaccaugaccacugcaaacacagucgcugcccuuguuguguuuccagucaguugaggaagcgagauagugaacaaguuccagaaaugaaugaaaaaauucuaaggccaugggugagucacugaauuucucugggcuucaauuuccuucccuguaagaugagauauaaaauguuuaacucaagggcuguuaugagaguaaaugugcuaacgugguuuauucgcauuuggcggggcuuguggagaugcauucaguaccaggagaguuaauaaaugaggacagaguggucaaguuauaagaacaugaaggcagggugaaugaaucuucaaacagcagaaugguggcccccaagaguugcaagcagugggcugcaaauucaguuccugauuccaagcuaucaaagaaagaaggaaagaugaucagucugauggcauugcuucuggcuuugaauuuuucaacagcuuccuguggcucuuagauaaaaucccagccccuuccucugucucacacccuccucuccucuugccagcucuucaguuccacagcacggagaaaccaaauuucucccuuucuggggccagcugugugcugucucauucuucauucccagcucugcucaccaaccccuuccucugugacucuucuccgcccugggucagucgccggaggcuuccucgcgcgcuccccuugccugccuguaaaugugggccugucuucugucuagucaccaccccaucccucucagggugcuuaacaccgaguagguguucgggaaaugucaguagagugagcggaucugcugagaguacacaguuuuccccauccugagaucuccgugucaggauccccccgcaucuucagaaacagagagccacgugacguuguggacacaccgcuuggcccagggccugucugcucagauugcaaaaauggugaucuaagaggaccgaaggaggcugguggagaaacaauuugagaugaugagaccugaagugggaguuuacugaaagcagggagggaaaggagaagggggaaacagugaguuuuaagguaguuuacacaaaacuugcaaaggacgcauuaggaagccugcuuucuaugaccaccgccuguaagguacaucuguaaaaguuagugagguuuuuggaaguaaacaaaaggucagccccagaaaagaaagccgaggacaguacaaacccauagagucaggggacacauuuuaaggcaaagaucacaaaggugaagggccaguaacuagucaugaauuauccacaguguagacagguaacaggaaaucagaaguucacaugguaaaagcuuuucagacauguugagcugggaggaugguauauaugguaaaccucaagguaaaauaucgccagaac

SEQ ID NO: 17671 - RNA, 14579 nt, Homo sapiens
ccuccuucucacguggaggaagcagagguggcagcaggaggacccaggugacuccugcagggaacacaggcucaucucgcuaaaacuguagccuucuggaauucgcuaacuguacauguuugaaauuccugaugcucuucuucggccuuacaaaccuuuccuuucagaggcugaucacaucucaguuguaaauaauauuuagcguaccuuugugccuucacuacacaaaucuccagugauuguuuucaucagacagagcaaaccauguguagcucccuccuggaccguugggccccucugccccaccaucaacaggcagauuccaaucauucuucccacuguggcugagggacgcccuucgggugaggaugaggggagggacugauguccugggcucuguggaggccccauucgggugaugcuggaggcagaagggggcuuugaugagggaggaguuggucaggaaugcuugucacgggcacagcaaugaguagcccaugcaggcugagagcccugcagaaaugggccggcccagugugugcagagcugaucgguagggcuuuaugccugugcuagucaggguucuccagagaaacagaaccaaugggauacauauacauauacuguacauauacauauacauaugcacguauacacauauacacauauauacauauacuauacaaauacauauacaaauacauauacauauacuauauacaaauacuuacacauauacauauacuauacuauacauauacaaauacauauacauaugcauauguaagaggggaauauaagaggggaucuauuaugggaguuggcucaugugauuauagaggcugagaagucccacgaucugcugucugcaagcuggaggaccacagaagcuggugggguaauucagcacgagucugaaggccugaaaacccagcgcucugacauccaaagucaggagaagauggauaaaucaucucaagcagagagagcgaacucuuccuuccucugucuuuguucuacucuuuguucuacuccggcccucaguggauuggaugagacccacugacacuggggagggccaccugcuuuacgcagcucaccaauucaaaugcugauuguuuccagaaacccucagagacacucccggaaaucaugcuuuaccauccaucuugacauccuuuagcccagucaaguugacccaucaaauuaaggaucacaaugccucucauucuuucacuccacccaugcaucugaaugugaugagauaucuauggaacuacucuauauacuauauagcucuggaugccauaacauaguuccuacugccugggagcagagaaaagcaaguaaacaauugucaucuagagaaaguccugggugagugugaguuuaagggguagccugcuggagcuaaagaggaagugacuagcucugcuggagaugaggggagggaggggauacaaggggaaggaaggaagagcgguaugaaagcagagccacgugaauugggacagccucucagggaacugggucuugcagccaaagccgaggcugcucaccguagaagaggcuggcaacauggcaggcggcaggcuccggggccaccgagagagcugaggcaggcaggcgggccugugcccagacuccuugggaauccuauguugacauucgugaggcaguguggguugggggccagggccugggcaggggccacggcugauacugcagcacagaggccacuugggcagcuguagccauggacacuggcaggagggagcaggucugagaaauauuuaggaaugaaaggguggauggaaugugaugcguuaggaaagaaagggagggccaacaacgacuggugcugugugggcaacccgcguguuccgggucaagaagcugaguucaguuuugaguugguuacggggcagcccuguggggaaaccagcaggcaguuggucauugggauuuggagcugggauggggaggagcggcugccgcugagcuuuacgcauaacaccaucccggggaaggggcccugccgcaucccagugcaccgccuacaacugugggcaauuccuuuccucucucugugccccagcuuccuccucuguagcguggagugcauuagguuggugaggauugaaugagccaugcucggugcguguuagcuauuguuaugauuguuugggauucugcagguuguuaagugguggcugaaaccuuggguggaugcgacagcccagggacagaauugugagugagcggggagaggccccaggacagcgacgagccucggugggcaagaauguuuucucacuccgauucugaguaucugaggcaaaaugaugcagagagguuguggcuuaaaaucucuuuaaaauaaauucucaccagaccuauaucuaagcauauaaauaacugaguuuuauaagcaaucugaauuaaacauuuacucgugauguuucugaacgaacaaagcgacacaguaaacacuguauaggacauuuggaggcacccagggacacugcugaauucaugccucgcugguaaggaguugcaugacauuggggagucaaccgcacucucuaagccugaguuuauucaccguaaaaugaaucgguuggauuagaaucauugcuugguuuccuuucagcuuugggucuagcuuuuuuuucuucuuccaaauggagucguccuguugcccaggcuggaaugcaauggcacgaucucggcucacugcaaccuccgccucccagacucaagugauucuccuggcucagccuccagcauagcugguauuacaaauccugccaccaugcccagcuaauuuuucuaauuuuuaguagagacacgguuucacuauguuggccaggcuggucucgcacuccugaccucaggugauccgcccgccucgacuucccaaaguacugggauuacgggcgugagcgcuaccacgccuggccggaucuagcauuaagggcaacgaaacgugaagcugguuuuaguuacccgauauacuugaaaguuaaaugucgggucuucuuuaagagcacggauacggaaggcaggcggaaggagacaguggagcggcuggcgcgcaaaucuaggaaucgggcagccgcuaggcugaggccacuccgacucugacccugacccuggcugguucccaguguuaccagaagggagggucggugggucagucggucagcagcccagccucccagacgugagagcugcugugcuggaagcgcgcacacgcccacuguguccggaauugguggguucuuggucucacuaacuucaagaaugaagccgcggacccucacggugaguuuuacagcucuuaaauuaauguggggcgccuggaguuuguuccuucugcuguucggauguguuuggaguuuguuccuucugguggguucguggucucgcuggcugagaagugaagcugcagaccuucgcggugaguguuacagcucuuaaggcagccugucuggaguuguucauuucuccgggugggcucgcuggcuucaagagugaagcugcagaccuucgcagcgaguguuacagcucauaaaagcaguguggacccaaagagugagcaguggcucauuugcaaagagcgaaagaacaaagcuccaaaguauggaaggggacgugagccaguugccacugcgggcucagggcagccugccuuuauucuguuaucugacccuacccacauccugcugauugguagagcccaguggucuguuuugucagggcacugauuggugcguuuacaaucccugagcuagacauaaaggugcuccaaggccccaccacaggagcuagauacagaguguccauuggugcauucacaaacccugagcuagacacagggugcugauugguguguuuacaaacuuugagcuagauacggagugccaauugguguauuuacaaucccugagcuagacacaaagguucuccacguccccaccagacucaggagcccagcuggcuucacccaguggaucccgcaccgaggcugcagguggagcugccugccagucccgcgccgugugcccucacuccucagcccuuggguggucgaugggacugggcgccguggagcagggggcagugcuccucggggaggcucgggcugcacaggagcccacggagggggugggaggcucaggcauggcgggcugcaggucccgaggccugcccugcgccaaggcagcugaggcccggcgagaaaucgagcgcagcgucggugggcuggcacugcugggggacccaguacacccuccgcagccucuggcccgggugcuaagccccucauugcccggggcggcagggccggccggcugcuccgagugcgggguccgccgagcccacgcccacccggaacucacgcuggcccgcaagcaccgcgcgcagccccgguucccgcccgcgccucucccuccauaccuacccgcaagcugagggagccggcuccggccuuggccagcccagaaaggggcucccacagugcagcggugggcugaagggcuccucaagugccgccaaagugggagcccaggcagaggcggcgccgagagcgagcgagggcugugacgacugccagcacgcugucaccucucaccaugaccacugcaaacacagucgcugcccuuguuguguuuccagucaguugaggaagcgagauagugaacaaguuccagaaaugaaugaaaaaauucuaaggccaugggugagucacugaauuucucugggcuucaauuuccuucccuguaagaugagauauaaaauguuuaacucaagggcuguuaugagaguaaaugugcuaacgugguuuauucgcauuuggcggggcuuguggagaugcauucaguaccaggagaguuaauaaaugaggacagaguggucaaguuauaagaacaugaaggcagggugaaugaaucuucaaacagcagaaugguggcccccaagaguugcaagcagugggcugcaaauucaguuccugauuccaagcuaucaaagaaagaaggaaagaugaucagucugauggcauugcuucuggcuuugaauuuuucaacagcuuccuguggcucuuagauaaaaucccagccccuuccucugucucacacccuccucuccucuugccagcucuucaguuccacagcacggagaaaccaaauuucucccuuucuggggccagcugugugcugucucauucuucauucccagcucugcucaccaaccccuuccucugugacucuucuccgcccugggucagucgccggaggcuuccucgcgcgcuccccuugccugccuguaaaugugggccugucuucugucuagucaccaccccaucccucucagggugcuuaacaccgaguagguguucgggaaaugucaguagagugagcggaucugcugagaguacacaguuuuccccauccugagaucuccgugucaggauccccccgcaucuucagaaacagagagccacgugacguuguggacacaccgcuuggcccagggccugucugcucagauugcaaaaauggugaucuaagaggaccgaaggaggcugguggagaaacaauuugagaugaugagaccugaagugggaguuuacugaaagcagggagggaaaggagaagggggaaacagugaguuuuaagguaguuuacacaaaacuugcaaaggacgcauuaggaagccugcuuucuaugaccaccgccuguaagguacaucuguaaaaguuagugagguuuuuggaaguaaacaaaaggucagccccagaaaagaaagccgaggacaguacaaacccauagagucaggggacacauuuuaaggcaaagaucacaaaggugaagggccaguaacuagucaugaauuauccacaguguagacagguaacaggaaaucagaaguucacaugguaaaagcuuuucagacauguugagcugggaggaugguauauaugguaaaccucaagguaaaauaucgccagaaccuugaaaagucauagcaaccacuccacacagcauuucacaacuagacagugcuccaaagauuuuuauuuccucucucucucccucccuccccuccccccucccucucucucucuccccccuucccuccccuucccuucccuccccccucccucucucucucucucucucucucucucucucucugucucucucucccccucacuguuacucugccacacuggagagagcugcuucaaaacaguagaacauguccuuuucagacaucuuccacaguaacgauuccagaaucuucacaccauacugcuugcugaauuacauuggauucaaaggauuggagauguguaguuuucagauguagggaagacaugcuaaguuuaaugacauaggucagcauuucaggugguuuaaaaagaauuauuggccggccgcaguggcucacaccuguaaucucagcacuuugggaggcugaggaggguggaucacuugaggccaggaguuugagaccagccuggccaacacggugaaacccuaucucuacuaaaaauauaagaaauuagcugggcuuggugacacgugcuuguaaucccagcuauucugaaggcagaagcaggagaauugcuugaacccuggaggcggagguugcagugauccaugaucaugccacuacacucuagccugggcaacagagcaagacuccgucucaaaaaaaaaauuacccacgcacacaaaaauuaccacuuguaaaaauauuuacuugccaauuaaaaaaugauccagagccuuaggaucugaaaaaaaaccuuagggcuuuaagacaauacuguuuuccaugugagccaucacagugagaugacuuccaggaaaauccucaggccccaugggcuguguucauaaaagugugugauggugccuuccuccauuggaguauuguucuguugugggcccugugucuucuauaggacauggauaaacucagaaugcuuucgggggaaagcgaucaugcuuucaggaaggagaagacccucaaaguuaugagaugugggaaaaaacggaagcaagauuccauucaugccaccauccaccuucccacccaaaccggaaacuugcuacuaauuguagacucuuguacuuuacucagucccucugggauccaagaaccgcucuccauucccuaggguucccagcugaguucuggugccugcugugucucccguggcuuccucugggauggcucaccuccacccaucuuccacacagcucucagagggagcuuucuaagaugcacuucuguguguguccccucuguuaaaauccuuaaugaauacucaugcguuccccaucugacccaagccuuucaugaucugacccacacucacugugacagccuccuccuagguccccauucacaggcacccuggguucuggccaggccauacgcccagcagguuccucaccaggccaagugccuucuccucuccaugcuucugcaccugcagggugcgcuaggacagaaauucagcuucaagacugcaaggacagaaacucacacucaaacaaaaagagaaacgaucaacaugaauacaguaguauaugcccaacuagaagguaacccucagugaaaaacaugucccaguaaaauuucugccccaccccaauuuuuuccuaaguugaauauguaugcuuauugggauagggaggagauggcagaauaguuucaacucugcagccucucagucuccugaauucagaggcaagagacaguuuuugucacuaguggaagauccccagggaagacucugaggggcuguggccagggaauaggagcauauucugauuugcuacccuguaccagagaaggacggcacuguucugagauccuacuaggaccacguggagggagggaagcagggaaggcagcucuucaaaggaaaggaugcuuggagacagaacacuggacuucuuucuugcgagccuuccccaaccuccccaggagucaagcgcuuccuccugggugcuuccggaagucgucauuaauaccucucuuccagcaugaguuauggcaccacugugguuuuucugaugaugugccuucucauccauccaauucaaguucccagcaggcagugauuuugucugucugcccuccauauccacccuccacccuuuccccacugcucucccauguggauggcacccugguguccugugcccucuggcuucugggggcauuuggccaaugcggcucaccaucagcaggagaugagagcugagcucuuggucucucuggcagcuucccuacaggguuccugugagcugguggccuccugacuaaaggcgacagccucucugucaggaagucccccacauagcuucagguucuggaagcagcucccuucccucagccuugcccaccuuguucugcuguucguggcccuggagucugcacuaucuccuuaggguucccuauacucugcccacacugaaucaauauguccuuuauuaaacucuucuccuacgacccaaucggggugugcccuccaccacccugguuccugccuggacuguggcacacaguguccuguucaucuucauugccccaggauccagcucagugccuuccacaccacagguacugaauaagcucauggauuauggaaugauuaaacaucagcucgauauggcaguauugagaccuauauagaaaauggaucagaguagccgccuucaaaauuuuuuugaccaggucucauaguaagaaauauuucauaaugcaaugcaguaaacacaucauaaucauauauaacugaacaagaaauuucaugaaggaagacugaguuuucuaugugcaaugcccuguggucuuuucuauuucauucugcucuauuucaauuuucaaaugaaauucuuauuaugguccgcugcauuguuuucacagcaugugaaaugauagcaacccacagguuaggaagcacgagccuagugauguuuagcuuucccucuagguuggagaaucugugauugcugaaguagaauucgcaggcacaaugaaugaggaugcaguaaugucgcagugacgaugcauuuagugggaguugacuuuauugccuugaaaaagcaaaggagggcaggcgagggggcucaugccuguagucucagcacuuugagaggcugaggcaggcagaucacuugaggucaggaguucaagaccagucuggccaacauggcaaaaccccaucacugccaaaaauacaaaaaaauuagccaagugugguggcacgcgccuguagccccagcuauucaggaagcugaggcaggaaaaucacuugaacuugggaggcggagguugcagugaaccaaaauugcgccacugcacuccagccugggcaacagagcaagacuccaucuaaaaaaaaaaaaaaaaaaaaaaagaagcaaaggaacuugccauucuaucuucaguuuuucauagaacucuuacucaaaguugucuuuguuuuagguaaaccuaauuugggagcgaggagguggggagauuggaguccuucuuuuuuuuuucuaagacagggucucacucuguugccuaggcuggaguacaguggugagauuucagcucacugcaaucuccaccucccggguuuaagcaauucuccugccucagucucccaaguagcugggauuacagguacccaccaccacgcccugcuaauuuuuuguauuuuuaguagagaauggguuucaccauguuggccaggcuagucucgaacuccuggucucaagugauccacccgcauugacuucccaaagugcugggauuacaggcaugagccaccacgcccggcccuggaguucauaaugcaugccaauguccaugagcaauuuuaagcaucagguucauaagcauuagugucuaggaaccacagacccugagagccagccgcgcccauaaggguucaggaugagccugaaguggaggcuaaucaggugagcuugccucaggccuccuggagcacuucccuguguccuugcuggcaccagcagcuucucuuuagcaaacacauuucuuagugcccugguuaugugcaggguuagacugaaugcacaacacaggcccauccgcaucgccaggucucugugacccacuugcgguuggauauucucucaaugcuucaaacucagccgaagucugugaucuuguccaccucaaaaaucguaugauucuauuuuaaaaacugaguuacguauguucgcuaaaauggaaucuccccucuuaauucauucccugucauucuucugauaucuaaaccguaaggucaaguuaaaaggguagaagaugaucauagauauauagcugugauucugagucaaauucccaaacccugucaucaccucccugcaagguucuugagagagaaaaaugcaaaaaagguaaggcucaguaggugggcuuguggccaggugggggcacugggcucaaauuuccaaggggagcccuggcaagcugggcagacacucccauuuccuuguuuccucaucauccuucaaauucauaugagcaccuacaaucuuucaagcauaggggagagaacagugaacaaaacagagccccugugcuccugaagcuuauauucuaguuggggaaacagaaaauaaauaaauaaagauauauauaccagcauaggagauggugguuagugcugugcagaaaucugcuacggcacguggugggcagaaugugugugugugugagcgugcgcacgugcauguacaugcuuuacuauaguuaguggugucagugagggcuuuuugaggagugacauuugaagaaagagcugagugaauuugagucauggaaauauugaggggaaaagcaucgggugaaaggaagagcaugugcaaaggcccuuuggucucacgccgggggguggaggcaggcuucgggccuuaucauagaggucugggcagcgucauuucucucccccucaacgcuugccaaacccuggccacuuuuuggacacauacccaacaauuuuuuaaauuauuauuuuuaauuguggugaaaugcacauaaauuuaacaucuuagccauguuuaaguguacaauuuggcggcauuaaauauauuuauuauugugcaaccgucaucauuuccggaauguucuuauaaucccaaaccagaacucugugcccaggaaacaccagcuccccguuccuuccuccccugagcugcuggcagccacuguuuccuuucugucucuauaaaugggaccacuccagguaccucacacaaguggaaucacacaguaucugucuuuuugugaguggcuuauuucgcuuaagcauaauguucuccagguucauccaugugggggcaugugucagaauguccuucuuuuucauugacgaauaguguuccaugguguggaugugccacguuuaguuuacccguucauccucuacgguugguggacaccuggguugcuucugccccuuggcuauaguggauaaugccucuaugaacauggcuguacaagaaucucuccaagucccucuuucaguucuuuuggggacauuccuagaaguagauagacaguuuuagcucccuuuuccuugaguugauccacugugcuuugcacgcugccccuuguuaguuuaugucacuguuagggagagcguguugaucggcucaccuguuucccuccucucagcuguaaguuccuggggaauagggaguggugcuuggcacugcacccccugaugccauggaaggcgcacagucugugccccagcaggauuuauucagugagcaagucuggaaagggcugcuccagaaggagggugaaggcugggcugcacagagccugcaccuucuuuguauuuuuacauugggcuucucugacugccccuaaaauaaaaauggggauaauccauuuuccugugagagaaaugaaaacccacgaagacuaaauguccugcccgcuguccaggugcagugaggggcguggccgggaccagaaucccugcuucccuguucucuagucagugcugcugcuggaaaccagagucuucuuuuguuuucccucucaccucuggcugccucucucuccccucaaaggucagagcagugccaaggacagaagagagaguagauccagccuuggcccugcuaggcugggcagccuggcagguagagucagcagggauagagcuugcuuuccuguucacgaucuucagccaaguucagggaggucugaauacugaggccuucauagccacugcaccccagguagcucaggagaaccuccgagcgcaggagugcaaaggcuggcauucuucaggcucugaggcugucccuuccgguggaggugaacugcuucuuauugauguggacaagacuguggguaugugucugaguguguggaggugauauagagaggccuaaggggugugugugugugugugugugugugugugugugugugucagggggugaguguguguaugagagaggcagaggcagcgggagagaaagagagcgcaaugcagagaagaaagcagaaccuuccucauagaguuuuggggguuacgugaucugaaaagcacuugaaacaguaccuugcucacagcaauggcugcguugaugauuuuuauuguuauagaggcacagacacagagaaaggcagagagggagaggggagaguggggaaggaaggugggaggcggcaggagcgaggaagaacuacauucuggaaaccucagagauuuaacaaaaggguggaaucugggaaaagcuccccugccugcuuguucucuuauaaagcugauuaugcuuaccuuccucccccaugguauuuuaaacuuaaauaacacagucuccauuguguaaagcaaaauaauuuuccagauucccuguguaccucagugcaccaugcuuagggaaucugcccggcaacacagacagacugugggaguaugccgcggaggcugcgucccccgcuugcugguuagggugcuccugugugcccagccuuccaggucuggccuccccccagccccccagccagcccccaacacaaaucauuugggcuuuaucuuaucuuuagcaggagaaugcuucccagauguguaggauuaauggugaauauuacacagcacccccuggacagagauggguccugggugacuccaggcccuaaaaaccuuucuccagcguggacuagcggggagcuccaguccccaccugagaguugaaggagcauccccucccugcuuugcgauggcuccagagacaagacgugugcccugcccccaccccacauugucuacuuugauuuacagcacagccaucacagggggaccuuuuugguuaacauuuacaaaagugcuuucugucugguuucuagauggagacugacaggauccuggcuugggggccuuccggcagggcuggcugcugggcuggcaggcucuggcgcuccccuuccccagaacugacuuuguuccuggcagccaugguggcugcacuaaccacauucugccuccaccuuugcacuaagaaaagcaaauaagcagaccacagaacuguuugcauuugccccagaugcucccuggcugcgggaagaggucaguagggagcaugcagggagaggggaagggagaccagcuucugcagggagggcacgcuggaaucuaggcuuggggagggacgaagggaaggcuuguccagcccagcacaagccugcggaggggcacugugggcacagugcaugaagucugaagaggugaugugcuagauaccccaaucccuggcauauucugcauuucaaaacagagaauaaguagucuugccacuauaaaguggcaagagcuguuccuuagcaagagaaagagaaacagagacagagagaaacagacacagagagacagagacggagacagaaaaauacacagagaaauggagagacagagagagagacauacagagagacaaaggcguaaagaggccccccgcacccuagggauauguugucaaggguggcuuuuuuguuaugaagauugcagccuauuuugcacggcuggccggccuggggcuccugccgucauugcugccccagggaaggcugcucgcuggcuuacucccauccccuugccacuggcagcaaaaccaagcuggguuaugacaucagcgacuuuuccccuucucagccccaggguagaugggccagguuggaaagcagcaggaaacuuuuccaacacuaacaaacaaugagcucagguagcaagcccugauauuagaaaacgggagggacccuuagggguuucacucagccugaaagggagccaugucuuucccagagccaagucccagucccuuuucagggcagccagccaagcugggagauugggagcuggaaagauguccccugaaauacagguuuggugacucuaaccgugaauggccccgauucacaggggaggguugcuguuccuuugccauccuuugccuauuugcagcacuugcugaaagauagaaagaaacaccgagacaggagcuugggcuguauag

SEQ ID NO: 17672 - RNA, 10605 nt, Homo sapiens
gguuuaugguguguuuuuuguuguuguuguuguuguuuuccaugaaacagcacagcaaauccaucguuagaggccggccaucccaccagcagggaugauuuugugagugagucaugcugaggaggcgcugugugagguggggcugcgguuuauaaugaaguccugccugggacuguacugaggagacagcccagugugucccagcacagagcccauuucucaaagcggucaucgucugauucauuuucucaugcugggggaugugcucuggguuuuaaugccuuuaguuuccaucaaugguagcuuuguuaguguuaacugaaaggaagacaaauuuguuugaaaucaaggucuuguggaugccucaguguguacccuucucugugcagaaaauggcuguaaucuugagauugaagaguugaaugaaguugucuucuuuauggaaaggcauuucagcaacuguaauuaauggucacaaaagucaucaaaaguuuuaacaaucccaacaaucccaguuuccccuuugcgaaucauuuuagguuuuuauauaaagaucgcugaugccccuauuaaggcucuuacugcuguaaaagucagguaggugagacuccagcuuggccuucauuuguccuuuuguuuacguaaagcauccaguuacucuuacaccuugacauggcuuaagcaggucugacgggaaacagccuuguuucagcugauaaucuccauggaauggacagacuucccacugcagaauugaggcagauaaaaggaaaaagaagugcucucacagcaagacagcaauaccuucauauaccugcacacacacacacacacacacacacacacacacacacacacacgccauuugggugcagaguaaauaccuauuugacauaucuuuucugaaauacagauuuugaaaccacacaaaccugguuuugaucccucucuaccacuuguuagcaugugagccuggauaaguugauuaaccuuucugaccuuugguuuacuuguuuauaaaaugaggaaaauuaaaguaccaaaccacaguauuguugaaacaucaaaggaaauaauauacauaaagcauuuagcacagugccuggaauauuccaaguuguccaauaaaugauugauaaucauaacaauaacaauaauagaauuuuccucuuuccugacagagagaccucucagcuccuuggcgcucuauaggaagucaggguugauucuguuugugguuuaccauuuaggauucacuaugaggcagaaguacaauguaaguuacaagcuauuauuauuacaaauaagaauuccuggagcagagacaauaugcaguggucugaguuugaagggaccugcgauuuuacuuucucaucucaaaaacaaggauauggaggcccagaaacccugagugcugaccaaguuuccagcuacuuauucuuagaguuaagaccagaaacuaguuaucaugagucuuggucuugggauguuuucacuuauccauucuacauuuggcaagccuuuaaguaagccaguuauuucagaaguugggcauaagaaaaggugcccauggaccgggugcgguggcucacgccuguaaucccagcacuuugggaggccaaggcagcagaucacuuaaagucgggaguuugagaccagccuggccaacauggugaaaccccaucucuacuaaacacacaaaaauuagcuagaugugguagugggcacguguaauucuagcuacuugggaggcugaggcaggagaaucgcuugaacccaggagacagagguuguggugagccgagaucgugccacggcacuccauccaggcaacagagggagacuccgccucaaaaaaaaaaaaaagaaagaaagaaagaaaagaaaaggagcccauggucuuugcugcuaugauggcaagaagugcugggagcuaacaucaaagggggagagguguuuggaugcuuagagagccagccuccgcacguuucucauccuccauugaaugcagcucauaccuaagcagcacaaauccaagagaagcaaagcagccugcaguguggacagaaggacugaaccaaaaaguccacacugagagcucagcuuccggcuuucuuccuugcugagacccuccccugccccaaaugaaauacaguuuuugccccauuaggcaaaacgucuuaauuagcaagggaccgaucguuucauaaucuuuaaaaagaacccacaguucucaaacacccccucacauggaugcacgugagguauaagacagcaacccaaugucuguuacuauggaacucaaugguguaaaauuaacucacuaaagcacacacccacugcaaaaaaaaaaaaaaaaaaacaacaaaaaacagccuuugccagcuaggugcuucagaaggugauauaguuuagaugugugucucccuccaaguuucauacugaaauguaauuccaaauguuggagguggggccuaguaggagguguucgggucaugggggcagauccaucaugaauggcuuggugccauccccuuggugauaagugaguucucuauuaguucaugucagaguugguuguuuaaagugcuugacaucuccuccucuucucucuugcucccuccuucgccaugugacaugcccgcucccccuucaccuucugccaugaguaaaagcucccugagaccucaccagaagccaagcagauuggggugccaugcuuguacagccugcagaaccauaagccaaauaagccucuuuucuuuauaaauugcccagucucagguauuucuuuauaguaaugcaaaagggacugauagagaaggcauugaugucacgcuacauauaaaauuugcauucugagagucgccucccacucaaacguaagcuccauguguucagggauuugccauaggucuguucacugcugcacagccagugccuagaacagcaccuagacagagcagccaauaaauauuuauugaaccaauaaaugaaucauacaugaaccaaguaugaacaguggaggcugugaacugucucaugugugaguuauuuaccaucucuuugcugaguuuccucauccugaaaaggcuauauuaauaggauugucguaagaauuguugguuuguguaaaugucuuuaaagcagugcuaguuaauguuaccuauuuugggcuccauagagauugugcuuuuucuauguccucacagaggauuggcagauagauauucagcgauguaacauauauaccugaaaauuauuucacucaaauaaucauguuagaaaaguccugaaagaggccaggcacgguggcucaugccuguaaucccagcacuuugggaggccaagguggguggauugccugaggucaggaguucgaggccagccuuggcaacauggugaaaccccaucucuacuaaaauacaaaaaauuagccaugcauggcagcaugcgccuauagucccagcuacuugggaggcugaggcaggagaauuccuugaaccugggaggcagagguugcagugagccgagaucacgccacugcucuccagccagagcgugauuccaucuccaaaaaaaaaaaaaaaaaaaguccugaaaggauuuuuggugguugguuguugcuugguuugacuuguuuucuuaaaaggccagauguguauaaggugcuugguuuuauuaucacgguuuuauaugaaguguucagacucauccgugauaccaaaagagccacauuauauuuggacacuuucccugguugaucuccuuccuacaagaauggaacauguaacguccuagacacccugaugauucuguaguaucaagccccuucuuggaagaaggccuccaagagguuuccagguggugagccaggccaaccucuucaggcggugaaucacaccaucccuaaagcucauaccggcucacagauaaggccucucaccuagaccccuccaaaagcuucagcucaaugaaaaacaaaguacauauggucuagcuuuaaucaaaaacugagcaaacaaucaaaacaacaacuagcaaaaugugugaauaccuguuucuaagguaucagaaacaacuuacagacauggauucaccaagucuuauaaaauaggauguaagggcacauagccucauauuuauuuuaccaaagagaacagaaaaagucauuaagaaccagcaauggaauccauucucucucuccuggaugcacuguuuaaguaacugcacacccaccuaaaguucucuauuaaaaaccaauacauugagaaaacagucauucucauauucuacugcugaaucuggcuugggacauugcauuuguaauaaaaaauauuugcauauagagaagagcugcagaaauagcauggauuuuggaaucugaaagaugaagucaaauuccagccgcaugaccuucaacaaguuacuuauguaaucugaacacaacuuuguucuguaaaaugugggcaaggauagcaacccagcaaugcugguauaaaaauuauggauacuaucuguaagcuuccaguagauugccucauuuauaaaugauacuuaguaaaggaugaugaugauaaugcuggccuucccuauucaaaaagcacauucucagcuggccacaguggcucacaccuguaaucccagaacuuugagaggccuagguagaagaauugcuugagcccagcaguucaagaccagccuggguaacacagugagaucccuucucuacaaaaagaaauuauuuuuaaauuagcuggacguggugaugcaagccugcagucccagcuacucaggaggcugagacagaaggaucacuugagcccaggaggucgagacugcagugggccaugaucaugccacugcacuccagccugggugacagagcaagaacuuguuucaauaaauaaauaaauguaaacaaaacaaaacaaaacaaaaauucucaggaugaacgaacacuuugucuuuccccccaguaauguuauacuuacgaaaacaucaggugcuaagauuuaauagcuuauuaggucaauuuuuucgggggauccauuugcagaaauuagauuugcuguauugauuugacaacuuugcauaaucccaacugaacauucccagcuaaaacaggguuuuucuuuccgguuaacuuuaagacucucucucuuucuuacuccagaaauucauuucucauuugguuugggacagagccagcugguaaaagguuucagcauguguuuauugccucuuuguucucaagcauuuucuggggccuccuggcagcucuggucuggagaaagcagcaaaacccucugggguugcaaagcccagacaaaucccaggcucugaccauggccuagggguggugaagaacagcuagaagccuccccucccaccccaaacuccugcucagaacucucaguaaacacagggcaggagcccagcauuuggccccaggggcuuccuccuacugguguuguuuuggagucagcugugcugccucuugucaggcccuacccaggaccuuuccccuugauacuugccuggucuccaacaagcaauuguuuggggaaauguguguguguguguauguguguguguguguguguguagcccaucaaaacugucuucaacaaugacacugcugcuuguagacauuacagauacccuuguccugggagguccuugggugucuuuccaaauagauugccugaacacucaaccccgguccaugccuccaagccugaacccauuuaggagucuuacucuaagccuggaggugaaaacaaggcuuagccccagcagagucaccacugcccagccuucuccaccugccaucuccauaccacuuauggugugccaugguggaugcauuaaagggcaguacaacucaacagucaauagcaccacuguagccuucaguugaccaagagccauaucuagcuuugccauuuuggggagccuguguacaaauauuuauuacuauaaauauggccgggcgcgguggcucaugccuguaaucccagcacuuugggaggccgagguggguggaucagaaggucaggagaucgagaccauccuggcuaacacggugaaaccccaucuccacuaaaaaauacaaaaaauaaauaaauaaauacgaugucccaggccagauccauauucagcaguaggauucaggagcucuaugacauaccugagccaaguucauuaucucacuuucccucaguuccucaaauguaaaggaaggagaguagcaccuauuucacagugcuguugugacaguucaaugagaugguggcugggaagggcugguacauguugauagucaauacaguacaaucugaacauaaaauuccagccaccugagcucuccucaagcacacucagcagcuucggguuugcuugagugaacuccuugcaacccucucaagaggcuaagcaugagagugaauugauccagguuucucugggaguuguuaugccacuggugcuuuuucccagcuuugggaauggcgggauugagugauggaauaaugaauccaacaaacauuuuuggugucaggcacuuuugaggcacaagucuacagagaggaaaaggcccaggucacuauccucaggcugugcacauaggacagggagagauggagacacccgaucagauauuggcaauucucaggguggugaacucuguggggcuaugaugaagacauugggaaguggcuaaggcaucaacaaaggcucccuacaugggguguccucugacaagggucucgaauaggggcuuacccagaggagaaaaugaggaagggaauugcaggcagagagaauaagcaaaggcacaaaaacagcaaagaaaaugcccuauuuggagaaugauauaauaaauaguucaugugguuggaaugggaagaaauucaucuggaaaaauuggacuguuagggacaucuauucugcuacagugacaguuuggccuaggccacucacugagacaccaaaaugagacaaucagccuggcucugucacccacccucaagguccccccacccccagccacugagggaggagaacaauaauugucuuaacaugauuuaagugguucucucagcucuuguucuguuguauaaacaaaugucuucuuuuuuauauuuuuuauuuuuucaagauggagucucgcccugucauggaggcuggagcacaguagugagaucauagcugacugcaaccucugcuuccuggguucaagugauccuuccaccucagccucucaaguagcugggacuacaggugcauaccaccaugcccagcauguguguguguaucuguguguguguguguguauguguguguguguguagagagagagauggagucucaccauguugccaaggccggucuugagcuccaguccucaagcaauccucugccuuggccucccaaacugcugggauuacuugugugagccaccaugcucaacacaaaugucuucuuaaacuucaguuucuucaucagaaaauagguuugggguagguucuuucuuuagaggaagaaugucaugcaaagcucaguuucucaucacccacugauggaaauuauuugggggcauuauuugaauaaagcaguuguuuaacauacccuucaagaagaucaugcaaagcaacuuucuggaaaucaguuccacacaugguaauaaacaucuugaauaaaucucuucucaucuccucauggcccaacuugauuucucccugucgccucugcucccaccugcagagugaugagcuaucaaaccuaacuauugcuuccacuucugauuccuccaaggagggggucuuacauuucagcacagaaggaggaaacauuaacacaggugaaaguacuuaagcuccucccagccauccucccucauccuuugcccugacaaagaaauacagcuaaaaucuaugagggccuucagugaugagcugauagaucuauuaaauaaucugacccaucaccuagaguggucugacacaaguuccuuucccauucugguccuagaaagauauuuucucuauuccaucagcagugaaauuaucuccguguucgaucugaucacagcaucuuuggaaaucacagccaggcuuccugaggccauugccaggccauguuuccuacacaaacugccugaaaauugaccaucagagagucuucagggcauuaagccaucggaauauugacaauuccacucuucaccgaaggaaacugagccacaguaaggauauggggacgcucuggacccagagaaauuccucacuggaaaagaaaaaaacauucaauguccuuacuuauggccuaagauccuggaacugcuuucuccaaggcaaacucaggaaugcagcacaaagagccugcgaagaauacugguagguggcuggggugguaggaagagauaaguuacaggcaaacguuuaaauacauauauauauguauauauaugcacacagagagcaaaaucccacugacccaugggaggugacuagaguuccacagugaaaacuauucccuucaccaagauaacaauaagaaacauuuucacaugagaaagugaaagcuucaagaagaaaaugccauuuuaaacccugguuuaccaaaagagguuguucuucguauuccccaaacuuucucaaaaggucucaaauauuugagugguugcuuccagacugaagagcguccuccuuguucuuaccuaauuuauuaaacacccacucugcucugagaacucagcaucacacaaugacacagagucuuuguaaaauggagucagccugcccagaaagggaaaauacaauuaaaagaucuaacuacacuaucgaaagaacaauggugcauccgguuugcuuuccuccauugaauuuaccuugacuuugaugucagcuggcccagcccuagacucauuucuuaguaaaaugcacauacccagaacuuggagagagguugguggaaauuuaaaaaaaacaacccugagauccaugucugggccaacugggggaaaacagggacugaacucacaggcagcccaaauggaacugcaugcuggaguggcuaugagaacacaaaccuccuucuucuaugaagacauucuggagacagcuuuaagagcaccaagaaauaaagacuugagcucauuuuaucugguucuuaaggaguaggaaacccccggggugauauuugggugguaguagaaaauuuuguauuucaggaaaguuuuuauauuucaauaaccaugaccucauuuucucuuccccaaagccuuaacuugcucccagagaaagacuauuacuguuauuccacaggugguccugggaaaugaagacagaauggucagguggaaggaagaaucccgucaggcuuuuaggaacucaauccugcgccucucacuaccaucccgccucucuggauuaccuuuuccaacauauagggcuaagcuauggacuacagcccauccuccuacuuccugaaguucagagcgugaucugaggcagacacuuggcugaccccuauacgauggguuccaacuccuucuacuccauugcugccuacuacagaggccugaguuuaauggugcauuuucccuugcagcuaagcaagguguagucaccuaacagcaauaauuuaagcacauucuuggaaugaccccauuuggcagaugcaucugaauguguguuuugugcuagggaaucugggaguggccaacccagagauucauuccuugucuaugauaaacuucugagcccucggccugucccguggaacaugggccaugcaggugauugagguccugcauuuugggcuaagugaagguuaccagguggaggucauuggugggaggguguuaacugaaaaugccaugugaaccauaugcuguuugcaagugguugcaguuuuccugcccagacugccaccacugggcugugcaguuaugcuguccaguccacugccacuggacucuuccaauacggaaggugguucuccccuccagccugcugccacuggauucccuccccuguaugugagcccuuaaucaaacccuaugucucgucugcuggcucuaggucucuucuucggccuucuugaaacuggugccuucccuauugagguuaacagggguucagcacaacgcaagggcaguguaccccauucuggaauauaagcagaagacuccugugugcagcuuccagaaugaauuuucccuucuugaggaaaaaggacaguguuggcuggccugacucuaccacucccgcuucuuccugccuucaacaugccacuugguccacagcgauuguacaacugagacagaaugcaaauuugggucuugccuacuccaaaggccaugcuccuaaccaccauguccuauugccuccuuucaaucauuucauuggcccacaaaugacagccagcagaaagaaaccaauacaugaggcagugaggaauagagaaaagugcccuggaccaggcaccugaagauuuaucugagcucagcucaggugcucgcucuauacuagcuguguggccuugggucagucaauuaaccucugagucucauuuccugccuuugugauagcuagccug

SEQ ID NO: 17673 - RNA, 12750 nt, Homo sapiens
agaccggaaacgcggacuucagcucgcuugggaaacggcuuccauuagcagaagggagacugcgguuuagucccgaggucgcuccagcagcccggccucacgcgacccaccauucccgccgcccccucacggugcccgccguucccgccgcccggcuuucuaaccgggccccuaguuccccgccccgugcccucuggagaccugcagcuccugccgcccugcgcccgcucccagggcccgucguuccgccgcccuaucccuccucaaggggccccuagcugccuccucgcgacccuuuccggacucggccugcccacuccugcccgcuaacccgccuggcucccgggcgagagcccucgcgcggcucugguuccuguuccucuaacgccgccggggcugcgggaugccgacuccgcggaccgcccagacccggaacugcugaggcagcagcgggcucgcggcgcuuggcucaucccgggauuccccagcucucgcgcugggcccgccgcguucgcaccaagcacgccaggcggcccuggccuaccucccucccgccucccggcagcuggcacgagggaaccuggccgucagguuuccccugggauccugggacgguaucaggcggggaaucugugcggccgcggcgagguaggugaggugaggcggggcgaggugggcgaggggggcgaggugaggcggggcgaggcggggcgaggcgaggcggggcgaggugggcgaggugggcgaggugaggcggggcgggugucgucgcgcugggccgagcuuacgacuccagcugacccgcucgcggcugcccaauuucguugaggcucaggacgagggacggggcggcaaauugucacagaggucgccguagaccggugugcaaccgaaggugaagagcgggaaggcgaggaccgaaucgccucuggugugcguuguccgacaggaagucccgaaugggcugugagccgccgguggaggugcccgggcaggugcagagccacagccugcgccccgugagccgaggcggguaggaggaacagggaccuggcggcgacacacguugggcggaaauucacaaugaacagggaaggggggacggucacccacucaaaacuggcuaaaugaaccucagagggagccccgagagauggggagcaaagguuaggggaagcggcaggagaaaaccuucuuggggcaaagggcgucaccaaagggggucaccggagccccgcagguuggggugggagggcugggcuggaggugagcaaagcugcacggggagaaugaauuaagaaaguugagaggaagccugucucauccaaaucacuauagcuuuuguggucauugcuaaguguggaguacugcgcaaauccugaagggaacucuauuagccaucucagcuuuuaucaucuuaaaacgcgaauuucgcgugcagcuccauuuagcuucguaaacuuaagcccccgcauaugaaaggaugagaccuaauaugacaaucaugucaggacuaaugauauaucacacagguugacacucugcaauuuaaaaacaggacuuugucuaaacuccacaaguaauuccuuacucaaaaguucuguguaaacaaaacagaggaacugucgugcugcuggaaagauguaccagcauuuucacaaaacgaauuaaaagauggcuuugcuuucacugucaugguucuguugugacagaguagacuggcuuuucugggaggggccuagauuuacuauuuuaguuacauuuuaaaaucaguguaauuacuucguuuuuaaucuaccacaaauuucuguuguaacuauaagauuuauauaaucuuauauucuuacacuaauuuuuauuugcaggugauuuauuuggcauaaaaguauucuuucaaggauggcagaagcuguuuugauugaucuuuuugguuugaaauugaacucucaaaaaaacugccaucagacauuacugaagacuuugaaugcuguccaauaccaccaugcugccaaggccaaguuucucuguauaauguguugcaguaacaucagcuaugaaagggauggagaacaagauaauugugaaauagaaacaagcaauggauuaucagcucucuuggaagaauuugagauuguuagcugucccagcauggcugccacuuuguauaccauuaaacagaaaauugaugaaaaaaaucugagcagcauuaagguaauuguacccaggcacaggaagacauuaaugaaagcuuuuauugaucaacucuucacugauguuuacaauuuugaauuugaagauuugcaagugacuuuuaggggagggcuuuuuaaacaguccauugaaauaaacguaaucacagcucaagaacuaagaggaauucagaaugaaauagaaacauuuuugagaagucugccagcacugagaggaaaauuaacuauuaucacuucuucuuugaucccagguauauuaaccacuaacuguuguuuuuacuuuguacauggaaaacuagucuuucuucagagguaguucaccucuuuuuuuccuccuuucuuuuguugacuguugugggcugauuacucauuagcaucaguggcaacacagaggugucauguuuggcccuguaguaucaggggugucaagggauaaagccuucaaagccaccccaaauaaauaaauuugcuuuacaaaaauuugaugaugagacaaauaaucuagcccuccuuugcaaugagauuuaugacacugaaaaucuucuauuuagaaauucugaaauuucaaaucauuggcaccuucauagaagaguaaaauuuaaaacaaucaaucuuacuucuugguuaaacaguauuuucugugagcuauaugcuauuagauauaacaaagccagaugagacacaauauaccuuuugaagagcaacaaucucauagggaguguaaaacaaacacaaagcagaaugccauaagaacauauggagguacaaaaugccauagaaauuagaagccaaauaacaagggcagguagcagugaucagggaaggucuaauugagagacugguauuuugaauagcaucuuuuaaaucuucacugcuuaucuucaacagauauuuucauacauggauuuacuacaagaacaggugggauaucuuauauaccaacucuuagcucauucaaucucuucaguaguuccaaacggagagaucccaagguagugguucaagaaaaucugcguagguuggcgaaugcugcaggauuuaauguggagaaauuuuaccgaauaaagguaaaauuuugcuuuauauuuugaaagaucuaaaguauauuuuuuacuuugcuaguaacuacauggacuuuaagcuauuuaacuuuuguaucugcuuuuuuaucuaaaguuuuagaauaaugcugugguugucuuucuuagauuuauacaccauagccuaaagauaaguucuauuuuauacacacacacacacacgugcagauauauauauauauauauauaugcacacacacauauaguaagucauccuuuaauguugauagguucuuagaaauugugacuuuaagugaaacgacauaauaaaaccaauuuuaccauaggcuaauugauauaaauaagaauaaaguuucuaaggcauauuucuugucacaaaaacaucaccaaacuucuaaauaaagaccaacacauuccuaguauuaaacauugaaauaaaugugagcuagacauauauuuacaaaacaguaagaaagacaaauaagauaacuaccaaauuauuucgguucagggcuuuagguagcuggagucuauucuggcagaucaggaugcaaggccacaacccacccucgacaggacaccauuccauugcagggugcccuuacacacacacacacguacucaugcugggaccauguagacaccccaauucaucuaacaugcacuucuuugggaugugggaggaagcuggaguacccagagaaaacccauguggacgugaggagaaggugcaaaccucacacagucagugaccggguggguaaucaauuuuuuucauuaacauuauaaugaaaugauguggaauaaaaugacauuauucaagagccuacuguauauuucaucuggaguccucaauucuaaaaguacaguuaauucucagagaguauacuaccacugcucuuuuugauuuagaagaaagggaacugaauggugguagagaaaggccauuauuuuauaaaucuacuccaggaggaacuagggucauaguugaugagauaaugucuuguuccuuacagaauucuagcuuuacuugagucuuggaaaaguaaaaguaucauugauuuguuaauuaacuuuccuuuacaagaaaaauuuucauuuuguagaaagugcuauaagaaaugauauaccuaucuuuauggaaagauguucauuauucacuauauugaauuuuauaauguuaaacucugcuuuucuuugcauaaacuaucagagauuauaaucuaaaaucuuaaauaguuaaauuauaaguaaauuuuguguuuucccauauauaaaagugauauauuuaaugaaugcuaguaaucuuaaacugguuauauaauuuuauacuacaaugaguaccuucgagaaagcuuaugguauaagaaauacuauuuccaaaacauuuuuguugcacauuuuugguauuagacucaucauuccaaugacaucuggauuaugggaagaaaggagccugacucuuaugauggaauaaccacaaaucagagaggagucacaauagcagcucuuggugcagacuguauaccgauaguuuuugcagauccagucaaaaaagcaugugggguugcucacgcugguaaguauacuuaauuaaacauuuagaauuuuacucauuuuguugugcaggaaaaauuguaauuucuuucugauggacauggcaaacaguuaauuacauuacacugugguaaguguaaugaugggagaggcggcauaguuuuauuauagggacagcuaagaggaguaucugcaucaaauuauaugaauuauaguagaauucccaaaggagguggcaccuagguugauuccugaggaauuuguugguuuuggcuggguaacaguguuccuuagcaagggugcuauuaacauuuugggcaggauaaucccacauugcagauuaagugucuuuagccccugaaauccuuaaugacaguagcaccucuaguuacuguaauaaccaagaccaaccaaccaaccaaucaaacaacaacgaaacccuccaagcuuuucaaaacacucccuaggggagugguacugccucugguugagaauccuugaaauccaggccauaggaaauaggaauguuaggcauguugcagagaaguguucacccagauggagcugcauguguaaagcuagggagguaggaaaaagcaagauguuuugaaaacuguuuuuaguuuacaucacuuaauguauuuaacuguaacuauucucugagagcaaagaaguauuuuuagaagguauauuguguuaaggauauggaauuuuguuuucugaagguauuuuaaaauaguauuuuagauuaccccauagcugugauuuugugugaaaugagggaugaucuuuaaaauuuccuucuacuuguaaaucuauggcuacuuugcuuuuuagcucauagguaaaaaagaaaguagcauauuuuuauuuugaccuagcugaaauaaugggauugaaugaguagaagucagguuuacuacaugacauugucaaaaaguuauuuaaaauuugagucuuggcuccuggauauaaaaagaggauauuauuuuuuuacuucuuagguucgaaaacauuuaguuuaaacauauccaagaucaagcagucaaaaugaaguuauaaaugugaauuucaagucauuaauaaguuaauuuugaaagaauaaaauaccuaggaauacaguuaccuuaaccaaggagauuaaaggucucuacaaugagaaguacaaaacacugcugaaagaaagcagagauaauauaaacaaauggaaaaacauuccaugcucauggauaggaagaaucaauauuguuaaaauggccacacugcccaaagcaauuuauagauucaaugcuacuccuaucaaacuaccaaugucauuuuucacagauuuagaaaaaacuauuuuaaaauucacauggaaccaaaaaagagcccaaauagccaaagcuauccuaagcaaaaagaauaaagcuggaggagucauauugccucccuucaagcuguacuccaaaguuacaguuaccaaaacagcaugguacugguaccaaaacugacacauaggccaauagaacaggauagagaaccuagaaauaaagccacacaccuacaaccaucugaucuuugacaaagucgacaauaacaagcaaugaggaaaggaaucccuguuccauaaauggugcuggcauaacuggcuagccauauguaggaaauugauacuagaucccuuccuuucaccauauacaaaaacuaacucaacauggguuaaagacuuaaacauauagccuaaaacuauuaaaacccuaggaggaaaccuaggaaaugccauucuggacauaggcauaggccuuggcaaagauuucauggugaagacuucaagagcaaacaaaaacaaaaauagucaagugggacccaauuaaacuaaggagcuucugcacagcaaaagaaacuaucaacagaguaaacagaaaaccuacagaauuggagaaaauauuugcaaacuaugcagcugaaaaggucuaacaccgagacucuauaaggaacuuaaaucaacaaacaaauaacaaucaaucccauuaaaaaaugggcaaaggacaugaacaaacgcuucucaaaagaagacuuacacguggucaacaagcauaugaaaaaacgcuugauauuacuaaucauuagagaaaugcaaaucacaacuacaaugagauaccauuucauaccagucagaauggcuguuauaaaaaaagucaaaaaacaacagauguuggugagauuguggagaaaaggaaaugcuuacacacugcuagugggaauguaaauuaguucagccacuguggaaagcaguuuguauauuucucaaagaacuuaaaauuagaacuaccauucaacccagcaaucccauuacuggguauauacccaaaggaauauaaauuauucugccauaaagacacaugcacacguauguucaucacagcacuuuucacaauaaugaagacauggaaucaacuuagaugcccaucagugguggacuggauaaagaaaauaugguacauauacauaauggaauacuauaaagccauaaaaaagaaugaaaucauauccuuacagcaacauagaugcagcuggaagccauccuaaaugaauuaaugcaggaacagaaaaucagauaccauauguauccuuuaagugggagcuacacauugaguacacauggacacaaaaaaagggacaauggacaugggggcuuacuuaaggguggugggugggaggagggugacgacugaagaacugucuguucgguacuauguccacuacuugggugaugaaaucguuuguacacgaaaccccagugacaugcaauuuacccauguaacaaaccugcauauauguaccccgaaccuaaaaaguuggaagaauaaaaauaaauuaacuuuaaaauauaauauaauuagcuacauuguauacuacuuuuaucagauaucaaaaagaauaaaauucuucuaugggacuaauuuaauaaagaucuuuuaacuagauauguauauauagauaggcauagaaaaaucaaauagaaaggagguggaugaacuacaagugagaggauaacuaaggaggcucacugaggaagagagcuacucucaucuguagaaaagcccugacaguuucucucuuuaacucaaaaugccuauaucuaguugcuucccuuugaacaucacugucugcaucuuccuaggugccugaaaaucauuaugucaaaaacucaacauuuuuuuccuaaagucuucucugccaguuagguuuccuguuuuaauuauugauauccuacccacuuacagauagaaacuugaugucuucauucuguacuucccauaaccacauauucaguggguuaccuguagaggcugaaccugucaccuaaguccuucuugcuuucaucaucuccuuuuaucuguaaaaauugaucccuucaccugagugccuaccuuuugaaggguaugaguauggagugcuuaaggaagguguaaggguacucauuauuggccaaccauaucagcugaaucaaacccagauauagggaauaaaggaaaaaugcaauauucuuagcuuucugucuuuggcaacaagaagguagcauaaguaaagaagaugguuuuaucuuagaacacuguaagaugcaaggcagauaagacaaagauggcaagggaacgauagucugggcaagugggaagggaguaaaaagaggcuguuaauugaaauauaauagauauauuuuuguaaaaagggagagaugaaaacugcaaaacauugcugaaggacauuaaagaagacacaaauaaaugcagagaaauucuguguucauggauuagaaguuagagaaacgcaaaucaaaaccacagugaaauaucaccccacauccauuaggauggcuaauauuuuaaaaccucagaaaauaaguguuguugaggauauggagaaguugaaauccuggugcacugguggugggaaugugaaauuguguagccacuauagaaaacaguauggcaauuucucaaaaaauuauaaauagauuaccauauaauccagaaauuccucuucuggaaguauauccaaaauaacugaaaucaggaacucaaagagauauuugcacaccaauguugauaacacgauuauucgcaauagccaaaaggugaaagcaaucuaagguacauugguagaugaauggauaagcaaaaugugugugcauacaauggaauauuauuuagcuuuaaaaaggcaggauauucugacacauacuacaauauagaugaaccuuaaggacauuaugcuaagugaaaucagucagucacaaaaagauaaauacuguauugauuucacuuauaugauauaccuacaguaaucaaauguacaggaacuggaagaagaauggugauugccaggggcugguaaaaggaagaaacaaggaguuauuguuaauaguuguagaguuuccauuuuaucaaaugaaaaaauucuggagauugguuauacaacaaugugaguucaacacuacugaacuguauacuuagaauaguauuuuuuugugguuauaauaguaaauuuuguggguuuuuaaccacaaucuuuuaaaaugugaaaaauagaagacuaagaagcuaugaucucaguggaaacuaaaaguauagagcaucuuuaaauggaagaugaagaaaacucccauuacaugucucuucugugucaggugcuuuguguaguauggcucauuuaaaaaccacaugauaauguaauuuauuauuucuggacuuugaaaaauauacaaacuaaaucugcucacuuuuaacuuagacauaaauucaggugaaauuuuuuauguuuugacuucucuuaucucuuuuuauuccuauuuaccagguuggaaagguacuuuguuggguguugcuauggcuacagugaaugcuaugauagcagaauauggcugcaguuuggaagacauuguuguuguacuuggaccuucaguaggaccuugcuguuuuacucuuccaagggaaucagcagaggcauuucauaaucuucauccugcauguguacaacuauuugauucaccaaaucccuguaucgacauccguaaagccacaagguaugucugauuucauucaacugcaaguuugauuauuucugauuguucuaaaaugaaauuuauuuuggagaacaauuaauaacucuaagaagaauuuagguggugguuauuuaagcagcugacaugcacauguacacaaacacucauuuuaaauaugaaaucuguuuucauuugaguuugaauaacagaaauuuuccugucugguaucuuucauugauuuaaaagugaaggaagaaauauuuggcauuuaauuuuaagagaucuacuuaaacuucauauagaaaaguuggcguguacuuuacuucacagccauuccucagcuaaauucuccuaaauguaaugaacuaucaggaagcugauauuuuaaaauuauucuuauuaucuaauuaacuagaggaauauguuuuuuagaaaaaauauuagauaauauaaauacacgguuuuuuacuuuuaaguuuuuuacaguucuucgcaucuuuuaauuuacaagguuuuguuauuaauaacuggugaaaauuauuugucauuacuacaaaggcaaauuaauguauguuuuaaaucauguuucuauuccagucgccaaaacuuuacccagagucugccucauuuaguacagauguggaaaaguuugaaauugauucuuaaaugugacuuuuaaaaucaaguaucacuaacuuguagucauauuucauaucauaaaguguucauggagaagcaaguuuucugagaaaaaucuggcuaauagaaggaaaggagaugaagggccagaugacuaaaaagcauacucuggcugagccaggugaauuuugccugauauccugguaacuuuuguagacauuucuucuuaaauaagcacuugauuuugauuauaaaauucuguaccuagauuaugucuauaagacaauauggaagguuguacugugcauauaugaacuuaggugauaaaugcugauaaaguguagcauuuuuuucccugacuaguccauguucuguaagugaauaacaauauacauuguucuagguacaucuuuccuggaacuuuuucaugccaacauccauacuuuuuuucauauugcuuuggcuauugggaaaauaaacucuugcucucuuuugaaaaauauuuuuccuaaggauucuucuagaacagggaggaauucuuccacagaauauucaggaccagaaccaagaucucaaccucuguacaucuugccauccugacaaguuuuucucccauguccgagauggccuuaauuuugguacacagauuggcuucauaucaauuaaagaaugagguacaguagguuuucucuccucucuccguuuuuccucucuuucaucccucucuccacuucucccucccuuucucuuucuuccucuuuuagccuauuccuccccuuauuuaaaaaaaaaaaguuaauuauguuaaacuuuacuccuuuauuccuacagggagaaugauguuucuacuuuuuuagugauguaauagugguagcaacguucauuuccaauaacacucuauuaugaagagcagccacuccuuuuccuaguuaaugaagaauaauuaggcaggcuuauguuaaaaguauaaaaauaaaacaauuuaaucuuuaaaaagguauguaaguauuuccuuucucucuacuauguacuugauaucuguacauucccuauccucacauccuuauaacuuucauguuauuuuugaaaacaaaucuuugcauaaacauucugaauucuagaaucauaagaaauucucacaaagaaacuagcuugauuuucaacuagauuuccaaaugauuaucugcaguuggaguugcccaaauuuuuauuuuaaaaugacaguaaguaguuuagacuuugugggacauacaguauaucucagcuacucagcuucgccauuguagagguagagcaacaagagauacugacaacauagagaugaaugaauauguccguguuccaauaaaacuuuguuuacaaaaaucaggcgagggagccaggcacaguggcccugcuccuguagucccagcuccucgggaggcugaggugggaggacugcuuuaggccaggaguuugaguacagcauggauaacauaaacccugucuguaaacaguaaaauaaacagguaaggggccagauuuggccuauaggcuauaguacacugacacaugaucuaaagucauacagcaagacugaguguaauuuucuuaaaauaguauuuauuagagaugguuuuguuggaauuauacaaaaauauuucauggcacugauuuagcacugccccuauaagauauguguaauuuucccuaagguuacuucuagcugaauuaauauuauuuuuuacucuuuacaauguuuuuagcucuuuaacuuacagaaaaacuuuaauagacuucaugacucuuaccuugauauucuaauaacaccaguaagcgucucauauuugauuucuauguauuuuacagauacuugacuggauuuuuguauaacugcuuccugccuccuuccaaacugacugcaagagagaaauuuagcuguuugauuuacuuaaaaccaaauggauuacaauggauaauucaucuuuuggguauauuuuuacuauuauucaaagccaaaugauuuucauuuaauuguaauaauaacugacaaaaaucaguauguuguagcuaauauguuuuaugcaugagaauuauucuuaaaguuuguucucccuguuuauuacacagaucaggaauagauuuguucaguucaguauuuauuggauacccucuauuggucaggcauuguguuaagcauaugugaaucaaaaugaacacaacuuuuuccuuugagucugauacagugaaggagaua

SEQ ID NO: 17674 - RNA, 540 nt, Homo sapiens
ggugaaaagauauauauauauauauauucagaauuaggcagcuggacucaguuuagaugaucccaauuuuguuggcaacauccaaagcaucguaaucaggagccagucgaacauaugccuucuucucuccaucaggccgaaucaggauguugaccuuggccacaucaaugucauagagcuucuucacagccuguuuaaucuggugcuuguuggcuuuaacauccacaaugaacacaaguguguuguugucuucuaucuucuucauggcagacucaguggucagcggaaacuugaugauagcauaguggucaagcuuguuucuccugggagcgcucuuccgaggauauuugggcugucuccggagucgcagugucuucggccgccggaaggugggugacgugcggaucuucuucuuuuuguggcuguggacaccuuucaacacugccuucuuggccuuuaaagccuucgcuuuggcuucagcuuuaggaggggcaggagcuuccuucuucgcuuucggcgccauguugugaaaagggucca

SEQ ID NO: 17675 - RNA, 540 nt, Homo sapiens
uggacccuuuucacaacauggcgccgaaagcgaagaaggaagcuccugccccuccuaaagcugaagccaaagcgaaggcuuuaaaggccaagaaggcaguguugaaagguguccacagccacaaaaagaagaagauccgcacgucacccaccuuccggcggccgaagacacugcgacuccggagacagcccaaauauccucggaagagcgcucccaggagaaacaagcuugaccacuaugcuaucaucaaguuuccgcugaccacugagucugccaugaagaagauagaagacaacaacacacuuguguucauuguggauguuaaagccaacaagcaccagauuaaacaggcugugaagaagcucuaugacauugauguggccaaggucaacauccugauucggccugauggagagaagaaggcauauguucgacuggcuccugauuacgaugcuuuggauguugccaacaaaauugggaucaucuaaacugaguccagcugccuaauucugaauauauauauauauauaucuuuucacc

SEQ ID NO: 17676 - RNA, 58190 nt, Homo sapiens
ccuuuaucuggaaacaagacaaagcagauaacacgcugagguuuuucaucauguugucauuucgucauguuuuguacuuugggaaguuuuuucccucccuuuucugggcuucuguaguauaaaggagaaaugaaauuaugcaaacauuugcuuuaucuuuguucauggacaagcauauagccacucuguguagcaaugaacacagaaaguaaagguugggagcaggaggggagaggaacuuagaaacaagacagccugggaucaauguuaaguuggcauagaaauuuaccgucacucagucuggagaaaguuacucugcaagcuuuaguuuugccaggagaaccagagaaagcaaauaaaugaaagauaaaacuuucuguuuuguugugauuauuagaucuuccaccuccuuccacaagagaacgaccuccuggguguaagaccguguuugucggaggauuaccagaaaaugcuacugaggaaauuauucaagaagucuuugaacagugcggugauauuacagcaauucggaaaagcaagaagaauuuuugucacauucgcuuugcagaggaauucaugguugauaaagccauuuaccuuucugguacuuugcauuacauaaggaguuuucuaggcauuuuguuauguuuugugauguuaauaugagcuuauucccuuuggccuucaugcaaaauaaagucuucauaguuuggggcuggaaaaggaggaauucugccuucuuccuuggcugccagaagcucugcgcuaagccugugaagguacuucacugcaggagcaauuucccaccauccagucuuuaggaauuccaucgaguuucuaauuaauguucucaagugcuuauuagaugagaagcaauauuaugaguacuaaggaccauuauucuuacuggauguaauccuuaggaggaguaaaguacucucucagaauaauuucagguuuuuggaaguggauucacuuucuggacaccaagguaccaaagcaaggucaguuccuugcaggaaaguagcuuaggggcccuaggagaaggcccaguaucauugccucguuggugguucauuaagccuuguccucuggugucaauuuuuauaggcgauuuuuacagauacugagauuaggccuagugcugccuucccaucuguggguauugggccaagugaauggagucuguccgcaaggccuuugccaaacccaagaauuaggggcuggcuuuggaaggacacauucucagacugaacucacugcccuucccucacacuccccaccuccauuuuucagucugucccucugcauuucaccucccuauuccugaggcaaagcugaugggggaaugugggaaaacaguagcggguggggguggggaggggcagggggaccuaucugagcauuccugccagguuuuacuuaauuucugcaguccaccucuauugccacgaaauucugugcaaacuccagaagacuugagguuauuccaauacugcagagacuuuccuaagguagacagugauauggagaacuuuaaaaccccuuauuucaguaaaaccuuacaaaguagaaaauaaaaacuaaaagcaauacaaaauggagaaggaagacaaagccuagaaugaagacauuucauaacacacaauccgcuguuagacaacggggguucuggugaguuuguggcacuggguuucacggccuagagccugccuccauuuucucaucuauaaaauaaagauaguaacagcaugaccucguaggacugugaggaggaauaaaucaaauaauggauauuaagugcuuagcagggcaccugcaacauagaaaccauucaggaaaugguuguuuuuaacacaaauauccugaugaugauaaagaaggacggauuuuucuaucucaagaacccuauccuggggaccuggcuucuaaucacagcuguaccaagaaaacugcagucaucccucaguacacuuggaggauugguuccaggaccccccgcccccgccccauguauauccugcagaacccucauguauaugaaaagucagcccuccaaauauguggguuucacaucccucgaaugcuguguuuuggauacacauuugguuggaaaaaaauccaccuauaaguggaccugcacagauuaaacccaugcucacaggucaacuguauucuuuacccuacuugauuaaaugagaagguuagaguaaaucagaggcccuuuucaacacuaauacaacacaauguucacacccaaucagaagccucauaagacacugacaaagaugaacagucccaaauuuaggcauaugaaaggugcuccuugauuauaccuugauccuaugauuuuccagccugggugcuggucccgcuucucucagcaagucucugauugcuccuuggucugccccauuacuguaggaggagaagacagcuaggccucaccuccagcuucccuaccugggugcagaggagccuccuaacucugccucccugcccuugagaggcugcagcgucagucccaggaagaucugcaaggccaauuaacuggaaaggcaggaaggaagucaggcggccccuccuguuugugggcuccagcaagcccaagcccaagcccagcuggaaggccugucuaauuuuaggaccacauucacguuugaaggccuagcuaauuuuagacucagccucaucagggucucuuuuaaguccuuaaugaugauguuucugugaaagugaggguguuucuggagccagaaauguuugaaaacugcuucucuggacaugagcaggggaaaggugcuuggccaguugggauagcuggccaguuuaaacaguccugccugcucagcuguuaugcguguaucacuguggccugcugacuuguuaaguucccauggcccacaaccaagauacauuuugcuuuugcauuaauucugcacaucugugauuagauguuuuuguuuuugauugguauuguuaugucuucccauuuucagauaacacuugaaaaucuagcagugagaaggguuccaaggcaucacagaaaccagaugugaagucaauaucuuauuuguaacuuuucaaaggugugaaguggcauccuggggaggagccagccucuacagagauuuucagcugagguuuauccccaagugcuaaaauaauccauugaaaucuaccaugagaucuugaacaucagcacagugcagccuagcauuuuacaguuguaucucauuugcaaagcccccauacuggaaaagugcuuauguugcucucuccucuggcagcccccagcagcugugucucugcugggaccuggauuuauguucugaaaaucugaguaccccaaacugaagagcaaccucaaagucaacucuucuucauuugaaguuaggccggcugacugguuucaguucuguuaguguugaucucucagaucaaauuucugcucauaaucuuuaucuaaguuggguagcucacagugaaucccccaaagauuuccaggcccauuuuuuucuuugucuagcucugggcucuugcacggggcugcuguggccuuaaaauauuacaugaacaauuuguguggugcugcauaccagaugaggugcugcagggcugugaggcaggcagcggcgaggccucuugaucgaagguaaaauauucuccugcgcaccccagaggauaaguggaaauaaaacagcauugcaaaauugccuugguaauuguggcuuuugcagcugcugagagagaauugagcagcagcauuuucugggggaauguagcaauaaccugugagugaggugucuggaauucacuuuguagaucuuuuuaaauaucauagaugcucuuuauuuacucauauuucaccuauacaguagaauuauaguaagcugaaaauauaauaaaaccaaggccauaaaaagguagagaaaaaaaaugcuccaugccaaauuuguuucugagcuuccuagaagccagggagaagaaggaaugaucaugauaagacccuaguuccugagaucaucuucucuuggggauacugguuuggaagauggguaagcagcccucugagacagcucuccaagguguguuuauccccaaaccuguaauaggccuaacuuuacagagcuucaagauugcuggggaaaaggauaauuguuucccgcuuccuaugggaaauguauccguagugacagccaagaaauaagugagcauuugccuaagcgugccuugaaggucuggaccaaaacuguggccauuguuacauuauggugugaccagaguuuccauugguuucagguuauaggaugcgauuagggucuagcaccgacaaaaaggauucaggccgccuucauguggacuuugcccaggccagggaugacuucuaugagugggaaugcaagcagaggaugcgugcccgggaggagcggcaccggcgcaagcuggaggaggaccggcucaggcccccauccccgccugccauaaugcacuacucggagcacgaagccgcucugcuggcugaaaagcugaaagguaugggccacccacgcuggcuuuucuuccuccacagggauccccagacacggaacccugugcguuucuccugcguccaccauugucccuucagcacaaugucugcuaugccuuaagaaggcuguaagagucugguguaagcacagacucuuuacagagcuggggugggguuagcuggggggucuccuggaagcugcagacaccugggcuucaucuucugccugggacagaccccugccccuuuccagaaugcucacccauguucuccauaaaaguguauguacagucacucaacaaaacucacugaaugaggggacagaaagguccccaaagcaggcuauuaucuucugacccaguguuuaaugagccagcaacuauuugugccauugguggggcguucuuaguguuccuccagcucuauagagugugcauguuuaccagacuccuaaagccuucuucaggcaaaacagcagacaugguacuaggguccaucgaggauagaaaagaaacauagaaugggaucccugucuucagagaugcaguugaagggacacaugcaacauuuacaggaugacuagcaagagaagagaguauguuuuauuucuucuaauguuuucugaggcccucccugguguuuuaugcugugggaaauaaagacauaggaaggcucugguaccugcccccgugaacuacagugaugccagauuuugaaguuaggaugacaugugaauucaguucuauuacugaccaaaguugugugagcugagcaacauaugggcauuuuacaggcaaaugauggucagacccuccugaggucacugagcacugucaggauuugaugagagaauguaagucacaguugguggccacauguaggugucuacagauaaacaauuaacuguaauaccaagucaauggcaugauugucaaccaagguaaaugcaauaugcuuuggggacucaggggccagugcaaauaauguugaugaaagugucaagaaagucuuuauagaggaggcauaauuugaaauuugcagaauaaauaagauuuuuuuccccaggauaaaaagaggcauaaaggcauucuaguuagaggcuggagaccuaagaauaaaaacccacagaagcagaaaggaauucagcauagaagcugccuuucuagagugagguaaagcuggaauggcagucugggccagauggcagagcccugaaggcuauugcuggauuuggguuuuauuccauaaacaguggagaagccauuaacagauuucugaugagaagagggaugugauugauccuucaaguguuuuagaacauagcugguguauugcuggcaguguauaaaguggauuggauguuuucacuaaaaaaaauguaugaaaagcugccuaacaccuauuuuaggaagauaggaaguugacauucuaugcuuuaaaaaaaaaaaaaaaaagguggcagcgggggugcugugcuuccaaucuucaucccccauccagggcuugagaauccuuaaucaacugcagcugccacugaaauacccgcaccguaaccaaggaaugcuucuugcugaugcucuuguggugugucugcugcuuugagaaaacaugucuuacugauguaaauacauaggccauggcugugccuuuaauaaagggcauaugcagugcagauacagauaucaucucacuuuucccuccagccuagaaaccauaaggaguggccaaaaugagauacagcagcaauguucucaacaaggaguauucacuggaacaauaauuuuucuuuaauauccaauguauugugguaucagauuaugaucuacacagacuaacuguauucaguuuguccacaccuagaagugacaaaaacugcaccuugaucugugaccuccuggaggaauuucauaaaagcguaucaucuaguuauguuguuuuuaagaacccaguacagaagugucuccgcacguaugaaguauguggcauuugccgcuccuuuuagaggauaacagauugggaugucaauuugguaaaguaauuugcaagccuugccauuucaaaaguauauauuuauauagaugaguauaauuuacagaauucagaagcuguaccuuugccaaguacugugugaucccuugaggaaagaacagauuggaaauuuuaauagauggcuguuacaguagaaugaacuagcuggggauacaucuuaggcaagagucagguaauaucaagcuugacaauuucaacccaagcauagaguuuggaauauaaacagcauuuaauugcuuaggaaauuggcugccuuagagaggaaauccacuccaugcuccuuauaauguugcaaagccagacaggaggagcugaggacacuguuucccugaagaugauuucauugauguggggacauaaaauacagucaauaccuaagguaaagaaaucugugucagaaaggaaauggaaaugcaaucugaaaauaccuaauuggauuugauuuuuuuccuccccugagaaaucuuacuuagauuuauuacagauacuuuuccucuauuuuauaucauacuuguuuauucuuacaauuuucucuuugaaaaucagcuuuauuuagcaaaaucuguacaaaccaagucuuucuuaugacccacaaggcccucuccauguccuguccaaugcuaaaacugugcacauaguaggugcucaguaaaaauaauuauuuucucucuucuucugcuauuuggaucuaugagcacguugaauuucuguccagugguucuacugggcaugaccagauguacauggaaaugaugugaugugugcucagccauccuuccaaucacucaagaaguauucguuaaucagcauuuuaccauaugacuggcgcuguccuagccagugguggaaaggacaacggugaacaagccccugccucaaagaguuuaggugucuugagugacacaggcaauaacaaaucaccuugcguuugccacuuauaauagugcacuauuauaauaaauauaauaauccuccuguuauaugugggaagugcacagugcugucacaggggagauagccagcccggaugggcagugcuggagugagagagggaggaucuucugggaccagguuaucccauucacuggcuacuugaccuucugaaaccagagguaacacuguguuguauuuguguagugccugagacauggagucacccagugccuguuacauuaauacaaauucuaaaaaagaaaauuaguaagcauccugcugguuaaacagacauuguuccgagacaauucaacuuaaugaagaccgacugggaaguaacugcucagaaacccaaaguuuauagcauggcuuugagaaagugggaaggagcucaauaacaccauaauuacacuuuauuggaaacaguggcaaccaggcagaugagauaaugaauuucagugugucuaacacagaccauccaccccuggaggaacccuguguuuggacugugggaggaagagauugauuagacagugaggaaggauuauauucuaauucaccgggauuucucuuggcaagagcauuuaaaaguuuuuacguacuuuguacccccuuagaaagcuucacauaaucuuucauuuugugaugaaaugaagaguuucucucugaauuaggugacguccugacaaagccuugcaggcagggccuuugggauuuccugaugugucaacaagaauaccauccuccugggaucaacauucauaauuuccagagaacuggacucuuauuugcauauagaauagccucaugucagccugccagagggaggaaggggcagaugugguaccagcauuuugcugagaugguugucaguauuuaugguuccaugaaaguaaaaaucaauaauguuaugagccaaguggaugucccauuagcuaaaagccaggcuuccuucauagaguaagggaaauaugaaacauaggagccuguuugcaaauuauuuccuuauguguuauugaccuucauagaggcaagauaggccguuuuauuuagaaauauuuugcuuggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaagcaaacaccgcauauucucacucauaggugggaauugaacaaugagaucacauggacacaugaaggggaauaucacacucuggggacuguggugggguggggggaggggggagggauagcauugggagauauaccuaaggcuagaugacgaguuagugggugcagcgcaccagcauggcacauguauacauauguaacuaaccugcacaaugugcacauguacccuaaaacuuaaaguauaauaaaaaauaaauaaauaaauaaauaaaauaaauaaauaaaauaaaaagaaauauuuugcucgacccuaaagcaggaauaaucagugcauuuucauauugcccccuuaauuuucucauuuuuacagcuacuaaauaguuaaggagauugcauguguguuuuggggguagaagggaacauuaacucuuuguuuagccuuuuaugcugucugugaucugguuaguugaugcgggguuaauugagcagccaggaaaaggagacuucuuuagggacauguacagaaauuuggggauugugauagcagcaaugcuuugaccauacugaaauuccaaaucugcuuagaugacucugugacuguacacugugagcaauuuccagcuaucuuuggagccagaaaucagugauaacuacagacauaccuuuccuuguguguguauguguguacacaugugugugucccuccauuucuuuggaaagaaaagcauuuuagaaugccuuccuuguuuucccucguuccguucaaacauaaaaucccugucuccucauuguuccuuuauagacccagcuguaaauaaggauacuauagcccaccuaaguuucguauucagugcucccggcuuggcucuuauccuaucuauuguucugaaauucagggcugcuucucccugugcacacaaagcgggaggaaaaaaacaccagccgggcguaguggcucacgccuguaauccuagcccuuugggaggccgagauggguggaucaccugaggucaggaguucgagaccagccugaccaacauggagaaaccccaucucuacuaaaaauacaaaauuagccgggccugguggcgcaugcccguaaucccagcuacucaggaggcugaggcaggagaaucacuugaacccaggagguggagguugcagugagccgagaucaugccauugcacuccagccugggcaacaagagcaaaacuccaucucaaaaacaaaaacaaaaaacacuuaccaauuugguuuauuuuccccaucauuaucuauguaucaguuuaauuaaaauucaccagguacccaucgcuuugugccaugcccuggacuuucagauaugacuguagcaugggcccugucuuuuguuaaagaauacuguggcggugaaaucaugacugucuuacaaauauaaaaugaacaugugccaaugauuuuauuuaacucacuaauuaauaaggagaccaagaaaauguuaaaacuguuucgaaggagaauucgcuuuauaaagauuuacauuuucuacugaacaaaaauuaauuugcauuguuacagagacgaauuauuuguauuguuaucaguuugccacaauuuauguucuacuccuacaaaguuguaaaauagccuagucagagauuagccaaagaauuaaaguuucccacccccuguagaauuagguaauucaugcccagcauuccauagaaagggucuauaguaaucucuaugcccauuuccaagucuugaacccuuuuuauuuccuggauagaagugacagcuguggggacagggauuuaauuggucguggggacagggauagagacucacaaagcucuuaagaaucacaucuauuccuuuugaaagucucuaguaucucagcugcuacuuuccacuucaggauuucauuaucucuuacuuuggucagcuccuaaccaguuuaccuggccuucacugaguccuuucuucaguguuucucaaaccuccaugugcguacaaaucaccuggaguaaaaugcagauuccaauucuggaggugugagaaaggcugagucuguguuuuuaacaagcucacaaaggcugcuccugcaccuggucuuagaauauagcaaagaguucucccauaugcaguuuuguaaugccuacuaugugccaaguacucaauaaauguggaagagagggagaaggaaggggguuaacaaagucugaaauaaccagaaaugaaaugagaugggcguggauuccaguggugacaucugauaguaucauuauaauauuauuuacuccucacaaagcuaaagagcaauuacguucccagaauuaaaaaugcuuucaaaaacauuuuugaguuauuugauaaacuguuuagugccucacugcagagggccuugcuucugugggauuaucugacaucacucuuaacuuucauugccagugauaaugacuucugaagccugaaguauaacgggaucauucagcuuaauugucaugagaacaucuaucucucguagauaauggcaugugugaaaauacucuuugacaugaaauuuaaauguuuauuaucaacucugauguuuccuaacuuuuaaccauuacauuuguaucuuuccaguauuaauugcuacaaaucuauuaggaauacaguagucuccccuuaccuuugggggauacauuccaagauccccaguggaugccugaaaccauggauaguacugaacacuauauauacuaugcacaagcuucuuuuuacuucuucacaauuucauagauaaauuguucuuauccuagauuuuagcaaccucagcauacaauuucuuucuuuauugugaagaacuuuuaccuuuucacguaaaggaagcacuugguggcuuuucuuuggcauuuccaaauugccagcaucacuacucuugcauuuuggggcuauuauuaagccaaauaaggguuucuugaacacaaacacugcuguaccauuacaguggaucugauaacccagguggcuaccaagugauucacagggagguaguguagacaacguggauacccuggacaaagggaugauucauaucccggucaggucagagugagacagcgugacauuucauuaugcuauucagaacagugugcaauuuaaaauguaugaauugcuuguaucugcaauuuugcauuuacuauuuucggucugcaguugaccacaguuaacugagaccuaggguaacugaaaccucagaaggugaaacuguggauaaggaggaacuacuguagaaugcaauaaaauauaaaauacaaagggaaaaacucagaguaaccagaagacagaaauaugucuagaaauaugucuuuggaaauuuuauucucauauuagccccucaaaacuggagacagaucuguaaaccaacaauuaccauacagugcgacuaaugcuuuaauagcaggauaugcggggaauuguggaaacauagcaaagagacaccuaauucauccuagaguugcagaagagauuucuuuauuaaagggcacuuacgcugaaucuugagggaagaauaacagcugaccagggggaccaggagugggagagacccaaggauaagugcacagcaugagcagaugcagggaggcacgccgugcuguuuaacaaagagggcucuggcaaaggaagcggggacggacggauggaagggaaaaaggcaagacccgugaauggaccuguccauuaacucaggugcauuaacauugugaggaccugauuagaaaacgguggguaauuucuaaugagcaaaugauuuauauucacuccaucauauaccaaucguucucaauucuuauaguggaaaaagcacaucugcacauucuagcuucuaaacugcauccaguucagaguuaugccugagcauguucacagaaaguauuuggaauuuuuauaagugcauguuugaugugauuuuuacaagcaguguuaauuucuuuccacaugaauagcuuuaauaaugcugcaaucuaaauccuguuuaaauuaguuuauauuguuuucugcuuucucagugaucuuuccacugaauacaaaauugaauuuacaguugaguauugaaaaugaccgcucccaauauccuccuguagccauccagagggaguuacugacuuagucuuaauuaauauaaauuaaagucacuucuuacauggcaacaaauauugacuggaguuaucaagcaugccuuaacuaauguuuuuuuaauuuaauuugaaugucaguacaucaaucauauaucggccugucaguuucagaaaguucagaaaugaagaugaaauugggagucuuugaaacuauauuccucuuuuaggcuaauggaauucugcuuccuaguacuuguuaacauguuagaaaaucucuuggcuacuuacuuuugaaauuguguauuuucaguggcuuaauccuaagaauauuguuuccucuuucugaaacuauaaucugcuggugaacuuauugugcucuaggucuaggugugaagggcaauaaaauguggcuuucagagcauuugagcaaacaugcauuuuuaaaauugaaguguuuuuuuuccugauaguaaaguuagucuauuuaugaacuaagcgaccacaagcaagagaaggaaaaacuaccuguauaugacagaaagaggugaacagcauuacacucugucccugcaaagcucauaacaaaaauguuaaggauuuuucuuucucuguguuauguagacaugaaacucacagcaaaggggaaaaauaguacaugaagucaguguucucuuuuucuguuguuaucuuuucagaggaaaaaaaaaaagauuucuucuaagcauuagguuuauuucugcugucuguucugagguccauucuccuaacauauauuggugggaagagagguagagaguguggagggaggcacaauuuauucugccaguaacgguugcagugggccucucacaaacaucaugcuaaauuaugggccucuccaugggcugaacguaauguuaaguugugugauagauuuuaucuuacacaagcugcuucgguccaugaaaugagauaagaaaccauugcagcuggaguucacugaggguugaacuuagacugaaauuccagaguuaacaaaaugguauaaguggcuacgauacucaguaaguguguucugugccuauggguugagauuuucaaggaaacuugagucugucauucacaggguguuuugugggcauucccaggccaguuaucuccucugguuaaagugugagggcaggggggcagguuugcucagaaaaaaaaccuuugauccccaaaucuagaaggcugcugugcagcaggagaggacuuagaauggugccugagcauggguacaucccuaaaagcugcuuucuuuccuggggaaggcagagguuuccagaguucagccguaggaccuugaauuagguucagccccaccuucauucaggacacacaccuccugggcaagcagcagccaugcuaaggaagcuguacuccuggucugggaggaggucuuugggagaaaagauacuaaagauguuuguaaagcacccuauaaauuuacaaagcacucaacggugggaagguuucguaugauguguaaaauacuaauaagaacucaaugauugauuuuaaaaucuggugagugaaacgaaaucuuuuucucaagcaugcaucucccccugucuauucauguggaguguauguauguuuauaugcaaacaacauaaggaugucuccgaugccccuccaguggaggggacaguaccuggcacacaguaggcacucaguauuuuuuaaaugaaugggugagaaucugaaucuuucaaucuaauuuugcuccugauuuuuagaauucagagucuaccuaguuuacuuguaaaaauguaggguauuuuucccuaaagcacauuuucuagggauugcagaacacaaugaaaagcuucuccccucagguuugccuggaaaguaggcaaugagccuucagcaguagucagauugguuaauguucuaacaacugacauacaacuuccaguucuaauuaacuuaaucacccacaaacuuucuuuuucuccaccuccaagccauacaacacggguuuguuccaguaaccauccccaaauaggcaagucuguuuucuuugaaauagacuuuaucacuuauuuucaggcggaacuucauuucccacuuccuauccccccgccacaccaugcacauacaucucaaacuggguucagaugggcucuccauagccaucuaaagcaaacacggaacacuucaggaaacauguucucuuuuguggaaaauuaggaaauauucuauuuuucagccuaauuaaauauaugguauuagcccuaaaauggaauuaguuuugaacuacaguagaacaagaauugacuuauuccuacuaccugccuuagggacaauaccauacauuacaaacacuuuuaaaaaaauccaaucuuucuuccacauuuuaauacuaacucagcugauucuauaaaugagaaaacugguaacacuguauaauauuuuugauaaaggaacaaagaaaugaaguggaggccaaguagguuaguaacaguuuuucaaguccaucuuaagaaagagaaaucaagguuugguggaagaaugaggcuguaccuuauuccuaagaaugcccagaacaaaucuccuacagcugagcucauggaguugguagaugagagugugaaccuccugagugguucuguggugcccugaaguuagaugggaaaagagaaguuaagugaugauauggcagucagucucaggaaagcuaacuugcugaguucugaaaauauauccacuagguuggacuaugcucugucuuuugagaggaacaagaauaaaguguauuuucucaucuuggcaugauuuguacuuggugguuuuccauuuccagaugauagcaaguuuucagaggcuaucacagugcugcuuuccuggauugaacgaggggaagugaaucggcgcucugcaaaccaguucuauuccauggugcagucggccaacagccacguccgccggcuaaugaaugaaaaagccacccaugagcaagagauggaggaagccaaggagaauuuuaaaaaugccuuaacugggauucucacucaauguaaguaaaauuuugggggccaucucuuuuguugugauuuugccuuuucuuuuuuauuaauuuuacuuuuucauuuggggguaaguaguucaauaauuucccauuuuuacuccauauugaauggcaaacuucauaaccuauuucauguucuguggcaacuuggaggaacacggacccugcccugagaguuuacuucucaaggugagcaacguuucuguagcuuuuccucagaacagcaagccuggccaccagggcagggcagcuagaugcaucugugccugcuggacccaccaugguucauaucauagcugcagggccgccaccguucaccugcaggcuguccgcacagaccccuauguccuccuagugcugacaguagaaagcaaacuugaacacauuuuccuugggcucuguguaggaaaaggguacuaucagaaaaacuccucaggaucuuuuaucugggggagcuguggcugucaaaaugggcaacucaagaguagagauuuuuuuguccuuucuucauuuggaaagcaaauugccuuaacuacucaaugccagugauuuuuuuuuuauguccagagucuaaaugaugaagggguguaaguggggcuuucucuuagaacaauagucaggguaauuacccagggcucuauucaaaaaaagggcguauauuuuuuuuaugggcacucuaucugugucuguaguuaaugucacaguggcaucaugcaucacagcugccgauguucucuugcuugguaaaagccauugaaugacacuguaacaaugccaugcuccauuccauaccaggugcagggcccuaugugguagugacauaugggauguauauuuccauucugaagauaaguacuauuuucugugauauagugugccaaaaugccuaucaccucuuucaucagugcaaacacaaggaauaauguaucugucaggauaggauggaagagagggcaaaacugagaucuuaaauguaaaaguaucuuacaugacuuuaucaaagacagguuuuacagcagcguagcauaugauauaacaaauucccaaauguaaauuccgauaagugaucaaauauccaguauaagaccaaucugucuuuaaagaaaaggaauaggaaaaauaagacuucugucuucacacagacugauaccagaccacauuaccuagauucaccagccuugaggaauggcccuuuacuuaagaguguaugucuagaaacucuaagguuauuagggauagaauuuuuaaaaagcaauauuuacagcaguuuuuaaaggagggaagaagagaauggaucaguggauggagggaagguaagagugaacugguagagaaaaaugagagagagcauaguaaaacaauucuaauaauacacuuucuucagaguuaugguaagaagucauaugccugaacagugaaaugauuacuguauguuuuuaucuuuugcucacuggcaucaauuuuaaauaaguucuaauuuccaugcaguuuauaguccuaaugagcaaggaagacucaacccuuggcucuaacaauaaagauaagagggcagccaugaauaggugagaacuucguuuucuuuggcaguaacuauugaaagaggcaccuauuaaaaugccccugugauguggcugaaagaacgcaaaaugucuaccugucauuauauagguguaaguuggcccauauuugaagcaacugagagagggacagaaaaguguaguaugugggacuacaaauacuuuuugguauuaccaccaaauuggaaaaugacguggagauuuacagcaauaauuggcuucugaauguuggacguuguguugagcauccagccucaggcagcacugaaggccccagccacauuaccuggaggcuacacuuuggaugccuaaacaagggagugggugagcagaacaggcacucccccugggcaggcuggcucaucacucccugagaaggagugaaugaagggguggggcaggaccagcaagauccugucuccuggaaaccacaggaguggagacugccucuuaggcaccucaacuuugaaauaucaaaaguggaauccuugcuuuuaaucuucaaaccugcuccucuucugguuuuuccuucccauucucauaaauucucaagccaaagucuuguacuuuuuauauaucugccaucucccaccaccacaacugacuucuaggucaucaagaagucccauuguuucuuccuucaaaaauauaccccgauucggcccacccuucuucauuguaaccgccaccacccaagucaggcuuugguuacuugaugugucaguuagacacggcauccacaugugaguaacagaaaauucugccaaacgguaucugaaacaaguagaagauguuucucucuggacacaguaaaauccagaugugggguuuguugguacugguccagugguucaaggcugccaggucugaggucucucuggugcuauucgcuuuaccuggauaguugucuacgaugguugcugcugcuucgccugccaucacaucuucuuuuuccagcugaaaucacauaagaaaagagaaggaaagacacaggaaggaguugcgucauuauagcaagaaagcaaacuugcccaaaaauccauccccagccaacuuccauguagguuucauuaggcagaauuauuauaccuggccaugccuaacuacaaagaaugcgagaaauauaauuuuugacugggccugcugcucuccagaguaaaauuggaguucucauaauaaggcaggaguggagaauggcuacuaggaagaauuuugcaguuuuugccauacagagugcuucccuuucuacuucuacucuaguuugauuuauuuucacauuccaucugauacaaaucaggucaugucuuccccaguaaaccguuugaguaucuccccauugcauuuagagaauauucacugucccuagcugacagagcucucugugcucacuucuuuagcuucaguuauccucagacucaccaugcaucauuuccacuggccccuuucccccugagcccaucaaaaccaccuuccaccacucggcuuuauacguucuguuccuucugccuggggugcccuuucccauacucugugugcuugacuucuucuuauccuauaggucuuggaucaagagccaccucuucagagagguuuuucugguccacccucuucuaguagauuugccaucacugcaucucucucuuuuuuuuuuuugagauggagucucacucugucacccaggcuggaguacaguggugcaaucucggcucacugcaaccucugccuccggguucaaaugauucuccugccucagccucccgaguagcugggacuacaggcgcccgccaccacgcccaucugauuuuuuguauuuuuaguagagacaggguuucaccauguuagccaggauggucucgaucuccugaccucgugaucugcccgccucggccucccaaagugcugggauuacagguguaagccacugugcccagcccacugaaucuuuaugaagguccuuuguaacacuuauccaaaugaguagugauuucaugauaugucugcuuuuaguuauuauagcaggcaucacaaaggaagagacaucaauauauaucaagucaucaauauauaucaagccuuauaacauagaaauaugcaagaaauauuugguggaugagugagugaaugaaugaguagaucagaagacaggcaggagggaacccugaaacagugaguucagaaauuucuggugaccucguugaguaguuuggcauugauauuagcaucaucugcaggaaacaagguuucaacuugcaugcauaaugaagcaaaucagagaaaaagcucaauagcuguacuuuuuauuggaaauugccacacuuuaccaaauucuuggucagaggcuaggaaauauuaggagaguuggggugaaagaaucaucagaaauuuacguuguaguauccccaauuguaaccauccaacaaccucuguauuuaccaucugccuguuacuauuugggagucccccuuagcccuguaauuugauucugagaaguauuucagcaguuggcagauaucaaccgagauugugaaaauccuacagugcuggccacgguguacacaucccagcaauggagacucugaggagccuuccugugagucuuugacagccaagaucuuucaggaugacucgaagaugggggauaccuuaaaugugagccugggcuagaauuaagccugugaggcagaaccagaagauugcauaucucauugagcaaccucagaacuuuccauucucuucuaugugcuuuuacaaaaagggcugcaaaaaggaacccagucugugaaacuauuagcaguaaccugacuaacaugguagguacauacacaucuccucauccuuuaauccaaaugccucuccuuuccugucccgaauuucccucucucuaguggagcuauguuugugucucaacuguacuucuugcuuuccacagcucuguucagugugguaagauguguuugaugucaggacuuuggggaugcuuguaaaacaauaacugcuaaaguccucagugacugacacacuugcugcauuuuccaaaagcagaaccagucacaccccauuugucugcauuaauauuccuggcaaauaccacaggaaucacauuuuggcuucuucccuuagaaugagauuagaauuguuaagcaugaguauucaggaauugcaccucagcuuuccuucucccagguggcuggaaaucuccugguuauuccauagcagccccaacugcucccucuccacauaaaggaucuccuuagugucagugccgaaagaucuccccagugucaaugccguccuucauggcauuccaugguagccuguccacuaaacagccaagcauguugggaaauuguugugaggugguuuggaagcagguguauuggcaaacuggcuaacuaguggagcaggccgcaaacaagccaaacacggagggcucacuccgcagcuucuagggaagaucagguacauugcagaauucaaagcaugguaaaagcauguggguccccuuauggauuuggcuggaaauaaccaauugguugaauaggacaagggaaacuucagaugugauccaugagcuggauuagaugcaccuaucuccuuucugugcuuguguacuuguucuugcuuucauuuggaaaggauccauaggcucaaauguuuggccuagauugcucuccagccaccguuccugaaguucagugcuuaacaaaaguuguuugaaaaacgucacaagucauucauaauaacauaaagaaaaaguugugauuuauucaaaggucuccaucaaaguccaucaguuacccucuagcuuuguugguguuuaguucugcccguauuuaugaaaguucuaaccuuuuuuauaucucuggucuucaccccaggaccagcuauuaaauaucaaacagucauuguuuuuagcaaagucuuagcuuaaagugucagggggcuguaauuaaacccaacccgaggccgggcacgguggcucacgccuguaaucccagcacuuugggaggccaaggcgggcggaucacgaggucaggagaucgagaccauccuggcuaacacggugaaaccccgucucuacuaaaaauacaaaaaauuagccgggggcaguggcgggcgccuguagucccagauacucgggaggcugaggcaggagaauggcgugaaccugggagacagagcuugcagugagccgagauggcgccacugcacuccagccugggugacagagcgagacuccaucucaaaaaaaaaaaaaaaaaaaaaaaaaaacccaaccugaauuuuggggaguauggcauccauucacuucuguguagggcgauuuuucucuucugaccauggauguccaguuaugaaaaauguuagaugaggacaucgucuauccugcuguggcaccuggggcuuucuccucccuucugggccagcuggauagaccucauuuccuagauauagaagaaagagaaaaaaaaauucggaacagguaaaucaucuuugucaugucaccuuaucccgauagcauccuagucucaucuuuaugucauuucuuaacccguccauuugccagaaacuuccccagguuuuccaacucggagacguuggaguuuuuaucuuugcuuuuuaaaaaugcauacuucacagaaacuccccauaggccugcccacuuucaguuucucaguuaugaacaaagcuugucauuucaaagcucguacaggagcuguuuauaaaguucaggaagcauggacuaccacauucaguuauuaauaugcaugccaagaugauaaguuuugcaugccuuuuaacaauuacaacacacacauaucuaauaaaaauuuaaacacuccaugauauccccauuuugcuacuuucccaacaugcuuccugguaagagagaagggaacaaacuggagaaaaggcaaaugggaaagccagcagcagugcagaaggguugauuaacauuaauuuaagaauaugugccauacauauaaugagcauggauaaaaagcagaaauuauagaauguuagagcuaagagggaucuuaaaggguugggccaaacccugucauuuuacagaggaggaaacugagucucagagagcagacgugagaggcuuuggucauuuaguaguuuaugggcaguuuagaaccaagacucuuggcuccuuguacaguuugcuuucuaaguguguguguguguauguguguguguguaaaaugaaaauuaagaauauuauaaauguaaagguacagcuuauagguagaguugaagaggugugcugucaucacacugaguauaaaugcugcuaucuggcuaaaaaaugaaguauuugcuucuggcacuacccucuuuccuaccuccacacauuugcuugugcuguuuccuuugccugaacuauuuccccuccuccaagugccaaaauugaaguccacuucuaucacauuuccuccaugaaaccuuguuuauccauuauaacccauaaucaucucccuuucaccuaccuucugcagcgcuuguuaauacuaucuacuugaggacuuacuuauuuucuaauuauuuuaugugcaucaaguuuauugguuuguuugcuugauuuucccucuagcaagauuuuaggcuaaauagagacaugagccacuuacuguucucuuuucuaccucacugugccacuucuggaccuggcauaauucuuguaagcacauagaagaccuaagaaaaaaaauauugguuguugaccaaucacagguggaaaggaacguggugcugaaaauugggcuagaaccuaauauugcagaacacagccuaaguguuuuuuaguaaaccgugaucucaaugaucuuagcucuaauaugccauucucuuuaaaguggagcauacggcauauacuuuaguugagaauuuuacaguaggaguauuagaguaccguuaucaauaucauuucaaccuggagauuggaaagguuagaacugucaugcaacuuuauacauuugugauagguaauggcaucagccucaucuuaggucuuaaaagcugcaaaugguggaaagacuuuugacaaggcagagagaucugguucuaauccaaguuugaccacuaauuagccuugugacuuugggaaagucuuuuaagcaacuucagucuccuuuuucucaucucuguaauaaaaggguuuaaccaguaaucccuuaaaguuccuuuccacccuuaagauuccacaguucuuaugucaaccauguggauccuuuaucgucucuggauaucuaaauacagguaucuuccaggacccaaccaugagguucaaagcuccuaaagugaucauagaacaggcaaucagauauuacucugugcaaauguucugccuauaccuugcugugaagguuacuccuccugggcuacacugugaauuuuaagccacauuucaacccugagguuaugugcauugcauucugcaggugcugaagauuggucagaauuauugucaaagacagcugcgcagggcacugacaguucuccacugucacgcccucaucuaucuucuuggguaaaauuguaaaagccucaagugucugaaugauuaaauucauuccacaaauauuuaucaagugucaaguugugugcuaagugcuagagugaaaugugagggguuucugaucucuguguacugugaucccccuuuuaggcagauugguguccucguccacauuucuucugccugaaaagcucuuucugaaaucauuuacuucuuaggaacaucucagccaaacauuuuuuauuuccaccaagggaaauuuggcuucuauguccccugcugucaaaaaggaauuuuaugaaguguuaaaauguuugcccaugucuguagcagucauugcuguaguucauccaugggaaaaaauuccccauaacugcuuuagcaaugugacagguuuucuauuucuccucaaaauuguacugauggcuguauuugccaaugcauuaagugcuggaaacauuauuuccauuuaaaaaaauaccucuuuggucucagggaauaaauauccagagaaaauaauauguauaaaaacuucagcaucaaggaugagcacagaauguucuguuucacaggaugccaaaggugaugguggaggacacuaugccugccagaacugaaaugagucuuuuuuuucuuuucuuuuuuuuuuuuuuugguauccuuccuuucagucucguggaaaauauauacacugagucaaaucauuauguuuuuuuaaaaaaaucuuuaauaauaccaaaauguaagauagaaaucaagucuuacacucuggaacaauaaagaauuggagugcauauuaagugaaauucagcaaaucaggaaagguauaacuucugggagcuaaagaugaaaacucugucacuuugauaugagcccaggucuaggacuggacucuagccacugccccacaucaggcgaggggaauguguguugauagcauugggguacucugggaaacagucucugagcuacacuggacaaaauccaugcauaaaaaaaauuuuuacaaagauuuuuuaaagccaagacacuuucaaauugaggaaaaguaaggugucaguaaaguuacuuuaaagcagagaugauguguucuugacucugcguaacugaaagagaaguacaacuuaguguuuguuuuccaaccaaagaaaauuguaccuggggagaaucauggaagaguagccacagacaaagugagaggauuucuauuuaaggagagaaaccacuuauguguguagacaccuucuauagcaagguagauguaugaccugcaaagccaaaaauaauugcuaucuguuccuuuccuuauaaaguuugcuaagcccuguucuaaaggcucccagagccagaaaggagauucaggauggucuagccuagcccccuuugccuugggauucaaacagauggacacuuucuucaggucacacagcuaguuagcgauggagcuaagacuugaccaacacagauuucccaacucucucuucccgucuacaugcaacccccaaaacaguguuguauucauaaaaacacucccuuggccccacuucuguaaguuuccccugcugaggcuuauucaaugacuuuuauuucaaaaaaaguaggacagacuggauuuuagacaaaaugagaaggcugagggcacacacugagagaaauugguuccagccugguagacacaaaaaaaguagggacuuuuuuuccagacacuuugauucuucugcacuguggcucauguuccucaauacacuuuuguagagagguaaaugcagcuuccugcuccaucauaaccuccaauguuuggcuuguuugcauugaaaauucaacuuagcugcaaguuucagccaagggguccuuuaagccuuucuuggccucccuuggcacccucugcagcucucuuaagcaauucucaucuugcgauucaaucauauauauguugucucccccagggacucugagcagcucaaggaccagcugcauauuuggcccuuuuuauccccaguguguaguacaaagucuagcacauuacacaccacagagcucauaagacuuuggcccaucauauaauggguauaaauacaugauuugaaguuggacagauguaauuuccauugccaacuucaccacugcuaaauauaugaccuuggacaaguaaauauucgucucagugaaccucaguuucuucaucaaugaaaugggcauucauacuagcaccuaccucagacagucguugcaaaacuuagguaagauaaucagagguucucaaacuuuagcaugccuuggaaucaugcagagagcuuguuaaagcagagucuguugggccccaucccuagaguuucaccuuugguaggucuggagucugaguguuugccuuucuagugaguucucaagugauguugaugaugcugguccaggggccacacuuugauaacuacuguuuuaaaucaucaagcauagugccuagcccaguaagggcuaaguaauuagaaauugccuaucacagggcugggcacgguggcucaugccuguaaucccagcacuuugcgaggccgaggcgggugaaucacuugaggucaggaguucgagaccagccuggccaacggggugaaaccccgucucuacuaaaaauacaaaaauuagccgggugugguggugcgcaccuguaauaccagcuacucggaaggcugaggcugaagaaucacuugaacccgagaggcugagguugcagugagccgagaucaugccgcugcacuucaggcugggugacagugagacuccgucucaaaaagaaagaaaucuccuauuaccauuauaugauuuucauaaccacuaagggaguuaguagagacucagaggagaucaggguugccguuucgagggucacaaagaagaaaagauccccagaaaccaggucucuccuccugcugcuaugugaugacuuagcaucgagccaacaacugaauacagggcaggcucaaugagucuggacuuguuucuguuauuuguaauggaaacugcaaacauacauaucacuggugcagacaauugguuaccauguaauucaugccuucugucaucuaucaggaauggcaaaagcuaaauuugauuaugcacuguuggcaaaggguaagagaaacaaacugaaaaacacuucagggacauagagugcaacuugccaguaccuuucaaaauuaaaaauucaggugcucuuuuaucuagccuuucuacugcuaagaauuuuuuauaaagauauuuauguaaggauuucagaagauauguuggaagauguuuauagcagccuuauugauaacauacauaugaauagauuuccaagauauauuaagugaaaaaaccaagguacagaauagcguauauaauauuagcaccuuuguguaaguaaaaaagguuucucauagaaaaauacacacuguuuguacuauaugcauaaccuuauuuucuggauggaugugcuaggaucuguuaauagugguuacugguuaccuuuaaaaagagaacuugguagaguugucaagaugggaagguagacuuuuuuuuuuauaucgucccuuuuuucuucuguauauacauuacuuucauuuagucaguagggguaaucuaggcaggagauuuauuggauuuaaaaagcuuaauaaaugcuauauauuuugaggaacuauuagauuuauaaucucauguauugcuuuacuuuccaaaauuuuuaaauauaugcauuaauaaagggcucuacaauucccuggaguauacuuggagugaugcaaaucuuuaaaagucacuauauaccuaauaucuuucuguuuuauuugaacaauuugaucauuucuugcuugcuugaaauuugcuuaaaacauccuguuuuuuuauauacugugaucaguaggcuucucuuuauucuauucaaauuccauucccuaaaacagagguccccagccccugggccaguacuguccauggccuguuaggaacugggccgcacagcaggaagugagcaccaggugagugagcauugccaccugagcucugccuccuguuagaucagcagcggcauuagauucuuacaggagcgugaacccuauugugaacugugcaugcaagggaucuagguugcaugcucccuaugagaaucuaacuaaugaugaucugagauggaacaguuucauccccaaaccauccccaacccccuguccauggaaaaacugucuuccacagaaccauuuccuggugccaaaaacguuggggaugcugcccuaaaagcaacaaauaucuggccucaucuagccaggaaguucaguaauaugaugucugcuguuggugucuuggccucaguuuuaagugggcuguaauggacucacaaugucaugugaggcuuuuuuuaacauaucucaagacaaaaccccagaaugcccuuuucuuccucuauuugaaauuccgguccaucccuccuuaaaguauggguuugaccguauucauucucuguuuccugggcuuucugccaggcugacugccagcuccuucaugcucaggacccagaacccgagugaaugugcaggagucugucugggaaucucuuuuauagcagcagcuuccucuuaugugcuguccgacacauaccgcuucucccuuggaccuugucuugcuccucuggguauccugagagcuggaaucgcuuacugcauucccuccauuauaauucuucagucuaaagccaaggcucaccaauuccagcacuacaucuaaagccuuacacuuuucuucugucccuucuccccuagcuauuaguauuuuaaaacaacaaaaacaagcuggggugggagaggucaccuauuucauuugugucauaucccuuugaaaaucucucaugggcuauucauagaggauuugggaaaauguuaucccuuaaaaaaagaaaaauguccuguguacccugcagaguugaggcucuaacaugagcccagauagcauuaaaaaacaaaaacuaagcuuggaagauuuguuugaggugcuuuauuuaggcaagccuacugccuuuaaggacuaaaucaguuucuccagauauuugggacacuaacuggauuaaggcucuuucaccgcuauuuagcuggaacaaggaauacaagaggugcagggccugugagaaagaaggcagucggcaagacaugaagggaaaagggcuguguucguguucucuagaggacucuaaccuuucucuuucaucucccaugcauuccugcccagagcuugaaauucaggagucuugugcagcccagaaaucugagcuuuugcacccaguggcugcuuuuucccagggagcuugcuucaguguggucuguuccuggauaaauggauauucuguucugagcuuucccucccagagaaggcugaagaccagcgcuucucaugauagucuguaaaguucucuaucaguaagaagugugcucuaaacucagcaaauguccaaacauuuugggguggggaaaagugcaaaaaaaguuguuaaauuagucuuauggguuuguuuaaaauuggaagaauauauacauauauguguguaauguguguaugcuaggugcguguauguaucuccacacauacauauguguaagcuaaugaauaaccacuagugaggguuugcagcucuguggagugauuagcaacuucaucaaggcucuguuuauccugcccuuaaggucauuuacagcugcuggguauacuaggggcucuacugugauaucuaaaacuggcauucaggcauacuucugaagaauuuaucauuuuuaauuuucuuaugauccucaaauaaccuaauuuaggcaaacaauuaaaacacagaauugggggggaaagauuugcaaagugugagggguaaauuuaaauuuucugauggagagcucuuucaguugcuaauagaagauuugggaaaauguuaucccucaaagaaaaaaaauucccuuuaccugcaaaacuuuugaguauacuuucuugaauaaguaaguggcaaucaaacagaaucuaugcuuuuuaucugauacaggauuguguggggccucuggccaccacucuguggaccacugagguggugaaggcauuggguagggaguaggucucaauuuguucugccugcagcacaacuucuauaagcuacuugcuuugaacaaaugccaaugccaucuuguuugcugguuauaucuuucucugagaagcaaaguuuugaagagccuguucugauaguaacuucuuaacagguuuuauuguauauagauagaguaaguaguaugaauuauaccagagagguagucaguggucaucuaauucauggacuuccucucugguguuuccugcuauaagcaaugaauaguguauuuacaucaauaccaguagucauccugauuuaugagcuuaaaaguaugcugucuuugaaugacauucauuagggcauacucuuagaggugcuuuuucccuaaugaugaugaauuaaugcugaugaaagcacuccuccagaguccuuuuucgugugugcccaggaacuuucauuugcaagacaaauggcugguucagggacagugugugcagcaaugagagagguaaaacugggccgugugaauacugugagagugguuuccaaaccugaguuacacaguuauugggguuuugugggauuuuauuuuguuuuguuuuuguuuugcuuuuugauugguauagggaaaaaaaguguauaaguucauaaguauaaaauuaaaucccacuuaguuuuacaucuaauuaauuacccuauugaaaaagaauacaagaaauggagaauggcccagaaaauguuggccauaucucuuugaauucugacuucuuucugaaccccuaauccauauuucagcuccauuuggauggucuucaggcaucucaaacucaauacguccaaaaguaaauuccuuaucuucuuucucagcccuccaccgaugcuuguucucauaguuugggauguacuuaccagcuccagucaucgugguaccucgcaccccucuuccuccucccauguagcaagucagcugccuccuccuaucaagucucccugucaaaugacugccugugccacacuccaugccagagccucugccuuaauucauuccuuuguaauuucucccaagccaauccuacaauauaaaguucccaaucagaguuagcauacauggucucucuugauucauaccuaacacuagccccagccccagccccacagcuacuuucacucauccucccacaacucuauaccagccuuugaacaggccacuccugccuucucugccaagcaggcauugcuucacuauuuaagacuuggcagaaauguugcccuauuuguggaauguuuucuaaugccaccuaucuacuuagcuacucucuucucuucucugugucuucaaagcugucaucugcaccucucuugcacaggauaauuaucugcuugucuuucuuucucuuccgagacuaugauugcaucaaagacaagacugggccuugaucauauauuucuagcaauuaaucaaguuccugguagcuaacaggaauccagauguuuguugaaugaaugaaugaacugaacuuaugccuugggauaugguaauaacauguucuaaguaaccgaggcacuuagccacaaacaggaaauaucuaauagcacauggcuugaguagauauuaggggaucuccuuuuaccccuaaaccugugcacuauugggccauuggguccuucuucuuaguucuuucuuuucuguacuccuccaggugcauuacuagucuuccuuaccuucauucucucuggccccuuacacguuuuuaugaacagauauacuuuucuuuaguguuucauuuuuauuaacagccuucucugauugaugucagaauuuucacuauuaccaaccaaacacucagucucaacccauauuguccuuuccccuuaggacuggugucaggacaucauaguucuuccucuucuaaaugaugccaaagagcuauguuauuauaagcaacgaagcccauuacucuuuaauaaccucuugaucaccaccccugccagccuagauuuggggcugacuguucuguguugccccuacagaaggcagcugaaauucccaaugaucccagccuguguacagacaaaacaugcagaaagccccggugauccacuggaacagguucucuccucugccagcugugcugcaggacagccaaccagagcacuaaggaucaguggucagcugauggccagcacuuagagcagccccagguguuuagucuggaguuuaguucuuccaguugaggucgaggagggaagccacaugugcccaaggagaguaugagacaaauugaaggcaaauccuccuguuaaaauugagucaaauaaauucaucaugugacaugaugacagguuuugcuaaauaaggagauuugggguugggauucuccugaaguggaaaauaguaaaaauauuaauagcaaaaagauaaaagcccucugugaaaaucagccauagauugagaaguaguuguucaucagcauagaaaaguauucacgauauuguaagugaauggaaucugcuuuuuuccuucugcuccaucauacauuuauuuugugugcuaauuuaaaaauuauggcaccaaguguuguucuucuguggggauuacucuauugcucuuugacauucuuuggacaccagaagauuuggaagagcuuugauguccuuuuuuauaauagagccuugggaaucacuuaugaaagauuuauguugaugggguguuagaauccuugagaagcuaauuuuaacugagccuucuuaacuaaaaauuuagaaguucagguuuaaucauaugauuaauuuagugcuuuaauuuccuuaaucucaugcuuacuggaucaauaacuguuuaagcaagauuaagucuacaguuaguuggcuccacccauaauacccacuacuaagagcccaugccuuugucuauguaguuuuguucauaaccccucaacauuuaccaguccaguagcaccaggccugaaagcagcagaaguacuaaauuaagucaagauaauagaguuagaacuucaaguggucugggagccagagggcggggagccuugugaaagugauaauggaaugugaucaugaggagcuauggagggugccauauggugguugaaauaagaccugcaugccagugccacugguugggugagcuuuggucugucuugagguagaggcuaugguuccuguucccugccagagggcuggagggcuggcugcagucagugcaacagggggaggaaaaaggagccaaggaggaaaaauggcccccugagauugaggggagacauggcacggcuauucauugucccaauuuggaacuuggacaugauaaugucuugagaggacugugauugaguccuugagauaaagaccaaaagagaaaaugauauguuuggcucuuccucguucagccacuucucccugacuucacuucucugcacccaacccuugcauuacuuugucuguauaucuggaugccaacaccagugucuauauaucuauagaucuagguauauagauagaccaaaucacauauugaaacaacagcuaaagaaugcuuggaaguagaugcccuugcccuucucccggucauacuuagaauuuguuuuaaccuaaaguuguggagacagacuugaagggagacauccccaaccuugcuaaaauguaaguacgaaaggcacaaauuggauggauauugaugauguuguuucuauugugacaucauccauagacuccuagugucuuugcuuugcuucccuauagugaucacaacauaaauuacuugucuuguuugacuuccuuguucaccaaaguugagcagauuguggccguuuucaacgcuucuaccagacaaaaagcuugggaccauuucucgaaagcccagcgcaagaacauagacauuuggcgaaagcauucugagguuggugauuuuauuauuacuuuuuaaccaccaucacacagcuggauuggcagagaauagcauggcugcagccaugaugguuucuguuauagugggcaguccgccugccauugucugaucucacugucagcuccaaaugcagcugagauuuguuccuuguccagaaaagcagcugacuuaacacuuagggaacacaguguuuuucuccccugcaaugggagaaaauacuuuuucccauucauaguaaagauuucagaaauaaaccaagacacuuucccuagcaaauuauuuugaagaaaaauggagcuuacaauagaaaacuggcuuuuaaauacagaggguuuuuuuuuuuaguguucuacgugaugaugacaguuugcucuuuggacaaguacgccuuuccguccauauuuucuuaucauaagcaacaucuuagucccuaugcuagccauuaaguccuauuacacuucucuccagauccaauguuguaaggggagugaauaucuaggccaacuggguccacccaucagcaaccaugcaugugugaagugaguaucuacccccaagagaacagucuagaauuugaccuccuugccacuuagaaggaccaaaaugugucauuagucacuggucguccagcuguuauuuuuaacuccacagaguaguguacgcuuugaaccuguaauuuaaaaguaaguauacugucuuugcuucuuuuuuuuaaugaaagaauguuuuucauuuggaugccucuccaucucuagcauguuaauauuaaaguucucuaaaugacauuccccucuuucaaaaucccaaacuuauggaagguaagguuuauuuauuuaaugauuuuggcuuacacuuguaaaauaaguauuuuauauagaguuugaggaaucacaaaguacuaugauaucaaucauuuggguagcauuuuaagugcccauuaacuaaugcuaaauuacaguugaauaccaauagcacuagauguaauauccacaugaauaccaaaugaauucuuuauuaucacuguuauuauggugaauaccgaaugacuucacaauaaugugacacuuaaaaugcuagugcaauuuauuguuaagaaggacauuuuuuaguuuguucacuaaugccuacggugguuggugacugauacaguucuguuuuucuguucaggauuaugaguaaggaagaggugggauuucucuuuaauuuuucaggggccagaaaaaugaagggugcuuaccugauguucucccugacucugacuuaagacugaggucaaggcugauuuucaagauuaaaaaaaaaagaguccucuguuugugaugcaguagacaaacugaggguuaugaaaacacaaauuggaguccauaaacuaugauucagauuugggaaugaucagucugugaauuauuuauuuuuucacauaaaaaccaaacaugauuaaaaggaauguugagagaaaggcugguggccugcugccgaauaaaccugagcauaaaaaggccaucauuagaaugugagugucagcaaaugucacauauugaucugaaucacacuuccugccaugucugccucaacuucucaccuucgcuuaacccugccuccucugcgugggugugguggggagcaggacgugugaaggcuuccaugcaggucuaaggagccugcuugcuuuguuugguacuaggagacagaaaugaugcuccagaaggacagauggagugcagcugucaaaggugcuccugcgaagggucuuuuugccuuccugcuacuuuccccaccucuuuugauauacauuaggccacagaauucuaaauuagcugugauuuucucuugcaugucgcugaauugauuaaauaccaguugguaauuuaacauuguggaugauuucucaguugcguauaagcuugauaauuggcuugauuuuuucccacauucccauguacagcaucuguuaauuaucugcaacaccucuacagauuuauuagaguguacuagugauuuaaugcugaaccagaggcacccuguggaaacacccucagcucuuuuuccucaauuuuuuuuucuuuuccaccacccuuucccacaagaacaacuaccauaugacaguuugucauuaaucgcagggacuaaacaacagucccuuucagccucauuuauucuuuccaccugacuuuuccuuguuucaaguguuaagccaccucuuugggaauugggcucuuugucaguagaaaaauuagcuguccacagccuaaaaauuuccgcacuaaucacaugugacacccaccuccaaugccugaugguguuauuuaagauggaauuggcaccuguuuauucuggguggcauaaucaaauuaggagccuugucugccuucccucuggccucucagggcugccugugauuggugccccugcaccccaccucggaccuugucucucugcuuucucccuucccugucuucugcaagggugauucccaggguacagaguugaccauucaaaugcuguuagcaauaaauacuuuccucuccaucaugcuguaguuaaaaucugugagcuaaggagagaaaagaauggagaaaacccauaacauggagugauauaugcauguccaucaaaugggcacaagucaugccccuaauaaaucaguuguaguaauuuaguuuuauuauuacucauauguuuauugaucauaacaugaaauuauuuuaacuauuugauuuuuauuuagagacuuuacagagggaaaaagaauaauggaggcuuccccuguuuuaaguauuucugaagauaguacauguaagagaacagaaugaauaaggaagaauucacaaauauguaauauacagcuugauacaaaauaauaauauaaauacuuagcauaaguauuacaauguucagauuuuaggcacaguaguaagaaauuuccuguguaauucuuuaaucuuuacaaugaguuuucacauaugcuacuacauguaaacagccuuguauuauuauuccucacuugugagugacuagacaaagucucaaauaaauaacuugauuguagucacuccccuaauaaauggagaaaguaaggugugaucuuaagaucuguggcucuaaauuaugugaugcuaaagcaaccauugcaacaaaaacaguaaccccaacaugaccgugugcaauacgaaagaaagggcaucuguuuguguuuuguucccuaacaucuuacuaauuuugaauuuuggauaucugaauggugugugugugugccuguguguguaugugaucacacaugggcacauacacacaugcaggggcacuauguuugcaugagaaauaauaauguccagcauuaucaacugagcaaaccaagugucuggcaugaugcuaaguacuguacauucauuaacucauuucauccucaaaacuauuuuuaaucauaauauuccagugagcaauuuagguuaauagagaugaagaauccuuccuaaugucacaccgugugggucagugguagaacaguccauuuuaaaauuccacuguucauguucuuaaccauaauuucuaaguccuuacuguacaugugccagccauguaacagguauuucuauguaaucuuugcagcccuauuagguggauguuauuauccgcuuuguacaaaugaggaaauugagacucaagagagauuaaauuauuugcuaaagagcccuagucaugggugagcagggauuaaucuaagccugaccucagucuccccuguaccccacaccccucagaaccuccuuuagguuaggugaggcuauauuugggagauaaaagcuuuggauucugaauguuaauaugccagucauauauacccaaagaccauuggggaaagccauaugugucugugacucugacauuuguguauccucuacuugcaggagcuccggaaugcucaaagugagcagcucaugggcauccgccgcgaagaagaaauggaaaugucugaugaugagaacugugacagcccuacaaagaaaaugagagucgaugaaucagguaaugccgauaacugccacagacccaugagguaucauaaugaucuuccaaaucucagauggggaauaaguaaauggcccuauaacucacuuuuauuugaauuauacuaaacuuucaucuuugagugacucugcuuuuuauuaauagaacuuuaaacuccuucuugggaacagagugauuuaaauugcuccaguuguuucuccguacguagaucuggggccauuaagcuuuuuucagggauauuugccuguuuccaugaaaauccuuuuccagaguacggcagccacagcugaugcuaaaaauauggauaaaauuugguuuuagucaguguacuucuuacaugggaauuguuuaaucccugaagaagcuuucuagcuucugagccaagaugcuggagaauuagacuucuuuucccauaaauguucuuucaccuaaucuguaauuaaaaggcuggccccauuugguaccaagcuaggggugucacuccuuagguuguacaaagaagagaaacuuagagagaaccuugcuuugugugcucugucuaaugggagcugcugauuuaaaacgcucucauugaauuauauauaaauccauugguauuguaaaaacaggcaagggaaaagcucauucaaaacaugagacaccaagggagacugcuugucugauuggaaggguguuguccgaaggaccuaggaagaaccauaauugccaucauucccaaaaaagaaaauuacagagaugguauagauuugaucugucuccucauguguauaagugaauaaaacauacaccuguuagagacuuuuuaacagaaagauugcaggugaccaggaaucgaggaucuuuacuaauuuauuaagaaaccaaaaucaagauucuaaaaggaucaggucaccaagacugcaaaguggucaggaugcucuguuucuccagggcuguagaagagaauguaggggugcgagugauggucauaagaaaaagcuccugccuacaggcauauagagaaagggcucuaauuucuuuaaagcagugguucucaaaagugugguucucaguccaguagcaccagcaucaucuaggaacuuauuagaaauguaaguuagcaggccccacccaagaccugcugaaucaaaaacgucuaguggcuacaggguguggggaagugaaguccagcaaucugugauuuaagcccuauaggaaauucugaugcaugccaaaguuugagaaccacugccuuagaaacuuucccuuucacccucaaauucauucauuuuaaucuuucaggugcuuaacauacaaguaggcaccaugccacuauuuucugaagccauauaucccuugucugaaaaaugaacccagcacuuaugugucaaugauguaugucuccugcuaagcccagaucagauuccucaggacugcuuuacucuuggguuuguuuauuugaggagaccaccuuccucacaggauuucuauucuacaaaccuucacauagcaaaagaagggggcaaggauuugugugaauuucuuaaguucaacaagaucuucaaauaaagaaauaaacuuuuuuuuugucaaaagcgcuuucauccuuugugaagcuucuggaugagaggcaaguugacaugaaacuuggauucuuaauauccugacaagguagguguaggagaaaagaacugcaucagucagaaauucucauuugaaccuguggcuuuuuguuuugucuuggugauguuucuuuuuaaauaacuugucaauuucccaaguaagaauuguguauaauuucauagucugcuuaggauaggaccagaauaaugaugacucugaauaguaugcucacugaggucuugcggcacguacaugcuuauaggaucggggcccggccucugcugcagaagcaucgacggagaugugaucccccgacaccucucucgguuuauuccccaggcaucugaugagaacgugaaguagagccugaacuuuuaaaaaaaacuuucaccagucuuguuacuuggucagcagaauuaaugagcaaagugcagggcauguuguaugccaaguucugagggaagagaugaaagaaccggaguucaaaugccaggccccgagcaguucaaagucuuuucgugcuuuucaaaacgagauggaccagagaauguggcaugugguuucugaagaaagcacaggacugauuaaagggaaaggaaggcaacuaaccuuuuuuauuccacggggcccugaagaucuggcccaaaggcaggcaguuguuuuucuuucagcccugcauauuuggggacacagccugacagcaagaauucccaucuggucuuuuguucaaaccucagacaaaucccugcuaacuguugcuugaagcaggaggauggaggccauagcccgagggaaacaccuuccagcgguaucuucuugggugacacaucccuuguuuuuagguacacauuugcaucugccagucaccuacauaggagcaguccucucaaaauguagcacucuaauucacuaacaggggaauugccagugcuguaauggaagugaaauucuccaugcuguaaggaauccccugccaauuuccucucugcuuaaacagugggauuuugcuucagaccuccuggguaguagcugacccaggaauucuuggaaauuccagaagagaauauccuucaguugucaccugccugugccgggaggaggugcugaggcugcacccacugcagggcgcucugucuguggucccccagggccagcuuugcuugucaucuccauacuaagacaaaaaguacccuguaauggguuuuauuuuggggggcagggaagagauggaaauaauugacuuguuugguuuuuaggaaaggcacaauuuauuguguaaggacuuauaugauaccuuggguuuacuuuuuaaaaaauaaucaaaauguuucaauauaucucugcuuuuugguuaugaagaauauuucauuguacuuuucuuuuuaccauauauaauaauuugcaauaugucuuuggcuauaauucugcaguaucuacaauagaauucugggugggguguucacucuucuugaucaguugaaucuuaaaggggaaaaggaguucacuggagcaaaacuaagaugcugauaaaaaugaaaaucaauuuuguuaauaaauucaaaaauaaugacagauuuauugaagcauucauucuagaagaucggcauccugcucugaagccugugaagauaauuuuugauaaaaauucaaauuuauuguuguuuagucugccuccuacugaaaugaagccagacuuuaaaauccagaucuguucuuccuuuuucucuuucucucucucuuccucccucccucucucucccucucuccuucucccuuacccuuuuccacucccuuccucccucucucccuccagguugacucuguggggcgggauagcguucgcaagaaauaaaaaggagaaaggaaagaggaaggcuguccuagauuguaaggccucagauggcaaaacccgauacguuuuaguauugugagaguuaauaagucaaugcaugcaaggcacuucugacuuuacuuacaguguugagcaucuaguaaguacucaauaaauguuaacucugcuuguuaucuuagucauccuccaacacguggcccugggccuuuccccaaguacguaaucaauaaaagucuguggacuucaauucauauuccccuucuucugaucuuaauguuuucgaugccuuugucccagaaguugauaggaggaugauaacccugagaacauuugcucuaauuaaauugaaauggcaaguauuaaagaggcauguucaaacaaaauguucagaacuuuauacguacaaaauucagugucacauggcgaacaggccauggcccagagagcuuuaacccagcacuguuuugauuaucuacauuuuguauguccaaggugcuguggacccagggcacacagaguuaguuagauacaggguacccaguucucuaggguguaagacucauuugaaaaaaguguuuucaguuaaaaauauuagggauguccuaaagcugguaaauuaaauuuauuauaaaccaaaaugaacaucacuacauaguguauguaccucacccaauauuugaugaguguacuuugaacacaaauguuagaagaguaaaacuaaaaagucccuugcucaguagacaaucauuaugccuuuccauaauacacaaacaaauguuuuuggauuuuaacugcauuucauuuaaacucugagcuccuuauaggagcagacacucuaaauuaugaagaguguuuuucugagcugucaauuuuucaugaaaauucaccauaacauagguacaaaggaauuuuuuuuuuuuuugagacggagucuugcucugucacccaggcuggagugcaguggcaugaucuuggcucacugcgagcucugccucccggguucacgccauucuccugccucagccucccgaguagcuaggacuacaggcacccgccaccacgccuggcuaauuuuuuguauuuuuaguagagacgggguuucaccguguuagccaggauggucucgaucuccugacuuagugagccgcucaccucggccucccaaaguguugggauuacaggcaugagccaccacgccuggcccggaauuuuuuuuuuuuaauuucacuaagaauucaaacaaggacuuuccaaaucuuucagccacuaaaucaaauuaggaacucauaauuagguuugguuggaacuagcaguaucagccuaucugaauaguuauauauguagcuggaagauuuauguuaaaaaaaaaauaaguaauaaaaauaauaauaauagggcucucugaccaucccauugauuucuuugaauagcaggacaaccuauuuuuucugauuaaguauuuucugggugguaguacuucugaaagauccuuaaaaaugcccaucaggaagauuauaaucaggcacaagcuuaagaagaggcucacuguuaccccaucaccagccaggcacagaagaaggagaggguuacuaaauaccagaccagggugcagcagcugacugaaggggccaacugcaaggggcucugucauucacacugguagaaacuuccuuuuaggaagcacugaauguaacugaaagcaggcucacccgagauuggcucagaacuuggcagagggacaagagaauucagacacugaaagugagauggcucagucugaggccacaugccaggaucugagcuccgggcgccagcagaccccaagggcaggggugucuguguugaguggaagcauagaaggauaagcuguuuucacauguaaugacagccgagggcaccaucuccugaaagagaaauagaccagugggguguguccaucacugaccacugaauuaaagacaagcauuuucucuucugggaacccaagggggccaaacaaggaaaugugaugaaucagaacuaauguggcuuaaagaugauaaaagaaaucuugcaaggugggcugaguagccugcuuucuuccuaaacucuaaacagaguuucauuugcaaaggagccaaggcuuuccuguuucuuuccuuuuuuuuuuuuucuuuuaaucuugcuaaucuugcccaaggaauucaaauaaauauuuauuuuggguggauuuuuaaguucccuaauuucaugugcaguuacaauucccuuuccguaauggauaugcuucugaaaaguguagaauuuuuuuuuuuuuuguaaauugcuucaccuuuuaaaugcaggaaaacagaugcuauuuaaauugauccuguagcagaagauuccauuucaauggaagcacuccuucugcccaaccagacuguguuuguuuuguaaauucacacuuggagccuaaacugucuuuaagcuuagccccuuuauaauccuauuuuuauguagcaccuaucaaugccaugauucuugacaucucucucauaugugcacaaacuuuccauaaucugguauuuuauguaagauuaaucuguguugcugacauuggugucuacaggaccaaggacuuucccuaauacucuuaacuacucaacugugccacaccucggugaaauucagcugaggccuagcugaaguucuuaaacaauccauaccuguuugauccuagcuuagaccuggguggggucuccacaaaguuuccugcaugacagcccagcauguucccagcuccugucaggcccuggcuucuugcuuagugcuaugagucccuugagccugguggagggcuugagcugaugggcaguuggcagggagaggaggagaaugaggacaugagcaaccaaucuucacaaagggagagccacugacgccuugaccugggaaagguuaagacgcaugaccagggaguaguacagggucacugcaccgccgccugugugcagcccaaagugcccugaugcuuauugacugccaggaacaccauuaucuacauuacaguuuauuauguguucugggcauuucauuccgguaagguuugaugcaggaucauuacauaggagaguggauuuaauccuguuucuguagcaggcuugaaggacacugagggaauauuuauguaauaagaugcaaaguugcuauggaaaguacuauagcaaccuaacgucuuagcagagccaagcagccacuuguaacagcaauccaaauuuacauuuauuuuagugucauuuuaucgacacucuuaguaucucauucugacaggauguuaaaauauguuuucagcuugcguuugagcaaaauuaacacaguguuguuggaauuuaagugcgguuugcacaacuucuagaaaaaaucaggauauuuuuugaaggaguuuagaugacagaaucugggcaacuuuguaagcuuuuuauuguuguuguucuuuccuaaacacaggagagaauucuucaguagaauuuauuccugauuuuccguuuucauuuauaagcaauacucaggaaucucugauuuugaaaaacggauuacccuuuacaacaucgaugaauuuugucaaaugcucaccugugauucuagcagaugcucauagaaaacacuuucaguaggucaccucauugcgcucuagcagcauguaacauuuuaaaaaaugaaaguuguuuuuugaauaaaaauaauaccuggucauuuuugaaaaccuaacaacuaagaauaaugaauaaagaagaaaacaaaauuguguuauaacauuacagaagaauguuuuggcuucuaauuuuuuucuuuugcacaguuaacuacauaaguauuuuuccguguauuuuuuaaggcucaggaauaaaauucuacaugauuuugguuucagacaagaguccuuguguaacaagcaagccuuuguuaaaaguuuucuuuuuauauauuaauggaauagaaaauagagaacaaauaaguuuguauucuuccuggaucauaggcucuuuccuguggaccuuugagagaugaagcuaaaaucuuugagguggucagaguagauuccugagguuauuaaaagcaugguaacugggccagaccuuccaaaggcaucuuuuaggucccuugaaugugaguauggcagagaagcuauauauauguaggccaguugguaguggaaaaauaguaucuauugauuuucuucucuaccucuccaucugaaaucuugaagugugacuguaacauuguuaaaguaggacacuggccaaaagaaucaguacuaggccacauuaaaacauacacuguuaccagccucuuagcacagugaugugcuguugaugaacaucauuguccuaauucuccucugcuuuuauacuguauuguucaucaaaacacaguaggugacauaaagcuauuauaccuugacuccuaacacuguugcacaugagcuucguuaaucgaagacuugaagaugcuagggauacugcaugaacacagaaaaugaagacaggaugaugucuuguagaauucuaguaaccguagguaguuaagagccacauaacuaauuuaaaaaguaaguacuuccuucccuuucuuggaaauucuacuugccauuauaugauacuuagaagcccuggaaauugaaguuuauaggaaauuauuauuauaguaagcucucccacaucuaaauggcuuagagacccuucucuuucacuugacugaaugcucuugauaucaaagagggagcaagagcucagcaacucuucuccccaguuccaggacacaaugugugaagccuucuaggaaguggcuagagaaagaaaauuuuauuuuagacucccaucacuagcagagaaguaggaagaacauuucuggagcaaaaguuacaagacagagucuauuaauuguagcauuuccggcagggcauugcagggucuuuaaugagcccccuuuaaguucuagagcugcugugucccaaaggcccuugcuuucuacuuggggcaugcuggucauugcagcucaaagcaguuaccuaaauuaucaguucucagaauuaauuuagaaacaucuaaacauugaacacuaggguauugauuaauuaauguauauccaugagcagucuugaaagaaaccaugguuuagacuauauaauggaaugaaagaaaguucucaauauguugugaagugauaaaagcaguuacaaaccagcauggauaauuccaauuguguguguauguguuauauucacaauuuauguuaggggaaaaucugugaggauauaggucaaaauauucagacugauuaucaccagaugguguaauuacaagugauuuuuuuucugugcauuucaaaaaugucaauauaugcauguauuauuuaaauaauuaaaacuacaauaaauauuaauuuauaaauuaccuaggagaaucuaugaaaaaauccauguugauugaggaauacucccuagacauuuucagucauucuggaaagucaagaauaguaaggaauaguaacuaguaucagauaaugauaguuuauugaauugccuucuuuugcuuuaaauuagggaauuuccacauuuaacucaccauaauaugcuuaccuucccagaccacauaaucuuauaauuucuuauucuaagagcuaaucauauugguauaaauauuaaauaauggauccaagaaauaauucaaguucuaaaccaggcagaaauguugaguucuuacccacagagagauuggcaaugaugagaaguuauguuauuuacccaagaucguaaguggaaagccuagagcucaauacuagcuuucuccuuuucagguuaaugacccuguuauggcaccaaugaauuuuaugggaaaaggacuccagaaucucuuucaaaugccuucagugauaccauaagagucaguaaccaaauaaaaucaacgaaggauuuugagugccugcaguguacauggugccauaaugccuuuuagaggcaaagguagccuggagaugcuuauuaccuuaaaauguuaauccagacaaagccgacuggggcuucugcuuggucuucccgucauuuucuguauuuucccacuaccuagaaggagauuugcuucaauauaggcaacgcacccagcaaacucuuuuuaagcccaucccaacagaaaugccacccuuaaaaauuauucuggaaauugguaccacccauuugcuaauugagugacauuuauuuccugaaagcagagucugcuguauggcuuuagacaagaaaaagaagaaaagaaaaugcuuugaagaggugaagugcauagggauguucacugcuguguuauguguuuccuuugguaaccauacacacugucacaacccauguuuuccauuucauaaguccccaaaaagauaaagagaaaaaugaagacguuccucaaaccucaggcacaugcuugaugguugaucugaaaugaucugagcuacaauaucagcccuuugauuucccaucucaucccauguuuucuuugcacccccagggucugggagagccuaccugaggaucaccaguuuauugacucaccaucuaauuucaagacuuauugaagugccucucccuguuucucuauucccgaggcuuuucuuuaugagaugugccuccaauauagcuuuaaaauaagagucugagggaccucaucuacaguaauaucaaucuucuugagauucacagacucagggaaauucugaucuuggaaguaauaugucuucucccuucccccaauguccuaaauuaaugagaaaaaugaauuuugguacccccaaauaaugaucaggugagcugcugaauaaauacaaguuuauauuugauacuugugauuuuuuugugauuacaaguuuucaggcacaacuuaaucuacaacauauauuuagaagauauuuuggaaguaccaugagagauuuuauuuuucuuguagugauuuaccagucaguuguuuaugaaaugucuccacaugcaauacuagacuuuucuaguguaguuuaucuaccgagccuccuaaagccauccauuucucuacccuuaauccuuugccuccacgaauugucuuaaacaaugucauaauacaaagcagugauaaaauuaaaacaacaaauauucaguaaauucucacaaugugugugggaccauauccuuugucuucuuuacagugccagauuaaggggaaagaauagcuaacaaagucuugaaagacugagacacugacuuggaucugaaaggguugcuucucuccucugaaaaauccucguagcauaacaucaguucggcuuuucuuggaauagugucagaucacagguccucacagucucugcccacugugcccuccgaagucauagccaaaaacuaguagauaaacucuaacauaaagaagugugagagcauaaacuugaacauaaagaaugcccagcccacuacauuguacaugguaggggggcaagauuuuguuaaaugaauggauaggaaauuaaaacuaggaagaacuaauuuuuaaucuguugggggauauuuuuuucauuuugaagaaaaaaaaaaaacccuauuaccuauuuaauccucacaguacugacuacauuuuuuggauaaggacccugaggucucuuggagguuuaguuucuugcccuaagccucauagcugguaucuggcuucagagccccuucucuuucucuagcacuccugugccucucuccucuauauaauccacguccacucgacucuuugagguuggcagggguagauaugugggaugcagagcacuauguuaugucgagugugucucucagggugacugugccucagacacacccaguaguccccaaaguaucaccuguguguggugcccccuccccucuguggaauucugcuuccaucauuauauaucagacacucuguauguuacucuuuuugguaggaagaaggugauguucuuucaggucauuaaaaugugggggacuauggcaagcagaaggauggggcuaagaggaagaugaguaaaugcuuuuuaaacagcucuaccuuuuuuucuaauugagaaacagagcuguuugggcaaguuuaugaggugaccuugauugaauuaaagagguaaugacugaagcuuuuuucuguagaacuagguugcaauuuuugcaaaugauaaacuauauguugauuuaauuuucucuuucuuuuuucuuucuuucuuuucuuucuuucuuaguaauugaaagucauuggguucuuggacuuugaaauaggaaauaaaauuuaaaauggacuuuuugacccuucuacguaacacuuaggcuccuaaggaauauuguaauugaugcuggaucaucagugucauguuaacaaagcacuuuagaugaaacuacccauagucccuucccucucauguucaauaaaaagcuaguaacaagacagcugccuucucagaggaauucuuuuaaccuuucagaaacaaaauauuuuaugcuaauuucugcuuaauuggaaggaagucauuuuuaaaaaaaucauugaauauggguuugaagucuguuccaucgcugaccucuuuaauucaaucaaggucaccucauaaacuugcccaaacagcucuguuucucaauuagaaaaaaagguagagcuguuuaaaaagcauuuaguguuugauuaauagugcuuaacuggcaccucagcacuggcagaggcuuuuuuuuuuuuuuuuuuuuuuuuuuugagauggaaucucgcucugucaccaggguagagugcaauggcgugaucucggcucauugcaaccucucccggguucaagcgauucuccugccucagccucccaagcagcuaggacuacaggugugugccaccacgccuggcuaauuuuuuguauuuuuaguagagacggggucucacuguauuagccaggauggucucgaucuccugaccucaugauaugcccaccucagccucccaaagugcugggauuacaggcgugagccaccacgcccaguugcagaggauuuuuaaggaggcucugguaagaauaaaacauugcuaccugaaaaacuauacucaccagaaacgcaaaacaaauuuuaaugaacaaagcaaaaacuguuuuuuuguggggaugugagaaagguuaucaugcucaauauauagaggguuuaaaugucugaacaacucuuucccagggaaaaauugcuguaauuuauccauccagacaguuuauaaaauacaugcauuuucccugcccaaggacuccaagacuaaugcugaguuugucaaagcaagauuuuguggcacucgaacucuggggauaaaaagaagugaugauguguccaguugaagaaugugaacugaagccaucugaaucacugaaauauugagaauuccgaaaauaaguccuuggcuuccuucugcguuuccucuccacugucgggccuuacuaagcacugccaagcucacuaugauacucucuuuggaagagaggcucaucugggugguaagaguguuagaauggcucugagaaagggaccucuaugagugagaacaaguguuguuggcagggggaguuuagagucagugaguacaguaaagaaguaacuuugagccuggguacagugacucacaccuguaaucccagcacuuugggaggccgagguaggcggaucauuugaggucaagaguuccagaccagccuggccagcauagugaaacccugucucuacuaaaaauacaaaaauuagccaggugugguggcacacaccuguaaucccagcuagaugggaggcugaggcaggagaaucguguaagcccgggaggcagagguugcagcgagccaaggucacaccacugcacuccagccugggugacagcgagacucuggaaaaaaaaaaaaaaaaaaaguaacuuugagcagaugaggucagagggcccuugaaguaccuugguuuuauuucuggcauggcuuggcaaauaauaucccuucaccaagccucagcuuucucagcaaugacaugaggcucauccugagaguuccucaauaagacugugagaaauaaacaauuaagggauucuguggcauuuugcaaauaccaggcacuguggcaauguggagaguugaugcugguguagagcagaaggugugaaugugugguucacagccccgucugcacaugagaaucaccugggaaacuuuauacacauaccaauggccgcagguuaaugcccaggcaucgguguuauuaaaacaguccccaggugauucgcugcacaaaggauugaaaaccacuggccuguaaugugaggaugauggcugucauauagugcuuaacuggcaccucagcacuugcaaaggcuuuuuaaggaggcacugguaagaauaaaauauugcuaccugaaaaauuauacucaccagaaaugcaaaacaaaucauuuuaaugaacaaagcagaaacuuuuuuugugaggaugugagaaagguuaccucuuuucccaccuauuaggugggaaagaaggacaaaacggguugaggugagguaaaguaaugugggaaugagaagaaaacaaaaauggaguaaaguauaaaaaucuguaguggacaggaagugacugacauaggcaaugauaaaggagcaaagaaaggagaagugagagggagguaguuuaaguggagcgugugagacccagguggagaaguccccucacaggucugugucgggcacauuuggaguauccucugguucacuggaaaaaagggcggcuugaaaagggagggcaaaguguggaggguggccugauaugaguggugaugcaagccaaggacagagucucugccuuucucuaccucuaggagaauagacaggaacuguuugcucauccgucagcagugagagagggaagcaggcaugccuggccacucgccaaggagaaaagccucugcgaaucuagagacuggugugguaagcauguguacaugggaggggccuccucucccacagugaaaaggcuguucccggggcccggucaagggcaauuaguuccagagguucagccuggccucuccugggugcaagccacaagccugccauagcagaaacuuucuccagacauauggcugcaaagaaaaguaaugcacaacaacaucgagcaguugaggacaauguguuuuggagacacugccuguaggauuuacgcaagcauucagucacagugucauuccuggagaggcaggagguagcauucagcaaggagcaggccgauagguuaauggaaugugagaagacauggcagaggcagagaagcccagaaggcuguguuggguuguaaaagcaggagagaagguccuuucagcuguuggaaaaggcugaaagaaagcaaauaugaaaaacuaaugaaagaaaucuaagacuagaagaaagucaugaagaaagcauuaggaaguggggaccuggucccuaaaggccagggagguggcucuaaaauguuggcaugcaucagaaucacccuagaaacuugcugaaaggcacaucccugggccccauuccagaaucucagauucguaacaucugggaugagucccagguuucucauuuaagagauaccaaagugguacagauaccucaagaugccagcuaccuguucauacuggguccucccaccuugguuauacauuuagagaggaugcagauacuuucuauccuauugccagacacaaguaaguguucauaagucaauuucaauguugguaaugagaacaguggggaggaggaggcucagagacagcccaagcagagucauugcccaagcauaaaagugaagucuuggugcccacuuacuagucuggauaguuaggguuuaccuaaggcggaaguaacuuucaaaaaaaguuuucuguucaacccauuauugcaaguauuuggcacuauaaaauaaaaacuuuacaaaaaaagaugcuacuccuugcaaagagcaaugcauagaacugagaagauauacuuuagguuugagcuggccaucauuucacauuucauaguguggauguguuuuauaugguagaagcaccaauucaaauacuaauauaacugugugugugcguguguguguuucuauguagaggguagagcaggagaggggaaauacacuucuuaaggggaaaguuucuugaugaaaauuagaaaugaccacuuguuaaaaaggaaggacauuuguaagaugggaggaaaaagagaucacugcuuuuauacuguagauuggugagaaaaugagaggaguuguuuuggagggaaggauugcuguuuaaaguuucugucuuuggccaagaccaacuacugucaguuaggaugaagucacacagagccaagcccaugguggaguacuacacccaagggaggugcacugucugcaggggaggggguacaauuccugaaagccagugucauuuuauugucuagcuuggcuuagcuaagccugacuuuccuaaaaaagaaucuuuaaagccuuuagaagauuuuuuuuaaauggcccuauaaucuuggaaaucaaaauagggacugaaagugaaaaagaaaacuaaaaucgaauuaaaagaaaaggaagaguggggaaaagugcccccuccugagaugcuccugccuggccuuggggcucaguaggaagcagccugcucgccucuccauagccauggcacauccuccuggagaucgccgaaucuuuugguaaagcaguguccacugugcagcagucccacucugcuuuccuucagcuuuucaaugugugagcucaaccacugccuuccauaaagagccucccccagcucuuauguuccagccagaagccuucucucccuuauuugacucccacuacacagugugaggauggccccuccuggagcccuucuaaccaguuucuaccagguuccauaucuguagcucuuccugcggcugggcugggagcugcgcaggccaggcugggcaggggcugagagcucugcuucccugcccuguccccggcuuggcuuagaguagggagcucagcucaugcuugcagcguucacuucugauguguuucccggaggacucuaaaggcauccucaccugacagagcauccuucaacaguguuuuaaaugacagacuuauccugcuuuugcaagaagugaacaugucucuuuccuuugcuuauuuuccucugaggaaaauggggaugguuuugggucggagcagaggauaguaauguaaauggaaaagugaugaggcaugaugugaagucuccauaguggcagcagcccagcagcaccuccuaguucugcugcuggugcagaguacuuccucaggaagagcucucuggaggaaggagcagagaauuuuuuuuuccugagucaccugcugcccauugugccuccagacucacauuuaagccaucaucguaacaggaucuagcuuacccugcacucccgaaauuacccuuauuccgcuggccucacacaaagauggaaauagacacugcauugugcuucuguuuagcuuucccuaauaauagcuaaugugcagauucgaauacacacugcacauaugaaauguuaugucaaugcuaaguuguaauaauaauaauccugcaaaaauguagcagaagaaauuuccgugagcaauuugaggaagauugaucaguggugauacagguauuauugaaaagcagaucaauuguacuuuguugguaccauaagaggcucuccagcaggagacuggcuguuggcagaugucauccuaggauacuuuccagcucugugccuggccacugggaggcacugauggcaacagcagccacugagaaugaggcuaccaaugaugaaggaccccaagccucuguuaaucuucugacaugguacugguccuugucuuuggccuucauuagcccaagcaaaguagacucaggggacagaguucaugggaggucagcauaacgcagaggaguuucugucaccuuuauucuaacugaaggcacagacaccuuaaaaaucaaacauaggugaguucagauggauggggugaauagucucauacuggaucuuugggaauccugagaucagcaugggucuauggacaaaacucucucaauaaagcauuauuagcaacucaggcucuugagcucugggauuaguggguaucaguguggccguuugagaggagagggacacagggcagaaaguaggaucccuaagugguuccagccaggccucaagauuuccugaagagugaguuuaacuucuccauaaaucauccccaaguuuguccugcagaaaauaccugcauguuuauuuuaaaacaggaucauccucucugcuuucauagcagagucucucuccagcagaacacuccccagauagagccagaaauugaauguuuuacuucuguuaggagcaaacuagccacuacaguagggucccugguuuacuccuuucucugggaugggcggcacuuacauggagcuaagcuagccugguggcauuacauggaggaauauaguccuagagccacaccuuuuaccuccaaccagcaaccucugucucccauaaacucacuuccaucaucuggaaaauagaaauaauaaucauauugacuguaucauguuuucaugauggugaaaggauacuguguaaagaauaugcuuaccucagugccuggcacauaaaaaucauuagcugucacuaccacuguugcuauucccauuacugcuacuguuauuugaagaaagcagaauagugacugugccuuuugcccaaaucuuccauaggagauagccagggcacggggcaagcugagcucaugggaccugggcacagggaugcaacagggcugccuucccaggugcagaacauggagucggggcucauacaaaaggagaucaaggaauaaaaccagaaugacaagccaagcaugugguucuuucagaagcauuucuccaaacaagccaaccacaaccccaguuuaggaaucgggauagaaugagcagcggucugagcaguggcucucaaaguguggucucugcaccagcagcaucagcaccaccugggggacuuggaagaaugcuaauucuugggcuuccucccagacaaacugaacuggaaacugaggguagggcccagaaaaguguguuuuaauaugcccgccaggagcuuguaaugcaggccaauguuuggagaacacuggguuagaguaacaccagcugcuguauaaagauggccuaaccaaaaaaaaaaguguuacuuuuugggcacacaacaguccaaggcagauauucugggccugugggcaccuuuccuccauguggugacucagagacccaagccuauuccagcagcaggcagagacugagggacugugcagaaggcauccucacucccccucacacuccauugaugagacugcucacauggcacccucuagggcagucaccucucaggagcaacacugcucuauacaaagagaagcaugaguuugaguacacagcgugauaaugucucugccacagaauagcuucuaaaggccucaaggcaccucacaagaagauucagaaugcagagaagcagauagaagcuggagagagucccugucacugggccauaacuacagcucccuuuccuaguggagcaggaggcaggaucguggcugaggaggcagccguugaaggcacacagauauuguggugacauuugccaggccagccugccucugcccuccuguguucaggggcuaucgguacaacugccuuccuggguagcagccaaugaaauucuugaaaaagacuuucuuugcaugugggaaggaaaucuacaguucagcagcguccuuccagcauuucaggaggacaucuggcaaaguggagggggaauguuaaacacagaguuccccaaacacacaaagacuaagaguucuggagaaacacagauauuguuagaaacgauauguuaaaauguuuuauuauuuaguuacaucuugccugagcaugaaaaagauauuaacagacugucagcuuacugggacauaacccaaaacaacuuacauuuuucauauauugcuaacuauuuuucugaggcuggcucaggcugguaaaagagauuucaaggcuuucuccagauuauuuacuuaaagaaguuaagcauggcauuaucuguucccauggaaacacaguaagacaggagacagaagaggaggucacuuugaccauaauuaauauaaagaauaaugguuuauauagaaucuaguaaagaauauaacaagaugccgcaauaccuuuaagccuuuucuucagcagugccguucaaccuuuggauugauuuucauacauuagugucacuuuggucauuuuuuagucuagugcuaaguuuugaaguauaacaaucuugccuagcaaaauuuuuccaauuuuauuauuucauuuuugauccaaucagaaaauuccaguauucagaauuuuucuaaauuacugaguaacuagaaaugggugacugugcuggccuuaagcuucuugugaaugcuacagcuccucaccauguuuucuuaauaaauacauaaauggguggcuggugaauuaauugaugguaauccagaggcaccacuagauucagcagugccuuuaaaaucaccaacaaaauauuuaaucacauucaguc

SEQ ID NO: 17677 - RNA, 51262 nt, Homo sapiens
gagagagugggaggcguggagaguaggcgguguugcgggccggagcugcggcggcggcggcggcggcggaagccgaggggugggcagggcgggggcgggccgcggggcugggagggggagggcugggggucagcgcgggagggggccagcuugcuugcccggcucgcucacgggucguugaggccggugacaugucugugagcugcggaggcugcggcccccaggugagccgggcgccgacgugcucgccgcggaggcugcguuuagaugggguggcggcgggugugcggccggcauggauggagcggcccggcuccggcgcuccagccccuccgccugccgcuggucccccuucuggcuucggggccgcccgagagcugcgccuucgcauggcggagggaggagggcgggaggagcgcggccgaaggaggaaacucaccgcaccgggcccagaguagagggaggugcugggucucgagacgcgucuuccuggggucccaaguguggcgguggagcugccgccccuuuuaaugacaggcuguuuccauccccgggguggucuucagagacggccccccgggugcguggugcgcgugcuuaguguguguucguggugugcgcacaggaacauuugcagcgguugggaggacguugcacuuuguucccgaacagcauccuucacugucagacccccggagccuuggaagcaggcgcugcucagaucuuguaaacggaaggcgucaaggggcuccucagaguauugauauuuggauuugcugucaaauacucuccuaggcuguuaauggcuuaaggcuggccauaaaguaccccgaauggauugaguauacugcuguuaauccaggcaucuaagcugcuuuauaaaaaauauguagauguaaccgaaguauuaaaaagugacaaugacaguaaaagcuaacauuuuuucucuuccccauauuaccagcuuucauuuuuuuucucugcuuugucugucuucuaaaaccauauaaaguuggaugugguuuagcuuuagauguuaaggaguuucauggugagaaagacugcugagauacauaccuaauagcuuuaguacaaacuggaguuaauuccuguucucuuuucagcuuuucaaucgcuugcaaaaugcucguuuugcuuagcugcuucccacuguuuuagaaaugucaugucgauuguuauuuuguuaugucugaaaauacucaaaauauggaguacuaagaaaaaaugggguaucaguaaugcacagauauauuuuuuuuaaugucaucauuuuaggauggcagcccagugccuggcaugauuggugucaguuaaaauagugcaauugaaugauuuuuuuuuuuuuugaaaaacacauuuacuuuuucaaacgguacccugauuauucauuuuuucuugucguuguuccuccugacaaaacugacccagggguggacagugaaugucacuauuguagcuguaacaguaauuuaugaaaggucaaagaauguaaggaaaucagggaagaaguggguucccaagcugagcuagagacuaauguauguacccacauaacugcaguaucgacaauauugauaagggccuagcaguggacuccuaggccagugauauuuugcaguuguugaggauaugggaaguugccuaagacauggaaccauagugagaaauucucuagccuucucuagcccccugaacuccagggauaagucuagaagcugaagaaguccucuuuugccuuuagaggcuggaaaaaauacgguacuuuuaauuuuuuuauuuuuuaauuuuaggaacuuacugucuggaaaaggaacucaaaccaauuuggacaauauauuaaaggccguuuuaagagaaaaugccaguuguaaauagguagaggaauucugucuauacgugacaaaaaugugaaagacuuagaaaauaucucuuugugaaugggcagaggagaccaguguugauuagaaaaaauuccuucuuacuccaucuuagcaaacuaauuuucagaaguagaaaaauaaauuuuuuggcuggucuucauaaccuuuuggcaaggguuucaaacuuguagggcgugugguguuugguuuuucaaaaguaauugaaguaacuuuggauaggguaacugauuuuguuuuuuuuccugucuuguggucugcauuuuauuaaucaacuaccuggaaggauugaagggugaggacaggucgagaaaagcuuuaaguuaagccugggcaugaguuaagggucaaugagcugguaauauggggaagagaaagaaaaaugcuuuaucaguuuaaaaacagccuggaaagauccaagugucucgauucucccagucauccuuacauauaaaaguuuauuaaaaaaauacuucugggccaggcuuggugccuuacacuuguaaucccaggacuuuaggaggcugaggcggguggaucacuugagaccaggaguucaagaccagccuggccaacauggaaaaacccugucuuuacuaaaaaauaaaaaauuagccacguguuauggcacaugccuguaaucccaucuagucgagaggcugaggcacaagaaucgcuugagccugagagaugggagauugcagugagccgagaucgugccacugcacuccacccugggcgacugagugagacucugccucaaaaaacaacaacaaaaaacuucuggaguaaaggcauuugaaauuuguagauuagagacuggacaugguaaaaggagaaaaguuaucauuuuuagaauaaucugagaauguuucuugggaaauaaaugggguagaggccuggaacagagaggauguuacuugacugaaaaugagguauauuguaaagaguuucgguuugggagucaggucuauuaauuaaaugagccucauuuucuucauacccaccucaaaaaguuagugcgaagcacauaguagcugcuuacucaguguuuuuauuuuuaccucccguaaugguuugaggauucuuugauugcaaggaagaaaaagccaauuuaauuagccuacuuaaaaaaaaagcauuugucauacagugcugcugaaguccauugcaugauuccaauucagcguuuugggaaccagaaagucuucaggcaguuacucuuccaguuuuucucuggaagcacauggucuuaugucucugcuacucacgcaggucuguuccaguuucuuucagauuggccuucucuuuaaagcucuugguuuccacuuccccaaaacuuugauuugcaugagacuuugguuugccaugaugccaacaucagacucacugacuaugcaacaugguucucagcaaacaucuccaagucucaguuauguuucuagagagagaauccaauuggucagguuucugcuucuagcacaguuggcuggagagugaggaaagauaggaaugggaaaaauggaugaggaagagacuuagauuugucucacaguuugcagggcugcuccuuuuaaacuggccaugccaacauauuuaacaaaaggagaguggacagggaggaagugauggauaccucaggugugcuuuaacauccugcaauuugaguucuuccucuggcauugcauugaacuugcucucagcuugguaauguucuaaccagaucuaaccaguagucucuuuacaggacagauucuccugggugugggaguucaggcaaauuacugaaaugcuugaugacucaguuuuccuaugcguagaaugggcauaauagcaccuucuguggugagaauuaugaauucauguauguaaagcaauuaaacagugucuggcauauggcaggcacaaugcaaggguacgguauuaguauuuguugagagcauaccguguggcagguacugugauacaggcuucuggucguguucagagaggaaggaauuucugcccucaagaagucuagaaguccagugcugaccacucaugcuuaaaaccauuucuugacuucagugacacuaaauucuucuaaaucucuaccucaccuaccuuucugacugccauuuauuugugguuccuuuuaugccgguccuggaacccuuuaucaugguugucuucauagaugcucucuugaauuucuguucuuucccagucgcugagaccagcuuucagguucucuauauguggauuauucuuagaguaacaucuccaucucugaccccaaguaaaucucuuaauuuuuaguucuuuuuuuggguauuauuauuuauauaauuuauauguuuugagacauggucuugcucugucacccaggcuagggugcaguggcgcaaucuuggcucacugcaaccuccuccucccagggcucaagcgauucucccuucucagcuucccgaguagcuggaaccacaggugugugcuaccacgccuagcuaauuuuuauauuuuuuuagaggugggguuucaccguguuggccaggcuggucucaaacuccugggcucaagccguccaccugccuuggccucccaaugugcugggauuacagguaugcgcccacuguaccuagccucuuggauauuccuauguugauauaaaauacugucuuccaguuaccuucuaauuugcaaagccuucugauuuaccuucugauuugcaaagaaaaaaauuuucuuucagcaucccaggcuuaaaaccuuaaaguuauuuuucacauucuucuuuuuuuaugcuguaauauacccuguuaguuaauagguucugugugggcuuuugggugcuuccuaugacuggcccaucugcaaaguagaucuguugacuuauuucggcuacuggcagcuuaggauagauccuuauaucuguaagagcuacuuaaaugccuuuucagcaauauacucuuagagucauggcgucauagaugucacugauaaaaagaaauguguuccuggguuaaaauucugaacauauuuucuguuagaaauagucuuguggauagggcuacguacaagauuaagaauguuacuccauuuucuagggagcauauucauguugaaagcacaaucucaagauuuuaguuuuuuguuguugcauuuuuuuguagguauucaauuacauagcauuuuaauuauagcauaucauccuuauaauauugccauacacauauacaaaguuuuauuauaaaucaguuguugaaaauauuuuugaaagucaaauauauuacagaugcacacucaauagugaaacuaagauaaucauuugagggcauauauccuuuacagugauuucuuaaaacuguauucaaauguaggucuaaugaguuuuuuauuaugaaaauguuaacuguuuuauccuccugccuucaucugauuauucuaauuaacuucuaacaauggaccguugcauguuuaaaaguuguguuuauuguugcugaauaaguaguuuugaagucaguagccauucacacuuaguacuuugucaacuagacccauguuauuccuuucaauaccaguggcuaguugggcucaaacauaccuuauaaguagaucucaaucuggaaugcaguugaaaaaucaauaauuuuucucugugacuguuugggaaaacaaaagugacagaacaaauauucuuggauuaauuuuguaaaaagucauuagguaaguggcccuauuuucuauuuggugauguugcuuuugccaccaaaugccugucugcauucacgucauugaugaaauuucucuucaccguacagcucguucacuucaguaaaucuauaguugcuuauuaugaguaaggccuuuggggaaugcagagaugaguaaggcauggcgauggaaugaaauucacuguuguaucccaaucacuguuacuuagacgcuuggugaauguauguguugaacguugguaguacuuacaguccagugcagggcauagacauguagacauuuaacuguuacauaaggcacuguagucuaaagugcuaaaauaggguaaguggugauuuugcuccccaaggaaauguuugguaauauuuggagacaguuuugguuacugcaacugagugcuacuggcaucuaguggguagaggccaaggaagcugcuaaguguccuaccaugcauacacagccuccuacaacaaagacuuaucugacccaaaauguuaguaaugcugagauugagaaacucuguagcgguaagaacauauauauugugaaugcaggaaugagguugaggauuaaaaaggaaaaaggcagaaacuauaaagaagcaaauaucuuaauagauauuaagacauacuaaaaucauuuuauacgauugacuguuguuuugaaaaacaaaauaguaucugauagcuguaguaguuuuagauuuuguaagucaaauaacaggucuguacccaagaaaggaacuuagcuuccuuauuugcaaaaagggggauaacaucacuuuuauucugcuguucaccuauuagguauuauucuguuuuauuuuucuaguguuuguguuaggguuuacaagauaacuuauuacagguuuucuucaaauaacaucacuucauguuuaauguagaaaucuaugacagucuuuuuuugucuccaucuccccugccacauuuuuuauccuauuuugucauacauuuuaucaauaugucugucuuaaacccucuaauuaauuguuacuauuuuuaaacaguuauauuuuaacuguuuaaaagggauugaaaaaugaagaauaacuucuguuacccucauauuuaccauuucagauguucuuuauuccuucguguaagauucagauuuccaucugguauuguuuuacuuugccugaagaauuucuuuccauaguuacucuagugguggucaacugguggugaauuuucacggcccuuauucaugugaauaaauuuauuuugccuuaauuuuugaaauacauuuucauugaguauaucuggguugaugcuuuuuuuuuuuucuucuucuuaguacuuugaagauagugcuccauugucuuguuuuccgguucauauagaugugaagucuguuguccuugguuccucuguauauaauguguacuuuuuuucuggucaauuaauauuuuuucuuuaucacugguuuucagccauuugguuaugauuugccuuggcuuucuuuauguuuauucuuaggguuugcugagcuuccuugguacugucaguuuacgguuuucaucaaauuugggaaguucucugcuauuuugucuucaaauuuuuuuuucuucugcacccacuuccccagugcacgcacgugcacacccacacacacacacacacacucucucucucucacucacucacucgcuuacucacuaugucucuucguggaacuccaguuauucaccuuuuauggugcuuaaaaagucacuuacacucuacguuuguuuuuaaguuuugucucuccauguuucauuuuggauagcuucuauuacauugucuacaaguucacugagcuuuucuucucuaguuuaaucuguuaauuguauccaguaugguuuucguuucaguauauuuaauuuucaucucuaaaaguucaauuuuggugucuuuuguaucuucuccuucucuccuuauggugauguuuuccucucacuucuugaguauauggaacauauuuguacuauaguuuuacaauccuuuucuguuccugccaucaucacugucauuucuaggucuucauuuauugccuuuuuuucucuugguuaugguucauauuuuucucuuccuuugcaugcuugguaauuuuuauuguaugccagccauugaguuuauacuguugcuugcuugauuuauuauauuacugaaguguguuggauuuaguuggggugcacaguuacuuggaaucuguuggguuguuucagggcuugcuuuuagaauuuauuaguguggguccagaacaguuuuuaacguagugcugaauuauugucucuacuaaggcugcuucuacuaaggcugcuacuucuucugaggagucuaucauuaccugauacauuacaagguuuuucuauucugguggaauauauuaugguuuaucucuagggcucucacuuacuuucagcucucccuccagcuuaauacccuguaaauucuagccaucuuggucucuccaaacugaucuguguuuaaaacucagugaaaccaccagacugcuuggcuuuccugucccuguauugugaccuggaaguagcuggcagccaguguuucccuucucucagggaucacaaucccguguucccuguugucugauguuuaaaaccaauguuucauauauauucuguccuguuuucuuguaguuauauucaacagaauauuaauuuuuaacacuuggccauuuggcauuuggucaaaauguguauuuggaguguuuacucuaaaugugaucucagauacuauaaaguagaaauuauuggaaacacaaauguauuuucacaaacucauuaaauguagacauacucauuuaaauauuugaaggcauacuuugcucuuuauucuguuuuauauuuuucagccuacaucaugcuuugaacuuuguucuuuaaauauguuacuuuuuauuuauuaguucagcagauguuugaaugccuacuauguaaaaauacauaaaacacuuuuguccucauggaacuuacaacaggagggaaguaugcaaacaguggcaccagaggauuaaauuauaaaccacuuagagagcacaaaggaggugguuacuauuugggcaaggagggauaaaggagagauaugagccaagccuauuuuagggagggaaguuuuugaacuggugcgugaauaguaaguagcaguucagcugguggaagagagaggguagauuugagagaaguuuaggagaaugacaagucaggauuuggcaauuuacuaggcgagguagucuguaggaauugaggggaagaccaguuuccagcuuggccuacugguuggguuugguuuaauggcucuuacugagauagagaauacaggaggagaucguuuagggagaaaguuuuauuuaccuuuugaacauacaaauuuuggaguaacugggauauuuaguuggaagugucuaauaggaaauuagauauacagaacugaagaauaaauuagggaguuauuugcauaguuaaaaccagagguaaggauaaaauguccuugaaaaacuaaauaaaaugagacaagaggauaaggaugaagacuaagaaauauuaguauuugaguaacaaguuaugaaauaauuuaggaaaggaaacuuacauacagagagacaaguuuuucucaaccagaaauuacauguggcaguuguuaaaaguacagauuccuauguuccauguagaccuguugaauuuggaucuucuggugggggaguuguguguguuagaaauaagcugauguguacagguacugagguuugagaacuagugcaguaggaagagagucaagauauggcaauauuguugacaggcgcuucacagacuggcauaguuaauucuccugauacaaaaaaggucaaguaauaggugaugucaacuugaacauuucuuaggucagaggagauaaggaaagacuuggagaauauauauuuuuuaauuauaaaagaauuuauguucauucagaaaaguacaaaacucaacauacauagacacaaaaugaaacacccaugauuguaucuacccagaugaaaccaaugucuguacucaucuaguguaugucuucuuuuauauuacauauauagauacacacauguaguuauacagauuuuucacaaaaugggauaaugcuaauaugccagaaccugucuuauuuuacuuaaugaucuaccaucuucucauauuguagauagaugacauuuuauaaaauuuaaaagucccacuugcaugggugaccacuggcaucaguuuaguguaccuccuucaagucauuuccuguggaugcacaaauauuuacauaugugugucagaguugugucuguauauaauuuuuucuuucuuuuuuuuuuuuuuuugagacucuguggcccagguuggagugcagugguacaaucuuggcucacugcaaccuccgucucuuggguucaagcaauucuugugccucagccucccgaguggccgggauuacaggcauauaccaccacacccagcuaauuuuuguauuuuuaguagagucuggguuuugccauguugcccaggcuguucuugaacuccuggccucaagugaucuuccugccuuggccucccaaagugcugggagccacugugcuaggccagucuuuuuuuuuuuuuuuuuuuuuuaaauuacaagugagagcauccuauuaacaccauucugcaacuugcucuuucacgccaguauggaucacucuaacucauuauuuccaauagcugaguaauaaucaugugaauuuauuugaauugaugaacuucuagauuauuuucaguuuuuucauuuuauuucagugaauagucuuucacauaucuuugugaauuuugugcaaguauauauguaggauaaauuuuaagaagugaaauagcaggacuaaaggauauguguauuuauuuaaagugcccuauaucucuguucucuguauucuuuauaauuguuucuguaauugcuuucauuuguuuacuuuugcauucugugauuuuucuuaaaaucuucuugguuuuccauuguuuuuagcaaugucuguucugcuuuuuuguuauuucuaaggggauuucauuuguuuagugauaguuuucuguguguuuccugagcuauagugguucacuucguaguuguuugccuugucugccucuuucuugucucucaucugcuuuuuuccaagccauguagguucacuuuaauuucuuugacuauagauaacgcacuuaguuauucuuugcuuaggacucuuguuucuucauccagaauagggcacaaagcaguaaagcacuaaaugaaaaguuuaucauaauacaaauguauuuuaggugaauauacuguauuuuuguucuucuugugaaaucugucaaaaacgaugugcucucuaauuauauaagaugcuaaagaaauccugcucuaguagcuguuauccuuucuucccccaucaaucuuugcaucauuuccaaagaugauuuuuuucuuugcuuuacaaaaguaugucauaucaucucauauuggauucacuuuuauguugcacagauauucucuaauagauuucuuucuuccugagacaguauuuuauuuauguuuaaaugaaaaagugguggaguaaggcaguaaguuguuuuucuuccaugagugaaacagaguguaaauauagaauuaaacuguuucucuuucauuaauuucaaacaaugauuugaauucugagauaaugugagucucaggggcaugauuauauuugucuggauuuuuucuuuuuauguauauuguauguuguuuguuuuucaguguuccuucgcagaucccauacugaauuccauuugcuuuauuauucaaucuugaauaaggguguuuuaucuggaucugcuauucaggaaaauuguggguaaagugaacugggguagccagcccugucaaaucccggauguuguuucagagcacucccaccucucccugcccaacuuugaaacuguuucuucuaccuuaggugcuuguugcaccugagggugagcagcucauuuagauaguuggucccauuuauuugauggugaagucuccugggaguuaauguuuaucuuugcucaguugacuuuagucagcagcugcaaagguaauuguuguuuccuaucucuuuucccuacuucccuuuuaggcaagguuaggagcagacucagagaaagugauguaaggcgugccauuccuuuguccugcaguauuguuuuuaauggcugccauggcgucauugugggaaugaaccuaagaucauuuaauuacucucuuguuucuggcaucuagauugcuucguauuucuauugugaguuguaaugaaccagacuauaaaaccuuuaugcacuguagaggaguggugaagagccccagugcuggaguuagaaaauuuggacuugaaucccaccugugccauuuauuuacucugugggccugggcaaauugcuaagcuuccucuugccucaguuuuucucaucgucaaaccgggguccuauucuguagucuuaaggacaacaugagauguuuacauaaaccucuuagcaaaacagaacacuuggugcauuaugagcccuuguuaauaaacuagaugcucuaggaucauuauuugcuuugaugcauucccaaaagcagaaaugcugagucaaagaaguauuuccaggguuuugacacgcauuacaaaacugcccugcaggugccacuuuacuuaggagccuucuuugacagucucugguuucuuggaacccuuauguuggcuucuauguuuuauguuacauuugagaaaagcccacuugccucugaggcuuucuggcaguugaggagaacacuguggagaagaaaggagagugaaguggccugggacaaauaaaaggauuaucuuuuugcuuuggccacuauacauuuuuauacuuaaacuuuguuuugauaauuuuugguccacuugaucauuuugguccuuagguaaauauuuaagucuucuuuugccuguguuuuauaguuuucaaaguaccucccauaaauuauuuuucauuugagucucacaguaaacuucucugguaaauacgguaucauauacauugaggaaaaaguuccagagacauugcaguuuacccagaggaaacaaagcuaauaagaggcagcacagggagacgcaugaucgucuucuggauucugggguaucacccuuuaccuugugcuguugggaacuccuuguguuaggcugagccuuucucaugcugcugcuucaauuucaguaauuaaucagauuuuauuguuauagagaccacuagggcuuaucuuaguucagaauagaauacaaucauacuucuuugucuaaaaauuaaaauguagaaaucucuaaagaaguguguguguuugugcacucacgcuauagucuuaucugcauagcaaaagaauauacaauuugaacuucacuaaaauuuaguuuuuuaaaaguucugacgguggggggcuagauugaaguuuguuuuugcguauaaaucuccucauaguauaaauuuauguuaaccaaaugucuuggaaaccucagcuaagcaauucauuuuuugucuuuuuguuuuuuucagaaacugggucuuacaauauugucuagacuggcuuugaacuccugggcucaagcaguccucccacaucagccucucgaguagcugagacugcaggcaugcaccacugugccuggcuucaacuaggcaguucuugauaagaccagauugauuuucugaaaauacuugaaacuaagaauuucuuaaauauuuauuugacuuuuuaaaaaaaguauuuaguuccccacuucuacucuuuauugugaugaaacuuuuuccuuugaaggcuuugaaugcaggagggccauaucuaucuuguuucucuuguauccauagcaucuagcacaaguagauuuuaaaugaauggacaagauacuguggucaaaugcagauaccgagugguuaaugccuggaguggauuuaaguucucaaagauguuaaagcaucuuuaaaaaguugagacuuaguuuugaguguuucaccuggcagguguuguguguguuaaguacugguaaucauuugacuuggaugucuucugaaauuuugucaaugguaugcucuuaagcuuccuauacaaagaauguaucuaauuugauauguacagauuucucauucgucuauuaucaaacccuucugcccaagaaauaagaaugucaagagcauucacuguugccauagagauaagagugucuugggaggcagggaaguuggaauucuuuuuguaauauucucuacuuaagcuucuauuuuuaaaauguuuuuuaaaaaacuuguuuuucagaucuuucucuuugacacuuugcaauaaaaaagggcagugagauugaauagguaaggguguaaacuauuuuauaauuuugaaccaaaauauaagauuuuuauaauaauuuucuaucucauuaagguaccaauauucauauauuuuucaaauauucuugcuggauugcaaguaaauuggggggggugcucagauuauuuuuguuuucauuuuuauuuuucuuuuaaugacugaguuaaaauaaauuaauuuagcacaaaaugcuugccugaauuguuaagaucaauaaauaaguuguuuuaauauguuuucuuuagguguuuuguggauuaacucuucauugauuauauacaacaaaaaauaguuauggcgacuuucagaaacaaucacaugaagacuaaagcaucugucagaaaaguaaguucacucuauuagguuucuuuuagugaaaguuuuaauuaaaauguugauuuuuuuuuaaguccuacagcuaugauguuuuguuuaaaugaaucuuauuauuugaauuaguaacauugaacuacugcaaagauuggcauguaugaaaauagugauacaaaaucaugauuacagugauuuuauuuccuaaagaucacagugcuuucuccccauuuuuucucuacacauagauauccaugugcuuuuuugcaauauaggcugucagguguaagcuuucuuauauaccuuuagcuuuaccauucauucauuccuucauucagcaaauacacacuugaguucuuauaagccagaccauauguuagauguuggguaaucaguaacaagcaaacaaaauaugauucuuaauccuuucuuccuucuagucuaaggaggaaccuccucacuuccuuucuuaaaacaauuugguuaaccuuccauuucuugacauuuuugucuuugcuaaaacuuuggaggcacuacccaugaacaaagaagggaagaauggagccuggaagauaauuaacagucuuuguuauuucuuuuucuggacuucaucuucugcauuauaugacaccauugaccaauccuuacacauuaagacaauauuugauuuucauuauagguuuuucuugguuuccuucucuuuuaugguaacucuugucuccuuugcuaaucuuuccaaauucuaauuaucaguguuccuaugagcuucugggccugccauucauuuauguagagagcuaaaagauguauagguuugacugcuaagucuaagaggauggcuuccaaaucuacaggaugccugcaaaauagaaaguaaacuuauccuuaaacaguauguuaauuacuuuuuuuuuuuugggacacaguuucgcucuguugcccaggcuggagugcaguggcgugaucuuggcuuacugcaagcucugacuccuggguucaugccauucuccugccucagccucccgaguagcugggacuacaggugcccgccaccacaccuggcuaauuuuuuuguauuuuuaguagagacgggguuucaccguguuagccaggaugaucgcgaucuccugaccucgugaucugccugccucggccucccaaagugcugggauuacaggugugagccacugcgucuggccaauuacauuuuaaaguaauaugcuccauauguuuugagguaaauuaccuuuaaauuuaauagguccacuuuuuaauuugaaaaaaguacaauaaaaacuauuuucuguuucuacucuuuguaaacuauaguguauuuauuauacuuuuucagauuagcaacuagacccauagcuuuaaauugauuauacugcuggcuuuaaacuaauaacuaauaauauauacaaaauauaauagcaaacugauaaccauggucuucaagaaugaugcuaccugacuugaauauuuaccccauacauugccagagauucagggauuagacagcagcugaaauuucauacuauuauuaccagguuagugucuuuuguuauucaacguauuguccauauuaggcacucaguaaagauuuaauuugaauucaacuugaauuauuggaaucccuuuuagauaaaaguaugugaauccagauauuacauacuguuuauauaaacaguuaugcacacacauacaccaccuucuacaucuuggugcaucuuaaugucagacacuucccuauuggcuacuguggaaauugaaagauauacuugaauucuuuagauuucacuuuaauuugcauuaaauauagagauacauuaaauauuuauugggaauuaauguugcaaaauuaaaaauagcuauaguuucuaccccaguaauuuuuucuaacauuuuauuaugaaaaauuucaaacacauagaaaaguuaaaagcauaauacacacacaaacccacguaccuaccacccauauucaacaguaguuaauaauuugucuuguuugcuuugugucuguguauguguguauuuacuuucaggcaguaccauuugcaaguuaugaucauaauguuucuucacccugaacacuucagcaugcuucucccaggaauaacaacaucuucccacauaacacuaauaccaugaacacauccaagaaaaauaaauucccauauaucuaauacucagccauacucagauuuccuguauuacccccaaaauaucuuuuauaguucacucugccccuguuuggauccagucuagccucuuagucucuguugccuuuggcaguuaggacuuagcauuucuuuugguuugaaagaauuuuuccuuuuuuucuuuauauucaauucugacaucuugaauaggccaggcuaguuuuauuuucuuguaccauguuucacaucuggauuucucugguuguuuucucauauugcuauuuaauuugauccucucccuuguauauuucacauaaaguagaaguuauguuuaaagguuuaauuggaucagguuaagcauuuauggcaagaauacuuuauagggugaugugaggacagaauuucagguuuucccaugaucagugaugcuaugauugaucaguugacuaaggugauaacccugcuagcauuuccauuguaaaaguacauuuucuguuuuuugguuagcacauaaucugugaugauacuuggcugugugcaaauauccuuuuuuucccccaacaaccauugagcuaauguuuuuggcaucccuugcuuacucuuuccugaauucauuauuucaugggaguugcaaaauggugauuuuccuaauucuaccauuccuuucacauuuauuugcugguauuaaagaaaagcuucccucauucaccuuagaugaacuauauaauaucuccuauagaggcagggcaaaugcccuuuaauuaccaguuuucagauuaaugacagggcaucauaguuaacaccagugguagcaagugaguuuauuuccccacauuaauucacuaauuuauuuguaaugcucuggacucauggauuuuugcaguucuauauuuuauaaccuuuuauuucuuuacagucauuaauucaucuauguaaguugcucaaauuuuuccaaaauugauaccugagagccccuccaaguagguaccuauauccuuuugucucaggcucauaacuuugauugcuuuuucacuuucggguuguauccuuuugguacaggaugaccuaauuucaccuacuuuaccuuccucagaccugaaauuggcuauuuuuuuuuuaaagaacccugaauaguauuuaaaacccaagaucuggauacuaggaguugccuuugcacuuaccaugucaugaguuuauauugacaguucacguucagauuucacauauuuuuuccuguuuugauuuccuguuucuaaauuagugugaaaauccccguuuauuaaggaaaacaaaauuguuuaaaauauugaauauuuucaagcccacagaaaaguugagaaaaaaaccuaguacaaugagcaccucauauagucuucacucagauucacccucgguuagcaucauaccuuuaaguaugucaguaucauuaccaccucuuugaaaaucauuaauucaguaacaucaucuagcaugcauuccaaacacagauuucccugugucucaaguauccuuguaacuuuuuccuugcuucucuucuaggauccacacuguauuuggucaagguucacacacuguauuuggggauuguaucucuuuggucuuccccauucuagaccauuccaauagucuaaauucuuuucucaugcagcaaaucuucugaagagucuaggccaguuguguuguagaauauuuuuauauuuggguucauuuguuuuucccuguaauuagauucaacacaacaccugaaaggugauguuguguucauuccggucuaucagaucugaaguccauauuguugauguuaggcuugacuaggugguuaagguaauaaccaccagauaucuccaauauaaaugcacauaaucucuuuaugauuaauacacuuaauaaacuauaaggugauccucugagacaguaugaguguccuuuuccccagcuuuuaacccaguagauuuaggauacauggauaauccuuuccuaaaucaguaauugcauugggaguuuacaaaugggguuuucuaacuuugucauucuguccauacuagccagcauuuuuagguaaaggagcuccucugacuuugucucuuuuaauggacucacagauuuuuuuuaauccaguagucauaauucauuaccauuuucauucuucuugauuccacauugucccauauuuggccagugggaauucuuucaagcuggcuucuguguuuuuugaaauuacccuauuagucuuugagcauuuccuugcauucuggcacaguuagauguuccaggcucgcuucauacauucucagccucagaccuggaaccagccauuuccccagggaaaucuaguucuuuuuauuggugauagauauuuacagaccaaaagcugggugcugacuaugcucauugccacugaaggucauuguuucuaagacuuuucaguggaaaaaagguaguacauguauucaaagaauuacgaauuuguaaugacaggucagauucaaauguaacaguacagcuuuuuaucauaaauucuuugaguuuauauuuguaccucuuagacuaaagauuuccauuuauuuuaauuuauuaagauugcagcuguuugaguuaaucuagugugagguucugaaauauggggaaacaaagugagugaaacacagucugugacuuccauaauuuguuuuaauggguaggaaagaaucugauuauaguaauuauauguuuuuuguuuucgagacggaaucucacucugucgcccaggcuggagugcaguggcgcagucucagcuaacugcaacccccaccucccagguucaagcaauucuucugccucagccuuccgagcagcugggauuacaggcacguggcaccaugccaggcuaauuuguguauuuuuaguaaagacgggcuuucgcuauguuggccaggcuggucucgaacuccuuaccucaagugauccacccgccucccaaagugcugggauuacacacgugagccacugugcccagccaauaauuauaauauguuuugguguggauuaaaugaucuuagugcacaacauacagcaggaacuuugagagagauuuauuaggacuaaggaauggaaaaaucuucacaggucuugggauggguaggauuucuacaugggaagacugggaaguaaggacauuucugauugaagagcagauugacaagucaguggaagggggcauaagguagaaggaaauaaguguucuauuuaugccugacuauaauacucauuauuuucuuuauguaacuuuuuccuuguacuugugacaaacaucucacccugaaauuuggaauccccucucauuuucaucagacagcuuccuuaagauccauggaaaaccuuauuuuggauuauuaucuuauuuuucugucuccaacuuuguuaauggaguaaucacuguuguuaagggaguaaucacuguugugcaccuuaccauagcucccacaucaucucauucaaucauauaaauuguugcuucuguucuacgccagugacuuggaaaucagauaugcaguuuguuaaguuuuaguguaagguaagaguaagugaaccugguaugagaucucacgugaucuucuagugaguugaaugcccaggcuccaguaguauguguuuugggcaugugaaacucugccuaaaccuuuucagcugaauggagcuuuucuucucaguggaauugaguuccgcauucaguaucaaaaggugccagugaauauuaguuagagaaugagugacuaucuaaaacaucuccaggaucucuuacccuugucuuagaauuaaauaaauuugaaauaucuuugcuuucuuuccccugcagagcuucagugaagauguguuccagucuguaaagucuuuauugcagagucagaaggaacuaugcaguguaacagcagaggacuguuuacagcaggaugagcaugccaauuuaacugagguuuaacauacuacuuucuaaacccuuuccuaauaaugcacagcauauuuucaugcaucuuuguaggacucuaugaucuauuuuuaaaaugccuaaaaucucuauuuguuguuacauguaucagaaguaccuguuuugugggcgggagaggggaaaaaaaagaaguaccuguuuuaaauacuggcuaaaauaauuuucuuaauugacaaugaacucaaacaaaugagcacauuuauuuuaugcagaguacuaauuggauauauagcauuacauuagaugaugccuacuauauucagcaacugauacuuuaauaugaauuuuucuacucugaaacauagaacaaaugcaugauucuuauguugauuuuuuggguuauuuucuugacuguuuaaauucagugcuuugauuaaaaaugaaaaaguagugauaaauuuaucuuugaaauuaagauacuuacucuauuacuugaggauaagauaauauaccuugcucaccuauuucucugcuacauccaguguuucaaaucuuuguuugaauuuauuauuauaaaaagaguaagauccuuuucuauaauauauccauacuucaucaucacauuuguuaccaaauacgagauguauuaggucguugcagcucacaacugaugaauauuugaaguuaaaacauuuuauuuugaaauaagcguucuaauaaaaucgugguuauagauagaugcuccuggacuuaugaucgaguuacauccugauagauccauuuuucaucaaaaauauucuaaguugaaaaugcauuuaagaccucauaaauccauuguaaaguuaaaaagucagaaguccaaccaucauaaguuggggacuguauguauucucuuucggguggaugauuuucuuaauauuccuugagaaauucucuauuugacgucauuucauaggaagaugagcauauguuuuaggccuguaguguucuggugccucauccucuuuuugugucagcuuaauuucacuauuauuuucuuugcuaaccuuuuucauuuuacuuuagcaaaaccaagccacucuuaaucuacuugguuguuuccaaauaaacaguggcagaacauaacaggccuaauacauaugcucaucuucuaugaaaugauguccuguguccuguccuccagugguuuuccagcucggauaggucgcagugcuuuuccaagcccacauuccuuggugaggccuuucuugaccaaugggaaagauaaaacucccccggcaucuucaaaacccuaugccagcuuauuuucucucuuguauucaguaaagcaaacuugaaggaauagauggaauuucuauuccauuuuagggugugcaaaucucugaguaucuuuucaaauaaaggaaggaaauuaguuauuugccuaucuguuauugagugccuguaaugugcuaggcacuuuccucuacauuauccaguuaaccucagaacuaugagagggaaguuguauugccuuaaguuuuacagauaaggagacaggcuccuagagguuagcaauucaccuagaugccuagaaguuaacuguauguaacacuuacaugaaguaauagccauaauuaaucagaauaaagaucucagaguaauauaagauucugacuugcuucugaaucaucagaaauagaucgaaaauauauucaguguugcuauauucugacuauacuauuguccccacauucuugagaaucgauuauuaauauugccgucauuuaaguauugcauauuuuuuagccacagugguugcuuaguggacaguuuacuacacugucuucaaauggaaaaaaugucuuacuaugaugccaaauacauagagaauauaaauguaaaaaguaacacuuuuucagguuauaaaaguaguauauauauauuuuuuucuuuucuuuuuuuuugagacauagucuugcccugcugcccaggcuggagugcaguggcgugauuucagcucauugcaaccuccaccuccaggguucaagugauucuccugucucagccucccgaguagcugggacuauaggcaugcaccaccaugccuggcuaauuuuuuguauuuuuaguagagacgagguuucaccauguuggccaggcuggucuugaacuggccucaagugauccauccaccucagccucccaaagugcugggauuacagacaugagccacugcaccuggccaguauauauucuuuguagaaaaauaagaaauacucaaaguagaacaaagaaaaugacuaucauugaucuuaugacuuagggaaaaaaugcagaggggaaaagaaugggaaaaaaauagcuccaucauccagaguuaaucacugcuuauaguuugguguauugccuuccaguauuauuuuccaugcauauguuuuuaaaaauaagguugaaauuguaugcaggcuguaaaucauuuuucuaugacuuguccuuuuuacuuaauaaugugacaguucuucaugcauuagguauucuuuagaaagucuguuuauauaaaguucugcagaguaaucucuacauaaggauauugaaggaaauaaauggugguaucacagagucaaugaagaaguagccucaggagucuacccagggggaaggccucucugaggaggugacacuugcaucgaaacuugaagaaugagaagccaggcauguaaccauccaaggaagagagauccagauugagggcgcaacugugaaguccuuaggcaggaauguacagggcguguuccagacccagaaagggggcucguguguaagugaaaaugguagaaggaugaaagcauuagguaaccucacuuaggauuuugccaugggaagcauggaggaguuugaauagggagguggcaugguaauaggaccaggugggagaggauuguacuaguguaggugagaaggguggcuggggaauggagagaaguggauauauuugaaauauguuuugggguuagaauugauugaacuugcuagugagggagaauggaugagguuuaagaacugcguuuuggagcccaaucuuuggugaaaaauauuuuugggucaucuuugaaaaaaauccuuuucaagcagacagcauuuuaaugcuuugucuguuuuuuccuguuugucagcucugucaccagccugaaagauuuaaaaauucaaauuaauggagguuuauuuguucuuuacucaggucacauuucuggguuuuaaugaagagacagaugcugcucauauacagguauggugaauuuuagcauuuuuacugaguauucuugucauggaaaucagcuuuagguuugaccacaaaagucauuuaucugagaagguugcaaaccgcagacugacuuuuucugcauucuguguauaauacagaauguaugacuuguuuguuuauuuugauggcuuuaauaauuuugaccuuaacaguaaaaauucuuauguuuuuaguuaagauugaguuaaauuuaaaagguaagauuuguaaaaauuaacaauuagccaaugcaaaaauuuagccuguuugauuuaggcaguuauugacagagggacugauguuugagauugggaucagcaaaggaaagcuucacaguuacauaaacagugguugaaguuccuguacauaugauaggcauacuuuucuuuuucccucgugcugcuucuuaaaaauuugugauuccuacauauuuccuuuuguggcaguaaagugucuccucauagaggaggaaauaacauuuuuaggucuuucugaauaaugcauaucaggugauuaugggcaaaaacugcuguauauuuugauuguggccuugcuugaaggaaauaauuuggacagaaggaacaagagaggauauauucuugagaacauacauagcuggaaagagaaguauuccaagauauuucuuuaauguucuucuucuccuuuaagaguuacugauaaaaccauguuuauaaaggaaaguacucuacaaagggucaaagacuuuaauaauucuuuagcuggguaaaauauuuguguauaaagggcaaacaagaagaagaaauaaaagcgauuuucuuuuccuuuaaucuucauuaaaauuaucaguuaaagucuaauacaauaccuuggagaggaaagauagaaaaacggauuauauuguacagaguuuuuaaaaaaaaguuuuuaagauguacauucucuagcaaaaaauuuuguaugaaaaaaauuucauaaaguuaaguuaagaccuauauguugacauugcuaaaaacuauuaaaugcuuaauugucauggauguguuagguacccuguacaauuuuuuuauagcuugauaucaguacauuuuaaaggcuacggggauagccaguauuuaauaauuuuaguauauuuuauuuuugaauuuuugaaaaauuaucugugaauaauaaacuguauauguuaacuauuaugaaccaggaaauucacuagccaguagaccuuaaaauuuuuggauaggguccacauuauaggaaccuuaacaaaaguguuacucuacaguguuacuuauuguuauuauuuuaaaucaggauuuagcugcaguuucuuuggaacuuccagauauucugaauucacuccacuucugcagucuaaaugaaaaugaaauuauuuguaugaagaauauaaauaaaccauuagauauaagcagugauccucuaaaucagguaacuuuuguagauaauuucuaaugagauuuuuagggcaaauuuuacuauauuugauaaagaugauuaaacuuuuaaaugcuuggaugacauuuguuuuuuuuaaaugguaucucaaggaaauaugauucauaagaaauauaacucaugaagcauugacaucccugaaggauauaauaauuuuggucauaucuuauaaauuauauuuuuuaacugugaaguuccguagaugguaugcaaguacauguuaauuuuuucugaaaauuuauuauuucuggauuucuugaacuacuuuuaccuuuguauaagcuacagugacuuuucccuauuauggccaauuucaaauuuauauaaauguuacgcuauauguuuuagagaauguacuucaguucauuuucugguuuaaaaaaauuccauguaaaguggacaucugauguguucuuuauaaauaaaaauguuaccauuucuuacaggugguuaguuuuauaauauucagcauuuaguucuuuaccaaguaugauuuuguugauaaugcaucagagaaaaugcuuugcauucuaagagauaagacauauacaauugaaccagaaaauuuaaaauuuggauuauuuuaguuuuaaaaaaacugcuauguuguucuuuauaaggucugccaauaaaacuagaacugcuugcuucauuuccuuaauuauguucuuuauucguauuugcuuuauuugcuaggauauaagaggugauaagcuauuauauuugauuucuaguuuuuugaauaaauaauuucaucaguauuuacuugaaaaaaguaguaugagggggaaaaucugguuacuuguauuuuuaaagcuauaaacauuguaaguuguaaugcuagggaaauuuaaguaaaaggaguagacuuuuaacaauugugauaggaaggaagauggcaucauacuugaaacuacgggaaaaugggauuaaaaauaaaagaaaauagaacuugguugcugcccccaaacaauuuauaauaguuagugagauaggugaaugauuaaggaaaaucauagggcuguacaguaauacaggaaaacauaauugcucaaaggaauggauaguaaguuucauaacauuucaggagacuggguagaauuugaauaccuggauaaaagaagaugggagaaaaaaggacuggaaagugaaaaauguagagaaagaauuaagaaguaaacauuacaaaaccaaggagcuuuucaggaugcaugaauuucuuguuuguuuuuuucucugagauugucuuauaucuaggcuuuacuucauguuguuuuguauuugaaauuaaaauuguuuuuauuaucuuuuaucuuucccaagagucauccuucuggaaugcuuugugucaugagagugucaccuacaucaccaagacuuaggauugauuuuaucuuuagucuccuaaguaaauaugcuacugguauaagguacaccuuggacacauucuugcaucagaagcaccaacuugagaccacugaugaagaugaugaugauacuaaccagucugugucauccauagaggaugacuuugucacugcuuuugagcacuuagaagaggaagagacuucaaagccauacaaugaugguuuguuuuucauuagacuuuuuccuaaaauagggaauuaaaauuuuucaguuuugaaaauuuuaaggcaggcuuguucaguugaaauuuauguugagauuugauucaauuuaaaccuuuuaacuuuuuuucugauuaccuaaggaaauuccuuaugauuuuuaaguucauuguaaucugguuuucaguuuugcuuauuucagguuuucauauuuaguuggugcuguucacgcacugguuacaucauuaagugucuggaacauuccuagguuccaauuuuggaagaguuagcuggcagagucuccacgguaauuuuucuaacaugcgugacagcaugcaaaacaucccauagaccagguaucccuagacauagaguaaacugaaauuauuuuauaaacaguauauuuacuuucaaauguuacuugggugaaucuuucuguuaaacauaguuuagaagauacacauaaauauuauauguuuaaagucaguuuauuccauggauuuaaguuaauuuccaaaaaguuuuguucaaaaauaauuucaccauuucauucuuuuccuauaggaaugaacauuacugugcuaaggagccagugugaugcugcuucccagacgguuacuggucaucauuuagaaacccaugauuuaaagauucucauuagcucuggacagcagaagucauuggcuaaacccucaacuuccucagugaauguccugggacauaaagaacuaccuucugugaaaacuucagucacaacaucaauuucagagccuuggacccaaaggaguuucuauaggucaucuaaugcuucagauaaagauagugauuuacagaaaacauuuuuuucgucuucuccugccuacucaucugaaucagaauguucaaguccaaguccuguuauuuucuuggaugaagagggauaucaaaaaagcuuaaaagcaaaacuugagcugccuaaaauuccugugaugaaagaugauauagaggauucagacucagaaguaagugaauuuuuugauaguuuugaucaguuugaugaacuagaacaaacuuuagagacuugccuguuuaacaaagaucccgucauagggaagucaucgcagaggaaagggcacaaacauggaaagucauguaugaauccucaaaaauucaaguuugaucguccagcucucccagcuaauguuagaaagccaacuccucguaaaccagaaucuccauaugguaaccugugugaugcuccggauucuccucgcccagugaaggcaucaagggaagauagugguuuauuuaguccuauucgauccucugcuuuuaguccucuuggaggcuguacuccagcugaauguuuuugccaaacagauauugguggagauaggauucaugaaaaucaugauucuguuuauuacaccuaugaagacuaugcaaaaagcauuucaugugaaguacuaggcucaguucuucguacccaccauacuaauacccuaucaaauauuaacaguauuaaacauggagaaaauaaaacuguaacuuuuaagcauggaaaccuugaucaaaaaaauaaaucuaaaaauaaauccuuaaugauuaaagauagcauucaaaaauuugcagcagaucuuguggaaaaaaguuuuggcagugcauuuaaagacuuacagaaaggagucucuucauguaccaaugcuuuguaccacuuagccaucaaauugacaucaucuguuuugcagauggcauuugaugagcugagaaggcagcgugcauuuucacuaaaagaacgugccauuaguggccuggcuaacuuuuuggugagugaagcuuuaucaaaugccuuaaaagauuuacaguauguaaagaagcagauauucacaaacacaguugcuagguuugcugcagaucuugcugaagagcuuguuuuugaaggcaucauggaggugugucaguuuucauauccucaaacgccugcaucuccacagugugggucguuugacuuugaagacaaaguagugaaguuguaugcaaaagauuugucugaaucuguaauacaggaagcauucauugagcuaucacaaguugaugugaccuuuacaacaaaggcagcaguuagugucucuacggauaauaucaaguaugugagugcagaaaguguagugccaucgacacaggcugucacguuuuccccuucuuuucacaaucaagcaauuauggugacaaaaccagugcaggaauauaaaaaggaauacacagugcagcaggccuuguuuuguacuucuggaauuguuacuucuauaccggugcccuuggcaggaagugcccuucucccauaucauauuucaucuacugcaugucaggccaaggcucaucugucaucugaugauaguaauucaaauggugauucugcccaagugcauauugccacaaaaaacagagaagaaaaagcagcuugucucagaaauauuuguuuaccuucagaacacaauccagguaaucagaaugauuuuaaaccaacuaaugacgauauugaaaugcagaguuccucaaaauuaccaaaugauccugcaauuauuagcaacuuuucugcagcaguggugcauacgauaguaaaugaaacuuuagagucaaugacaucauuggaaguuacaaaaaugguugaugaacguacagauuauuuaacuaaaucuuuaaaggagaaaaccccuccauuuucccacugugaucaggcagugcugcaaugcagugaagcuaguagcaauaaggacauguuugcugaccgguuaucuaaaucuauuauuaaacauuccauagauaagagcaaaucagugaucccaaauauagauaaaaaugcaguauacaaggaaagcuugccuguuucuggagaagaaucacaguugacaccagaaaagucucccaaauuuccugacucucagaaucaguuaacucacugcucacuuucagcugcaaaggauuguguuccagaauguaaaguuucuaugguucauggauccucccuagagacacugccaucuuguccagcugugacaggucagaaaucugacuugaaggaaucugcuaaggaucaaccacugaaaaagcauaacuugaauaguacaucacuugaggccuugucuuuuggacaggaaaaccccuuuccucauucacauacuuucucaucuacagcacuuaccuguguagaugguuugcauguggaagauaaacagaaagucagagacagaaauguaauaccugauacuccuccaucaacuccucuaguaccaucccgggcuaguucugaaugggauaucaagaaguuaacuaaaaagcucaagggagaauuagccaaagaguuugcaccugcuacaccaccuucuacuccacacaacucaucuguugguaguuugucugagaaugaacaaaauacuauagaaaaagaagaguucauguugaaacucaugcgaucucuuucugaagaaguugagaguagugaaaguggagagcucccagaaguggaugugaagucggagcacucagggaagaagguucaguuugcagaagcauuagcuacacacauccuuucucuugcaacugaaauggcagcuucccauuuagauaacaaaauaauucaagaacccaagguuaaaaacccuugcuuaaaugugcaaagucaaagaagugugucgccuacuuuuuuaaaccccucagacgaaaauuugaaaacauuaugcaauuuugcgggugaucuggcagcagaagucauuacagaagcugagaaaauagcaaaaguccgaaauuguaugcuuuucaagcaaaagaagaacaguuguuaugcugauggugacgaagauuauaaaguagaagagaaguuggauauagaggcuguagugcacccaagagaaguggauccguuuauucuuucauuaccaccaaguucuuguaugucaggucugauguauaaguaucccagcugugaaagugugacagaugaauaugcaggucaccuuauucagauacuaaaacaggaaggugguaauagugaguugauaauggaucaguaugccaauaggcuugccuaccgaucuguuaaaucaggauuacaggaagcagcuaagacaaccaaagugcagugcaacucaagaauguucccugugccaaguucacaagugaaaacaaacaaggaacuguuaauguuuucaaacaaagagcaccaccaagaagcagacaaaaagagacaaaguaaaagaaaugaagguuacuuuuguaaaaaucaaacuugugaaaggacccuggauccauauagaaaugaggucucccaacuguauaguuuuucaaccucucugguucacagcauaacaaaagaugcuaaggaagaguugacagccucucuaguuggccuaccaaaauccuuaacagauucuugcuuguuugaaaaaucuggauaugaagaagauaaugagugucacguuacaccagaauugccuaagucucuucagccuuccucacaaaaucacagguuuuaccacagcacuggcaguuuaaauggauaugguuguggagacaauguuguucaagcuguagaacaguaugccaaaaaaguaguggaugacacucuagagcuaacucuaggaucuacaguguuccgagugucugagaccacaaaaucagcagacagggucacuuaugcagaaaaguugucaccucuuacaggucaagcuugcagauacugugaccuuaaagaacuccacaauugcacuggaaauucaucucagcacuuuuucagacaggguucucucgccaguaguaagccagcuucuaauccaaaauuuagcagccgcuaucagaaaucuaggauuuuucaucucagugucccucagauucauguuaaucuugauaagaaggcagugcuugcugagaagauaguugcugaagccauugaaaaagcugagcgagagcugagcaguaccagccuggcagccgacagugggaucggacaggagggugccagcuuugcugaaagccuugccacagaaaccaugacagcagcugucacaaauguugggcaugcuguuagcagguaaguuucacguuucuuuugguuguuaaugauaaauuaaaaagauaaaugugauccuauaugucuuagguccuguucauaaaggaaugauuauuuuuaacccuacauaaacaaaaguuuucccuguugcauuuauguauuguuucauauccuacacaugacuuuaauauauuuuggucuccugaucccuuuugagggaagguguuauccauuuacagagcuggaaaaugaggguuggagaaaauaaucaccuuauccaaguucauagagcuaugaaauagguaaaguugaauuaaauaaauagcuagagaauuuuauauaguaguccccccuuauucucaauuuugcuuuccucaaucugaaaauguuaaauggaaaauuccagaaauaagcgauucguaaguuuuaaguugcauguucugaguagcaugaugaagucucacaccaucucacucaggaugugaauuaccccuuuauccaguuuauccauacuacaugugcuguucaccuguuagucacuuagaagguaucucaguuaucagguccacaaaccugguauguacagggcuugaugcuaucugcaguuucagacauccacugggugucuuagaucauaucccccauggauaaggggggacuauucuauaguaaauguagaauauuacuauauuaauuuacuauucugagauuaaauuuuuguacaccuuucuucauucacaaggguaaguuuucuuauaaagaccaugguuaaacuacucugaagaagaaagugaaaauucuuuacauacuuacaccauuucucuugauugguucacaaucuaagaggacaguucuuucugguaguccuacaguguccuguuuuucaguagcuaucucuugugcucagugauucuuuuuuuuuuuuugagauggagucucgcacuguugcccaggcuggagugcaguggcacaaucucagcucacugcaaccuuugccucccggguucaagcgauuccugugccucagccucccuaguagcugggauuacaggcacccaccaccacgcccagcuaauuuuuguauuuuuaguagagacaggguuucaccaaguuggccaggcuggucuugaacuccugaccuuaggugaucugcccaccucagcuucccaaagugcugggaucacaggcgugagccaccgcaaccagccaugcucagugauucuuuaauaacaacuuaguuacaguuuuucaguuuaaaccuucuuugucccugagaagauaucaggaccaacuuguguuauuaguugauaggaugauauuuguaaguccugcuugaaagagaaaaugcuuuaaguugagguggaauuuaauugagucacaugauauuccagauuuuugaguagcuucuguuaaagccaugacauggucugccucuuuucuuauccaucuuaaaauagggagauauagcuuggccaggauucuugaauccaauugcuccauagcgucuacuugagaugagagaugauguagguuucuggugaacuaggagaggucucuauuugcccuaaucaggcagccuucuuucuccuagaccagggguuggcaaacuacagucugugggccaauguggccuacugguuguuuuuguauggacugcaagcuaagaacagauuucauguuuuuuuuuaaugguugaaaaaaaucaaaugauauuuugugauguggaaauuauaugaaauucaaauuucaguauuuauaaauaaaguuuuauugggacaccaccaugcucauucaauuacacauuucuguggcugccuuugugcuauaauggcagaguugaguaguugggacagaggcuguaugaccagcagugccuauguacuuccuguuuggccuguauuaguucauuuucacacugcuauaaagauaccaccugagacugaguaauuuauaaacaaaggagguuuaauugacucacaguucugcauggcugggaaagccucaggagacuuacagucauggcacaaggcaaaggggaagcaaguguuuucuucacaaggcagcaggagagagagagaagggggagcugccagacacuuuuaaaaccaucagcucucaugagaacucccucacugucaugagaacagcauggaggaagccgcccucaugauccaaucaccucccaccaggucccucccuggggguuacaauuugagaugagauuuggguagggacauagagccaaaccauaucauggccucuuacagaaaacaauugcgaaccucuguccuagauccacauuuucguuuucacuacauaccaguuccuaguaugauaauaaacauaauaaauuguuaauaaauauucucaugaauagguaauaaauuaggccuuuuuacaauugaaauaauuuuccucauacagguugcuucaggcuauuuuacuuuuuacuccuccucaguucaguccugucugcccuacggacccauccaucccccuuuccucccacccucaugggaagaaaagagacuguccucuaaaguuuuuaagacaucacucucaggggcuagcaaaugccuuuguuauugauuuucucaguaauuuccacuuuuccuucuuagaguugggugaguagauagccccuaaaguucuuccuguaagccagugcuguccaauuucagcuuuuuauuaaggcuggaguaauuauuuuccugcuucucuucuuaauaauugugcuaggguucuguaaauacugacuaaggaaagcugacucuaguguguagaguuuacguuuaacauuuuuuauuucuaaaguuaaauuugucuuucaaacuugaaaggagauucauucagauggauuauucuuuaagguauuauuucaccugaugucccuuuuuguuugauucaugaacaugaccauaaauauuucacaaacuguaaugaacagagagguggcaugugaaugcaauugggaaauuaugugauaguacauuuuuauucauuuuuguuuguuguuguuuguuuguagagaugagaucucacuauguugcucaggcugaucuugaauuccugagcucaagcaauccuccugcccuagccucccaaagugcugagauugcaagcaugagccaccgugccuggcugauagugcauuuuuagccaacaaaacgauuauauucuaagcuaucauuccgagccaaaauaaccucacagucauuauaaacucuucucuggaccucauccuuugggucauuucagccaaaaaccaugagaauguggcacauauuaggaaaaguauucaaaaaaacaaaguaguaaucuaucaaugguucagaacuauaaugugccuaugcuuggaaugcucaguaucauucuguaucuuacaaaauuagaauagcugaaaaaauggggggcaauucaggggcuauucucaggauagcacuagggauacggaaguaaguaaaacaggcaaaaaucugcauucucuuggagcuuauguuauaguggaauaagacaauagguaaguaaaauauauaguaugucacauagugauaagugcuuugggggaaaaauaaagcaagguagggaguuagggaguuagagagugcugguggugacaguggcgguggccauuagggcugguuuacaguuuuggauagguagcaggggaaacaauacuggcaaagugauacuugagccaaaaaccaaaagugaaaugagaauaagucaugugggagucaccgagaacagauuuccaggccuaggggugggacugugcauguuugggaaacaacagagaggcuuguauugcugaagugggaggagugggccagggagaacauaggaggagugggccagggagaacaguaggaguucagauggauguuauaagaggggacaggcaguauguuuuaaggauuugggcucuucggcuuggugggaagccauuggaagguuuugauccgaagacugacauuuuuucuuuuuauggaaacaucacuuugaacuacuuuguugaacauaaaauguagugggacaauuaaaauaguugagcagugaauggacuuucuugugaugauggaauaaaaguauaaaugccucuuauugagaaaaaugaaagggguuaugaucuauguucaaaaucuugaagagauuugguuaguuugaauacaggcuugguugacaauacuagaauuucuugaacgacuuuuuuguucuuaaagccagaaagagacuccuuuaacauaaauaaaaguacuguuuuacaaagcagaugauaacuuaggaacuuguacugccccaugguaucucaguugaaaaaugaacugcuuuaaguagaauuuagagaaauaaugcccuagggauagauccauuguagauuaacaaaguaaguuauggcuguugguggguaccucaguuaacuuugaaauuaauacgcuauccuacagucuguuuguuggcagacucaaauaaaggauuacaugagccacuggucugauuccgaauaccauuucuuguuuuuaucaucuuugucaucaaauugauagucuuguaaguucagaaucugggaugcuuucaauuugauuuuuuuucuuuuuuucuucuuuuuaguucaaaagaaauagaagacuuucagucaaccgagucugucaguagccagcagaugaaccucaguauuggugaugacagcacugguagcugguccaauuuaaguuuugaagaugaacaccaagaugaaagcagcaguuuucaucaucuaagugaaagguaacuacacuuuugcauauaauuguguaguuuagguccucagaucuuagaagugagcuauaaauuuacauuauuauuuaaaaauucuaaauuugaaaauaugcuauuacuuucaaaauguauuuuauuauucacaauguauuucuaauuguuuuuaacacuuauuuaauacaguaaguagcccagcuaauuuuauuggggugugccaauaguugauuugaaaaauauugcauacauuuaauuuuaugccuuuuaagcuucucccaaacuuuuuaugaacuucugaggaaaaauuuuuuuuuucacuuuaaaaaggguacuuuuuuuucuuuaaagaacaagaaaaaggacagguaucuguaaaaggcaucaaaguagcccuguacuuuuccugacauuaguuaaaauaguaucuuuuugguggggcgagggucccugcuuguccugcuguuaggaacaaaaugaccuggaagacuuaugcuugaaugauugaaaauacguaagucaaagccauuauaaaaaugugauuuuguauagcacaaggcacuuaccucauauauaacuuuucuuaguuaacuuuguucauaacagugguguuugaaauauuuuauuaauuaugagacaguuguuucuuauagucuuaaccucuaccuaaaggcauuucugacuaaccuauaaaauucuauaaacucuuuauccacauuaagugauaacuggaaauaauagauaccauuuguagcagagucuugagggaggaaaggguucuuagcauauugcugguuucaggcauguguggaaaggaccuguggaccaucaguugaacuuagccccuggaaauggcaaacuaggugugggagggaaggcaacucuuggaaaagggaaugagguagcauaaggaaaggaaauggcuuuucaccugauagaacacuucaucucgaagaguuuuguucgaugcuuggauuaaccuggaaauauuaauauuuuuguaaaguauauuuugucauaguuuauuauggugcuauauaaaccaccaauauuucuuaaaaucuagguccaaaaagacaguguuuaaaacugguagaagcaagugggggcaaugucacaaaucaugauuuggcccuuuucuauaacuuuaucuagaaaaggauacuaacauuuaguuucuucucucauuuugagaaacacaggcuucuaugauuucagugggguugacaguguugccuaggaaauccuggcguuaaaaugggagauugagguguggguagaggcuuuaagcauuaagaggacuuguagucaguugaacaacucugugcugaauauuaucuaauuugaugagaaaaaggagucgucuuaccgguuucuguccuugguucuguccuccuuagcauuauuuauuaaugauguggaauacucauuuguggaugauucaacacaggcugaaaaaagaaucucauuaacagaacaaagguuaaaaagaccaaaucaagcugagguuaaaauaauuauguuuaacauggauaaaugcauuuaggcucagaaaauuaaugauuaauauuugaacuuaaguggggagcaaaccuggcuugauggcauuuugucagaaaaagaccuguguuuccauugaccaaaguuguaaugugacuuaauguaaugcugcguggcauuaagguucuggcacagagaaaaagcggggcucauccaggauugguggugugcucguugcauauacaguguccagggucucaccuccagagaugaagauuuaugaagucagugaaggguccugagaaucugcaugcuugauaagcaucacagaugauuucagugcaggugauucagagaccucacuugaaaauauauugauuuacaagauauguugcaucuguugaugacaauugauaucuauacuguucuuuucugcuacagagaucaagguaggagauaaagacuucggcgauuugggcugggcgcggugauucacgccuguaaucccagaacucugggaagccaauggggguggggguggaucacuugaggucaggaguucaagaccagccugggcaacauggugaaaccccgucucuaccaaaaauacaaaaauuagccaggcgugguggcaggcaccuguaaucccagcuacuugggaggcuaaggcaggagaauugcuugaaccugggaggcagagauugcagugagcugagauugugccacuguacuccauccugggcgacagagacagacuccgucaaaaaaaaaaaaaaaagacugugacaauuugaaaacaccuugccaguuucauuauaagcaggaaguucaguggagggcaacaacuaaaaaacacacuaauuucagauuuucaaaaguguuuaggaggauuauauaauuauuugaucagaaaagaacuggucucugucugugacugucuuaaauauuuagguaguuuguuauucucuuaggaauuaugaauuagauuagguuaagggauggggccagauuugcagaauguuucagauaauuuuuauaagauguaucacaaucaagaccagucuugauauggcuaaaagcugcaauaaagcauugcaguacuggaccacuguaguacuuauaccacugguuggaguacuccugugcuagacauaggaaauaugaaaagacauaaaagaaagugauggaagcaggguaguguuucaagagugaaguaggaaaacucuuaagugaagaaauuaaguuuuuuaaauguuggguuaauacagggugaucauacuucccacuuaggauaguuuggcuuauuucugcuguucuguuguaauuauuaacggugaggucuuuaaaaaaguguccugguuagaugaaaaauguauacagucaccuaguuagaaguggcauuuuaugaagaaugacuucaaauacccauuuggaggcacaaagagggaggggugauaagguuagagggaauuugaauuuuuagucuuuacuucguuuagcuguuuuuuuuuaauguuuauguaauagguaggugauggauuuuauuaaguggaagaaucugugugauggguagaaaaauuuuauauuuuuuuguuauaaucauucuauuaauagaaguaaauagaguguuugagaugauuaauuuucuuuuucuccuuugcucacagcugucuguccauucuuuguuuguauauuuucuuauuuuuaguuuaucugacaaugaacuacauggguuuuaacaguuuuauaauagagcuauauuuguuugaacauauguuaaaaagacccugcucaguuuuaacuuuuacucucuaauacaucaugauuugugacaguuugaucauguuagagugaauauaacuaugcaaauuauuugagauugcuuggaaguuuuuuagaacuugaaguaaucaccuuuuuuuguuaaccauaccaacauuuacugauguacauaaaaugauuuuauguuuacuuuuuuagaaccaaaauuuugguuuguauaaauauuacuuuuuauaauugccuagcauaauauugggaaaaaucgcugcuuaucacugcaaacuaaugugcuuacuaauguuuaauaauuagaaaugauuagaauuuuuaaauugcaugcugaggguuuuaaucugaaaauuugaauuuaauuuuauuucugaacaugguugcuuuuuuuaaaaauugcuuugcugcaguuuuagaaaguaguugcuuucuucuucaguugauuagguaguguaagacauuaucuguauguggcauuugugacuggccaacuagacaaguguaaugcuugauuaagccuuggcuauucuagcuguauucugaagaaaauguuuguuauuugccaucuacugaauuauacauaauauaugaaaugaagauaauugacauaauaguauuuuaaaaucugagaacauguuuugcccaaauaguuagaaaaggucuguuugggacuaugucuuuauagagucuuccaucccaucuccccccaacauccccucacccauaccugucacuguuuugcacuaucuaaagaccugagagaauguuaaccuguuuuuuuuaacuuuauccaaauagaaagguauuggcauuucacaaauuauaguucaagauugguccuaagacauuaauuuuccugugaaacuuauuacuucaugcauucauuugcuguccuaaaagucauucuguuaaucuguaaaauauaaguuuagauaauuuucaugaucuguugagaagaaagaaaaaacucccgaaucucugaacuugucaggcaccuuuuagcauaggagugauggucaaucuccucucuggauguuccccuucacuguggcagcuucagaacaucugcaguuaucaaggacagaagcuguuccgaggaaacaaaggucuuuucuacuauucauuuucuaguucagcucuguucuuuucuuccucuggcaguaaugguaacagcaguagcuggagcagucuugguuuagaaggagauuuguaugaggacaauuuauccuuuccaacaucagacagguugguccagucuagaaacuuaaaaacugaugagucugucaccacuaaugcaugaugucauauucuucaaagaauguggguuacagugccaguauguaucaaccugcuuuucuccuauauuuugacaugauucugcuugaugaauucacaucuaaugaaaaacuucaacugugcuaagauaugacugacaucuaauugcaaaaugugucacuguuaugcauguguugcucugcuugcuauuuuucauucuaccaauuauuucauucaaaagagcuugcuuccuacaggauuucuguuggguuuuuuuguuauguuuuauuuuugugugugauuuuauuuuauauauaagaaaaguauagguaaaaaguguuuuuacuguauuaaaaauauauauaaauugcaucagcuaaaccauuaacaaauauuccuggcauuuuguaauauucaaaugcuacauuaaauuaguagacuauuucaacuuuaaaugauuuuaaauugaauauuaugaaauuacauggcacuauguaucaugguaagguaggauuucuugguuuugauaacuuuagggaucauuugcaauucagauuuuaacaugaaaugaugugagaagcaaagcuuccuuuuuuaauugucauuucuccccuuucuaaaugucauaugucauauuguaacauucauucauuaccacauuuuuaagaauuuguuuugauaccauuauuaauuaaauuuuuuuuguaacugcuucugcuauuuuauucauaagugauggaccagaugauaaagaugaagagcaugaggacgaaguagaagguaauuugauuuguuuuucaaaguguuggcauguguuuuguauaagguuuccuagaagagucuuuaugcauuuucaucagauaggcucuagguuaucaguguaaaacauuauaaaucaggguauucuugaacuaauuuuguuuguccacuuuuagauccuuuguugaguaguuuuauuugauugcuacacuaaugaaauugucauugguauaaagaaauacugggcaggcacgguggcuuacgccuauaaucccagcauuuuggguggcugagguggguggaucgcaugaggccaggaauuugagaccagccuggccaacauggugaaaccccaucucuacugaaaaugcaaaaauuagcugggcgugguggcgggcaccuguaaucccagcuauuugagaggcugaggcgcaggauucacuugaaccugggaggcagagguugcagugagccgagaucaugccacugcacuccagccuggguaacagagccagagacucugacuuaaaaaaaaaaaaaaaaaaaaaaaaggaauacuuuaugagaauuauuugacuauuugagagagauuaauuacagucucucuacauaauuauuuucaaaauacaaaagcuaaaauucuuacucauguuauaagauaauuuauuauaacuauggcauauuauuuucauaauauuuuccuuccaaacugguaacuuguagaaccaggguuucaugucaaacuuacgugagucaguaaguaauauuuuuacuuaccuuguuuucuaaaagauauuucuaaauuaauuauucuucccucccccaguuccagugcuucacucacgcauacacauauuugaagaaaauacucagauccuuccuuaaugaacauaguuccaaguaugucaauacuagauaucacuggccacagaguuuuggaccauaguuuguaauccuuaauucauguuagaguaucugaguuuauucaucugagugaauuuagaaacuuuacuuugaagcugaguuuucauuauauucaggcgguuguugaauuuuuuucugaaagucuaauuuuuuucuuaauuuugaaaauaccaauaaugucuucuauaaagugcacuuauaaaaguauuuguacucuuugagauauuuguuuuugaacuagugauguuuuaaaaauugcuucucuagaagcaggcaaacagaaaauagcuaaaaagaauuucucgaaauuuacuuuaugacaccugaauuuucaguuaguuuaacaccuuguuuagggaagucacaucccaguuuuuaagcuguaaucuucagacuuaagauuauuauuuuuuaguuuuaaugccucuguaaguagacauucuuuauauaaggcuucuagaagucaguuuuucucaucagauauaaagucgagauggggcaauauuuuuaguguuauugauauuugauauugauauuccccacugcaauauuuguuucauucuuguucacuaaaaaaguguugacuuuguuuauaaaaguuaugccuuuucucaaguaacaucugugaacaguuauucuaaaggcuauacaucguauaaaugcaugugguuacguauucucuaaugaacuagcgauuguuuaacuagcuuuacugaggaaugauuaagaaaaaagaagauacaaguuaauguaaauaugaaauuuaucuugaaaaagauuacuuuuggcacuaaccaggcuguuaaggauuucuuuuguaguugguagaaaucaggagauuaauuauauguugauaugucauuacugaguuuuugagauuauagguauuucucauuauauagaaaguuacagccagcuuuaaauuuguuagagauugguaaauuaggagcuagauuggucuggauuuauagaaagauucaaaauuauggaaaucccaaggcaacaaacuuauuuuuuuaaaaaaauaauuuuguaguugcaggaugucagucccuccccuuuucacuaaugguuagagacuucucuaaagagagagccguuuggagguucuuguaggccaggcaaccaggaguccugaacugagaaaacaccagcagugcaaagaagcagugggaugauuagcuucuagcccccugaacuccucaggauugcagaaaggcccagagaccaugccuuguaccaugguaugccaaaccuauuuuugauugagaguguuggagagaggggagggaagagacaauacauuuauuuuuagagaguaauguggaccaaaucuuuuuaauuaaaaauuagggaccaacacaacuccuaaaaauaauuaauaguggucuagaauggccugcaagcuguagcagagaaucagagacaucugucaacaaccuuccauuacugguacauguuggcaugaugucugccagcaugcccuggugcucaccucuugugguguguguuaagggguggagggguccuggucucagcacuccuuauugcucagguaucauuaagcagcaggaauguuaaacgcaugauauuggcccauaagucauuauuucugucaacagagauggaucccucuuugugaugaaaacauaauuaucauaaaaaaagaaaauaaauuugagauaaucuugagacuagaaguauaccagaaaauucccugaucuggcuuuuggguguaagugguugcauauggcauuuccccccacuuuugucugaagaaugagagauuaagagcauggagccagacugccuguguaaauguccuggcucagccacuuccccacuggaagacucuggggcucucuuugccucagaucucucaccuguagaauggagacaauaauaguuucuaccucauagagugguugugaggauuaaaggaguuuguacauauaaagagcuuagaacaauacuuaggauggaauaugugcugcacagauguugcugcucuucuuuauuugagauuucuguuuuuuugugggguuuuguuuguuuuuugggacaaagucuugcucuguugcccaggcuggguggugcaaucucggaucacugcaaccucugccuccuggguuccagcgauucuugugccacagccuccugaguagcugggacuacaggcaugugccaccacgccuggccggauuuuguauuuuuaauagcgcugggguuucaccauguugggcaggcuggucucgaacucuuggccucaagcgaucugcccacgucggccucccagagugcugggauuacaggccugagccaccaugcccagccucauuuuuauuuuuauuguaaugauagcuuuauaguuuuauuuucucucuaacccacuggucauaauuuauaucaaauuauggcauuuauagaacuugaauucaguauguuaaaaugauguuuuauauuuuugcaaucaauaaaugaucaaaguuauuccuuuguuuuacauuauuuugcccuuuagaaguuuuaguugagguuauggugugguuagaaaaagauggauauuuuuuucaccauucauuagaauccuaagaaccagaaaauauuuguaucuacuugacaaccagaguauugagaguuaaauugaugaguuuuacuuuauauuguuuacauuuaaauauuagguuuggggcaagauggaaagacacugcuaauuacgaauauugacauggagccaugcacgguagacccccagcuaaggauuauucuucaguggcucauugccucugaggcugaaguugcagaacuuuauuuucaugacucugcaaauaaggaguuuaugcuaguaaguaccuaccuuacagagugugaggauacauuuaacaguauaugauguucuugucaugugauuggucuaacaagaugccuggugaugguuaaauucuuaggcuguaguguccaacaguuuggguucagacaucagcucugccacuuucuagcaguauaaccagaggcagguucaccagucugucucauugccccuaacugcacuaugcaaaugaauauagaaucuaccuuacagggguuuaugaggauuaaauauaauguuaaaaaaaaugcuuggucuaaugccuggcauaacacuaagcucucaaagguagaugcuauuaauaagcauuguguguguuccuaugaaaaaauugaauuauucucuguauuuaauugauuuguaauuguaccuaaugauuaauauaucuguuucucugauaauccaguuucauuuguaugagcagcugucauaauuaaaagccgauaaaaguuuaaacaagaugcuuacuaugugccaaguaccuuauuagucaagauuuucaguuuacagucuuaagguuuuuguuccauaauuuucuuuaucagaacuuuccuuuuggggugguagaaauauucgaauugugguguugguugcauucaacuuggagaacauacuaaaaaccauugacuaggacacuuugggugaauuguauguuaugugaguuuuaucucaauaaagcuguuuuuaaaaagguuaagcauauauauguuacacaaaauuaaaguaguuuuucagaauuuaacuuacagaucuuucaaaacuuaagagcuuuuacagaacuuaguagaaaaagaaaugaacaaaagcaugucgugaguggugacaacaggauuuauuuaaaccuguauuuauuuauuuauuuauuuguuguuuuguuguugaaacauuaacauucuuuaacuuagaaagccauguuuccauugaggcuagaguguguauuccagaaaaaugccacacuauauguuguggaaggaaaauccacauccuuuuauugaguuugacguugucuuuauuauuuuauguccuaauugaggguguggcaguuguauuuaguuaggugaagaauuuccuguagaaacucagccucugcauguccaugcagacuauuugcuuggugagguuuguggagcucugucuccagcgaucccaaagugucauucucuggaggagauguguuuauaaaggggaagaagggaaaauguuuaauuuggguaaagggguagcgguuuagaggggaagaccuuguuauaacuaggaaacgguauuuaauuguaaacagcaggauucuuaaguuucagcuaauauugaaaauaaaaauaaaagcuuuguuauaaaauuguuuuugguuaauguuugacacaucuuucuuucuuagcuuucaaaacaauuacaagagaaaggauggaaagugggagaccuccugcaggcugugcuucaauacuaugaagugauggaaaaagcuuccagugaggagagaugcaagucgcuguuugauuggcucuuggaaaaugcauagagcaaaccccaaaccaguauauuuuaguauuuguuuggggaggggaacaagccaauaaagauguuuaggauaaaauuugaauagugaauauuaacaucguaagucaguugggaggcaaguaaauauagcuuucugagcgcuuuguguuaucacucgguguauauaguucauacuuuuguaaucugucaaaauacuaccuucauuuauucuucuauacacauguguagugugucaagacccuaagaacauguauuugaaggaaggucuaaccaggggguuuucaggggcauugucugaccacauucuuuuuguauccaaauagugcugcuagaaacugcacugaaguggcugaggauagguuccagugauagaguuauaauuuugcuccuuugcaaacaaaugguaucuaauuaauaacuagucugacaucagaaaauaaaauugaggcugauuuuuaaaaauuucuaguagauuuuuggccuuuccuguuuuuaaaaaucaguuucauuuucauauuucauagaucagcuauugguagcuuuuugauuuccccaaacuauuuaauuucuuagcagaaacauuaguauuuuagguuucuauaaacacuauaagugauaguuucccccauccuuucauugacauuauuugccaaugcugccagucauucuggcaugaaagguguguguguguguguguguguguguguguguguguguguguguaagggaguacuuuaaccuugccaguuuguucccucuuuuauuuuacuguuuucuuuuuagaaacccacuguuaaaauuuaaaaaggugcuuuaaaauaaaacgccuauaaagauugugcaguaagaauuuuuauugacaauaauuaaaauuuuuuuugacaauuuuggguucccaacuuaucuuacaagugaaaacuuaaauuguaaaacauguugaaauuuuaaaaauuaauguuaauauggaaaugcauuuagagaagcccaguaguuuuuauuguuggauuuuugaaaaaaccucuaccaagaaugugguguuuuuuuuguuuguuuguuuguuuguuuuagaaaaauugggauuuccccccaccccgccccacccagauaaacuauaucuacacugucucgucaaguucucugacacgaucuuucugggcucuacauuuccuacuaguuuguguccagaaacugcaaguugacaugaauagaggacaaagguugugucuugcuuuugucucucucuucccucccugcaacucucucuccccuccucccacucucuucccccuccccccuccucccacugucucucaccucccccaccccccacucucucucaucucucgcuguguccuguguauguguggguguguguguauuuggguguguaaauguugguucuuccacuacuggauuuuguaaucuaggauaaaucacuuuuuuuggggacuuugauuuugcuccauuacguuuucauuuuuucugagcacugacuguucugaaagcugcacaaaacguagaaagaagacauagcgccugccagggaauaggaaaugagggcacuuacacauuaaugugaauuaguaauugugguauagaaauguuuuauagugaaagauucaaauuugcuuuucaagaaaaaugccaaaagcuauuuaaauaauucgagguuacaucguagguuuugauuuuucucaauuuaagauacagaaauacagcaagccuuaauauaaaguuuccuaaaguuucuucaaguauuuuuuaagguggagaaaugcaggaauuguauaaccagaauuguuccugccuuuagcuuuucagaacuugagauguggcagcacuggacuggguuuuuuuaaauguuaggacuaggaauguuugcucuuguuaauuaugaauuaauugauuauuaaguuuagaaugcauuuuuacaaguaucuaacuaucaaauuguguuuaguaacuugaguguaugcacaaguuugaucaacagcaaaauagaguucugaauuucuuuuaaagugaugauauauuauuuugugaaacuuuguguuugaaaauguuuauuucuguuuaugguguaaucauucugaggugaggcuuuucuuauuuccuuugcauuuugcuagagcugugcugaguucagcauuugcuuauuuaaccacuacauaaugacagaccaguuauuagguauuagcaugugugguaauaauaauaguggaacuucacacuuacaucaauucagugcaggggcauagaauaaaauauuaaauauuggcagauguaugaaaagaagugugaguuaaaaauauugaauauuggcaggugugaaaacaagugucaaaauuccucauauagagaaaauaauuuugaguuuagaguauuaucuuuuaauuaaguguagucuaaacuuaacuuucuguaaaggcacuuugugguuuuuccaaagauguucuagaucuauuugguugcucuauagucaaacagcucuuuugaagacaacugucuuauuuuauuacaaauuggcuugacauauuuauacuguaacauuguaauauugcugugcuguacauuuuggcccuuacgaaauacgucuuuuucagaacuguuaaaguuuugauguacaucgagcugaauucuguuuuuaccaguuucaaaaccuucaagugauauguggaaaaaagugaaugagaccucugauaggggguuuucagaaccuuguucacaccaaaaugugacaguucuuucauguuuuccuaaaccaaguuaaaauuacauguauauuuugguguuaagguugauuuuuaagauacuucugauuuguacaaaaggaauguuuccuuuauaaaucacagaagaaaaugacaauaucuguuggauauuugauauaauuuaaugguguuauaaaaccuuuaagaggauucauggugaauauaugugauaacaucuuuauacuuugaaaaauguuccacuuacccuucagauauuuguuguaaguuaauucaauucuuaauacuuuaauuuugcuccaacaagggcuuuauguugcugguaagagaauuuauuuacuaaaugcacuauguauaaagugaaagauaguuuacuuaucugacuuugauauuagauggcugacauuagugcacauaaugcagaguuuaaccuugauucuucaacagaguccagauuuaaaugucuacuuaguuaauuaguuagcugauauucuuccacaauuaauauauucaauuucccaucaguauaucacuuuaaauuuuauguuuuucuaaggaaacuuuccacagaauuuuaaacaacugaugcauccauacucaggguguagggagaauacuuugcauuuaaaaacccuguccaccugucaccagcacaagagaauuagagcuucagugagaauuuagaaaaauuauacuaaagugagaugcauuuuuucucauuuucagcaagacuccucuaagcauuuacucauuuacuguauuccugcucugaagauguggauacagaauuagucacucuugucacuuuauuuauuuauugguuuuuuuuuaaccaucuguguacauuccuuucauaggguagaguucuaguucuagaaguucuuauuuuguuuuuguuguaauguuugaauacuauuuaauauccgguuuuaauauugcuggauuugcuaccuuugguuacuugugcaguguuaaaaguaauccacuuucuuguuuaauauaccagauacauagcaaaagcagcuuggaauaauuauagcuguuuauuuggcugugcucaguuacuauauuaagaucuuguacuguguaacaguaacucuuuuuugcuuuucaguaauuuaauauguucacuuaacaaaauacgaacuuugagaugcacuaaaguuuuguuucagcaguggcucaaaaaauuucagaaauuacuuuuguaauuauuugcaauuaauuguucuuuuaucuuacaauuguuuaagccugugaucuuucuucucccagcuaagaguucuucaauaaauuuaagaaauaccugg

SEQ ID NO: 17678 - RNA, 5590 nt, Homo sapiens
uaggagacuaauaauuaauuuacuauaauuuuaaaggcaaagaguuuuauauuaauuuuacuguugcacaagcaguuauuggaagugggggaaaaaaagaaaacuggugagagaaauuacauggaaauuauaggaaaaaggaacuugaauugguaauuuggcaaagauuugggaacaaauaguuugaacauagauuucuuucaccuuauaugauagaaacacaaggcacacgugagcuguauagugugcugagcacacccccagaaaacaaaaaauaucacauugaugaaguccgagacuguaucuagaucuuagcauaacuagugaauucagggagcacauccugcugcugaaauugagaagucaguaagaagguaguucagaugaccuaaucauucaagacauuugauggaguccacacaaggguuuaugauguggggcaaauaucugugcuuucucaucucagugauugaugucuggagaacuagucagacacacuuagcugguuccuauagaaaaacaccaguaaauguggaucagaccauacccugcagaccaaggagauuuucuuaaacuugcuaagccuuucuuaaacuugccaaguauuagcaaugauaauugcuaaauggauuuuuuccuuucacugaaacaacaaaacaauuauugaaauucacaauaccuagagaugggaacaugguuuagguuuauccaguucuguaacugacuuuggcauuggcucauuguguccuuucuacaaguuauguuuuggugacuugguguccccaguuagaaauggcacacaauauuaucaguuguuaguacuugguaacguuucuuuuacuaaaggaauuauauaaguaugaaucauaccuaauuuuacaauuucuuucccacggucauuuuggauauaaagauagacuucccagacagugagguuagaaauuagaaguucaaauugauaucccugauguuuaauuuaaaaaugaaaguaaaguuaaaauuaguagcauuuguaccagaguagauuauggguauuuucaucuguuauauuacauguucauauuauucauuuuaggauaggccaaaacucacuucuaaaaucuucaaaaauuuugaauaguuucauuuuuucaauacuuaagccaaaugacaauuuuauagaugugaauauauguuuuuuaaaguuaaguccuucauaucuuuucuuaguuuaacuccccaaagaggaaaaugucucuuuaaaccaguaguuaaaaagauggaguaugugauguuccuuucucuguacugaguucugaauguuuaauccagagcauggaucacugacugcguucucugacuguggaaugguauucuuucaugcaaaguacuuucaaaacuucccauaaagaaacuaaacuagagauugucuuuauuaauuaauggaacucuggguaugauuaagggaauuaaauuagaaaguagaauaaccuaguuaaaaucauuauauuaguuauacaugagagucagugaacgaugacuugauuuuuacaugacauuugaauucugucacuaucugauucuugaccuaaagguuucuuugcuaaaucugauauuuauuauaguauaauaugauaauuuggagcuccuguugcaucucacugccccaaaaauguuggaaugccauaugauacagggaaaagauuggaguucaucaccguggaauuuugaucugucuuaaugacacaacuuaauuuucaugaugauagaucucugaaugauuaauccagaaugauuugguacagugacuggaagaaauuguuuuucugggaauuugcuucccauaaugaccugauauacaggugaccuuaguauaauugaaauuaauuauaauuuuaauuagaacaugcucuguuuacagauuauaauugcgcagcauuuuaaaaaaauauacauaauuaugaggaugagagaauugcaaacuugaacaguucuuuuguuuucucuccuuuuacuugaaaagcuuucagaaagcuuuugaaagaugacacaguuuucauagcaacaguaugcaaauuagguuuuucugccaagaaacucauaaacuaaaguauggaauaacacaaaugcuuaaucuuaaucuuggcuuuggauuuuguaagcaaaagcauuuucugcaucaauuuuuuucaguaugcaguugcauauuucauuuuuugauuaugucaaaaguugaauucucauuuuaugcuguguuucucauuaguugcaguaaaguguugauuucauugcugccuuucaggccuucaucauacaaacccucaccauuuuucacuccugugcuuuugccauagguuuuuuuuuguuuuugguuuuuuuccagcaacuaguuuuucuacuuucacucuuucccaccagaguggucucucuaaaacaaauuugcuaaaguucuuaaguaggcucuuuuuucucuaaauuacagaauagcaaacuaacuccuaagcaagaugagucagugucuaugaccuugccucuuucuuccuuuuuaguauccucaccaaccuucccucuguugacuuuuguaauccaggaauuuggaacuacuuaugacuuagugccuuggcauaaucacaugccauagaugaacauguucaagacucaguucaaauuuaacuuucugugaagcccuaccugacuucccuaggcagguauuuucuccaugccuauaguauauugaaacuuuuucuguuaaaauaacauaacauuucaauuacacacacacaaccugucucuuccacugaacuucucucucccccuuuguauucucagugucuagcuacacauaauaggacuuugauaaauauuuuugaaugaagguaauagaaaacccgaacuucucuauauuuguguacuuucacaaacaaaggcuuagaauuccacaugaaaguccacaugagguaagugugcauucaugagcaugugugcacucugggcaaaccaacagaagauaaacagcaaggaagagcaguuguuuugugaaaaauaaucaucuguuagcuguaaaucagaaauauuggccaaaucagaauucuuguuucuaaaaugaggcuucuaaaauuuucacauaacugccaaacucuuauuuguaauucuuaaauaugcccuaaagaucaucuuucucuuuuauagacauuuaguguauacaguccacauaaauacauauacugauuaccuacagacaauaaugagacuucagaaagaaucaaaagcaauagugaugguggaauuuuuaaauaauauucagcuggggggaaauagacugaguuugugugauuucagguuauuuagaguuauuaauguaaacauaagaaggcuugugacucuuaucacccucuauagaauauaaagacuaaaaauaaaaacuauuaccucugggccuguuuuucuuugggauuagauaaagccuuucuaccauaucaccaaauacucauaaaggcuaacacagaaagcuuuuccaaguuaauaauuucuaaaauuaaauaucagggccaggugugguggcugacaccuguaaucccagcacuuugggaggccgaaguggguggauuaccugaggucaggagcucgagacaagucaacauggugaaaccucaucucugcuaaaaauacaaaaacuagccaggcauggugaugcacaccuguaaucccagcuacucgggaggcugaggcaggagaauugcuugaacccaggaggcggagguugcagugagcugagauugcaccacugcacuccagccugggcgacagagugagacucugucucaaaaaaaagaaaaaaaaucaaaauaauuguaauuaacugaaaugcccuguuccuucauucacuugauagacuuuucuaccugcucuauacuuggcacucaauuagauucuggggauacagauaaaauaagacaaagcucccaucugguagaguccaaguuuguuuucacaguuauuuuuccacagucuguuuaagguauuaggaggacuuuuauaaaccgaguguuuuucagguuacuucagagaggagucuccuuccacccaaaaaaacuaaccaaauuauuuuaucauaaagagguaaucccauuuuuauguccacaauuuuuacauuuuuguaucagccaccaauaauuuugacuguuuugucaaguacauauuucaucaauccuauuuccacagccguacaugugaucccagugacugauagaucuguagaaugugaacucacauuuaaaguuuauuuugggaaggcauauaugccuuuugaugacacacacaccaaaauauauaagagcugugcaugguaaacccacaguagaagggaaaaaguaaugcuuucugguauacuucagaggcuccauuugaagaugugcguugauguuuccuugauuauuuugaaugaggaguaggcgguaauauuuaacagguagcauacguaucuaagcauauaguaaauauuacuaguacuugugugccaugaggcacuaauacauaggugaaacaaaaauauuuuuaguucuaaaaaauucucuagauauuuauggaugguuaggcaauaggguuccuucaugagaaggaaaaaacuguaucuuuauugucaguaaguguggaaaaaaacccgacuuguauguguauucacaguuugauaggcauauuuugaagucauuguuuuccaucaguauuaaguaucauccauuucuauguucucuagcaaaagaaaauucuuagugugauacagcuuuacucuuuguuugacuuuguacaagguccacaaaaggaggaggcucaaaagauuggacacuuuacccugacauucagcacauucauuuuaucuuucgauaaagauaaccagaaaucauuugccucuuguuuauuaucauguugaaaacacaacaguauaguuccuuuugucccuuacauuggaaaagguauuuuaaauuuagccuugccguauuauuuauaguuaggaauuuacuacauuuugguagucuguuuugaaacuaagcacuugugucugaaagaugcagauaauaucuaucuauuuauuacacagugggcucuguuugcugcagaaaagagugaaacuuuuaacugcuuagcacacuugccagugaaauauaccugacagagcagagguuauaacuuuggcucuaauuacuuuuaguaaugguaagacaacgugaguuuuguuuguuuacaugcuguuuacaauggcauaauuuuaaaaauauauacaauugagauauuuauugccuacuauuuuaaagauguuuuauguguuuucaccuuuggaauauauuguuacauuuccuuguacagauaauuuugguggcuuuguuaauguagcuaguaauuuuuaugacuacuaagugaccaguuuucggugccuuuuauugugggaugcaugauuauguauuuauuguacggaagucacugacguguguauuuuuguacuuugcugaaaguaaugguugauccugauguacaugaugaugaaagacaucuuucccaaagggcacugccuugagaucauccuucucaaauaaaaagaaugcauuugaagaaagug

SEQ ID NO: 17679 - RNA, 182614 nt, Homo sapiens
gauggcaggggccggaggccagcaccacccuccgggcgccgcuggaggagcggccgccggagccggcgccgcggucaccuccgccgcugccucggcggggccgggagaggauucgucugacagcgaagcggagcaagagggaccccagaaacugauccgcaaagugucuaccucggggcagauccggaccaagguagggcggaggaggcgggccugagggccgcguggaaagcgggagguggagagggcgcgggggcgcuggaacgcgccgggcgaucccgggaaggcggggaaggcggggaaggcggggaaggcggggaaggcggggaaggcggggaaggcggggaaggcggggaaggcggggauggugagacggugaggcggggcggggccuggggcgcgggcggggcggggagggguggggcggggcccgggggcgcuggaccgcggugcugcgggacggauucccggcggcugcgcgggaggcugcgagccugggcucccagggaguucgacuggcagaggcgggugcagggaacccgcggcucggcgggagcgugggaaaaagcugacgcgcagucgcgaguuccuacuuagggaacuuaaaaggagaguuucaauuuuucuucccugccguucgggggagcgugcgcaugugcuggccaaccagccugcgcugcagugagcccugcugcuuucccacuuaggcccacucagaggguggguggaaggugacaccggucagccuuuccugccccucugccuccugcugcggucuggaaggcagaagccccgaggcaggcaagugggacaugguguucgcggcuuaaccgcacccugcauggcuccaagggcuggccaggcuuucgugucgcagguucccgccaagugcaggcaggguucagaaccaugcguccaugguucuuuuuaauaaugagaaguuaccucugugcuguguggacauuaggaugguguguuacucuuguuaaugaagcuugugcugucgaccugugaggucucaaaguuaauuuuuaauuugaucaugaacauaccaaagcaaaugcuuauggauauuaaaggauuuuuauguauucuaauuuucauuguaauuuaaaaaucuucacagagagagucuguuaucaguagggaaauuuaacgaggauauugaaaacggaaccacaaaaucauuggcuugggguaccguuuuuaaaaauaaauuugcaaaaaauucauucuacaguuauuuuuaugaaaaauuuucccuaaggucaaugaacuccuauuuggaaacauaauuuuuauucagugccuguggaggccgguaacgguggcucaugccuguaaucccagcacuuugggaggccaaggcaggcagaucacuugaggccaggaguuccagaccagccuggccaacauggugaaaccccaugucuauuaaaaauaaaaaaauuagcugggcuuugaggcgugcaccugagaucccagcuccucgggaggcugaggcaggagaaucguuugaacccgggaggcggagguuguggcgagcagagauugugccacugcacuccagccugagcgacaaaaaaaaagcuaguggauuaauguuuguaguagccugccuccuuauuuucugaaauacauguguguaagaacaacacacaagaacaacuguugacaagaugcacuuacuaaagaguuagggauucagucacuuuaguuaagaguacaucuuguaacuccuuuuaauagugacguuuuugaguuuguaguaaauuaagaauauggcauuuaauguguuuuuuaagauuaaggcuuuuacaaaguuagggacuuuccuaaaaguguuuuuaauauuucaaaucuuaauucugaaaaaaguucauaaacuguguuaaugaugggcaaaauggcagguaaaaaaaaaaauuguauaggggccgggcaugguggcucacgccuguaaucccugcacuuugggagaacaagguaccugaggaucacuugagcccaggaguucaaggcugcagugaacugagaucuugccauugcacuccaaccugggcaaugaagcgagacugucucuuaaacaaacaagcaaacaaacaaacaaacguguauguuacauauuuauaugaaauggucaaaauuccaugcauacuuauaucaggauuaaccaguagauuuauacuguucgaaagaaaacugagagauggcucuaaauugaauugaaucaugucaaacaacaaauuuguugggaguaccacuguauuuuauagguuucaugcgcucguuguaauagcuaagauuauaugcuuauggagacuacaaguaaauuuaaaaagcacauuauuugugauuuucuaucugacuuucuaauaaaaacauuuagcacauacauuuugccaugagagaucauuuuugacuaugaaaucaaauauugcuugaauuucaaaaguguauugaaugucagaaauucagcauuuuacaauuucuccuauguuagagugcauguaaguucaucaacauuuucauauaugaacacuugagaucaggguauaagauucugagaccagugagcuucaaccucauaccccgccuccugcaacuggacuguucauguaugucacagacuucauuauuuacgucuuuuaucacauauacugauucuuggggaagaaagugagagcaauagggggaauuuauagaaugagaacuacuaaauuuaacguugguucccagucuucaauuaugauucagaugagaauuaaggaaggaucuuuagaaaaagacaaauacuuucugugucuccgcacagguguguaagaugggagcaccuggaggagagguaggcccuaagauuagcucaaagccaucuuuuuuuuuuuuuuuuuuuuuuuuuuuuuugagauggaguuucacucuuguugcccaggcuggagugcaauggugugaucucggcucacugcagccuccaccucccagguucaagcgauucuccugccccugccucagccucccgaguagcugggauuacaggcaugcgccaccacacccagcuaauuuuuuauuuuuaguaaagaugggguuucuccauguuggucaggcuggucucgaacucccgaccucaggugaucugcccaccuuggcuucccaaagugcuaggauuacaggggugagccacggccucagccccagucauuuuuaagacagcacaagcaguucuugcucaucuauccugcuuugucaguaggucaaaacuggucaaauauggaaugcuucauaugguucaaucuaauaugucaucauuuaaccaguuuuuugcagaaguaaauauggguuguuuuaggacaaugcacuaaucucagcuuuuucauaguggauuugaugguuuuuaaguaaagaauggaacugguaugcuuuugaaaucaguguggcuuaauaaaauccucauguguauuuuagcacccucaucauaacuccauacaguauacuuuuuguuccccuuuucauuuuccauuuauuccugguuucuuuguaugucuaugcuguccucucuacuauuuuccucuuccucuguuuugaacuuuuuccuuucucugaauaaccuaaguggaauuucagguggucucaucuagccacucaggugcuaaacacuaaaugauuuuaugccugccuuuauuucccaaagacaaaaagucacuuauguacaaaagugaaaguggugcugaugcaggaaagccaaaauggaguccuaacacuugucauaucucuucccccucuuuaccuucuugaguuuuuggauuugcauucagacauacuguuguagagaauuucacagguauuuacugagaauaagauauuuuugaaacaacgcuaauacagauucagacaaauuggguuuugaggaugaaugugaaagaagcuuuguguguuuuuuguuggcccaugaauacugcaaccuuucauuuuaugggaauggcuggaagaaacuuggucaggcuuacagccuaggauuguucaacaaucauaaaccaaacaguauaaacaaaugggaaccaucucaaugacuuuuucugccuuugggucaucucggcuaagguugugaagcugcaugugucaaaaauacuccugaugagguuuauuguguucucauuuauuuuuuauuuuuugacauuuauaugucuucuuacagcuaauggccacaaaugagucucuaaauuuagguaaaacauaccuaaacacuaaaaagauauucagaauuuugcaucaacauuuuaucuaggcugagggcgguggcuuaugccuauaauccuaccacuuugagaggccaagguaggacaaucaguugaacccaagaauucaagacuagcuugggcaacagugagacuccaucucaaagaaaaaaacaaacccaaaagaagaccaaaaaacacaccaguauucuaucuggauuaagauauauuuuuggugcagcaaaccaccauggcacauguauaccuauguaacaaaccugcagguucugcacauguaacccagaauuuaaaguaaaauaaaaaaaaaaucuuacuacuacuacuaauuauauauauaacuauauauauaacuauauauaacuauauauguaacuguauauauauaacuauauauguaacucuauauguagcuauauauaacuauauauauaacuauauauaacuauauguauaacuauauaacuauauguauagaacuguaacuauacauaacuauauauaacuauauauguauauauauaacuauauauguauauauauaacuauauauguauauauauaacuauauauauguauauauauaacuauauauguauauauauauauuuuuuugagacggagucuuacucuguugccaggcuggagugcaguggcaugaucucggcucacugcaaccuccgccuccuggguucaagcaauucuccugucucagccuccugaguugcugggacuacaggcgcaugccaccaugcccagcuaauuuuuuuguauuuuugguagagacagggguuucaccauguuggccaggguggucuugaucucuugaccuugugauccaccugccuuggccucccaaagugcugggauuacaggcgugagccaccacgccuggccaaaaacauguauuuuuaagcccaguaaggauaaugaucacauucuucaauugauaucuugguuuuaauuuaauaugaaggauguauaaguaaacucuuguuccuuuaugguaaggcaguauaugaaaguauugauuugcauuuuucacugccuuacaaaguacaauuugugccauuaaaacauuaucuuucaucacaaacccuaggugaaguaugcuggggaagccuugcucuguguuuuugaaauuguagguggcagcccauuacugggucauaugguucauggccagcauuuaaaagagaaacagaauaaauuaggaaauauuauuuaaaacuuuuagcuagaguucuguguggaaacaugggaaucauaaugauccaaauagaugggaaacagaaacauggccagaagaauauuaggaaaugagaguaaagugauacugacagccuuauugcucugaaacucaauaugaaaugagaagcaaguaggaacuuuuacauuuugauaggugaugagcagaaagauaucucaagcaauuaacacacauccaggucagaaguuggcuaacuuuucccauaaagggccagauaguaaauaguuuaaauucugugggccauaaggugucugcugaaauuauuuaacucagagaauggagguuacuaagaaggggagggugcuggggagaacuggauaacuccagaauaauucugagaauaaguucuuauucuggagaauagaauaaauucuuuuguacaguaaggugacuguaguaauaauaaagcauuguauacuugaaaauugcuaagaguagaucuuaaauguucucacccacaaaaaauuaaguaugugaggugauggauauauuaauucgcuugauuuaaucauuucacaaugaauacauacaugaaaaaucacuccauguaccagaaauauguacaauuuuuauuugucaauuauaccuuaguaaagaaaaagaaaaaaaauuacucuacuuugucauuguagcauaaaacagccauagacaauacuuuaaguguugcuguguuccaacaaaacuuuauuuaaggacacugaaauuugaauuucauguaauuuucaugugcuaagaaauauuauuauuccucuuuuuaagaaaucaguuugaacaugugaaaaccuucuuagcucgucgacuauauaaaaucaggcggccggcaggauauggcccauggauauagucugugggcuguaguuugcuggcaccuauguuagaaaauggaagguaguauaguuagguuugccaagcauugcaaaguuaaggugcuguuaaauaugauccacauuuaagggaccaaauaaagcuagauuucaguccauuuaaaaaaucuaaucuuuguagaacauuuuauuuuuagcuugguuugcgucuuugcuuccauuuuaaugugaacuaaauauagacuggaaauucugacucucaguacaguaauauaugguauaacaccuuucuuuccauuuugauuacaaguuaaacaugauaucccauuauuaaagauaagagacauaauaaauaauuuacuaaaccuuuacauauaacuuaacgaugccguauuuuaaaguaucuaaauuuagaacucuuucacuuaguuuaaguuugcuuguuugcuguugugguaaagaggcaaaagguuauaugaaacuaccaguauaaaggacguggggccccguucuguuuccaggguacaguguuuuucacucauauuggauuuguuaggcuuuacuuacucaggaaauguguuuauaagcaaagguuuuaauuaaagagaguuuguuuuacaucuaagaauagaccuuugaaaaaggccauaacauguuaguacauuacaguuucccuuggcaaauuuguuugguuuuguuggauauugaguauuuuacucuaugacuauuuagucacuggaaacacauuuguagcugggcaccguggcucaugccuguagucccagcaauuugggaggcugagcugguaagguugcuuaaugccaagagucugagacaaacuuuagcaaaacaaggagaccccaucucuauaaaacauuaaaaaauaagaaaguuagcugggcgugguggcaccuguggucccagcuacuuggaaccacugcucuccagccugggugacagagcaagaccuugccucuaaaacaaaagaaauaaagaaacauuuguauuuuugaguugguuaaaugauuuuaaaguggucaacagcuauuggugauaguauuaaauuaggaguuaaugugcaucauuccuauuuuauauaguuccuuauuuuuuuuucaaaugaucauauaugguaauaauucucucccuccugcuuuuuguuaugaggcuauuugggagacuguuaggcuucuguuuuauaugaggaaguacgguuaacuuugucauguguagggcuggaaucucugaccuucucacugugucauuugaguaucagcacuuuuucagaccaccagaauguaauuuagcauaauagaucuuuuuaaauacaagcuuggugcauuuaauucagaaauuuagaaauacuuuucuauuuagcauuuuauugguuacagagcaguuuucuauacaugaucuuauggaacaguuguguacaguuaccuaaauuuuauaaaugauuauacaaaaguuugaauaucugcugaguaacggacaaagcuggaacucaaaagcaguuccuucugaugauuguacccauaucccuuucacaguggauuaaaauggguggguuccagaugccuugcuuucgguagcccuguagcuucuugggcagugaaacuuuaaucuacagcaugcaaucaugugugugugcaggcagacaggcuccuuacuucucuuggccucucucuccuucuccuucccuucgcucuuuucucucucccuuagauuccucuuuuccucucccuuauuucccccuucuuccugcuccugccuuuauucguuuguuuaauccaugagcauaucucucaucaauguuuuagguuucaucaugccguuuugcauuuggauccuacguuuuuagggacagauauaugacugcacauuugaaaaguaaauuuugaaauaaaaaauuccagcugaaauuuauauucauuugaauuaaacuuaacaaaaauuauugagacuuuuuaacguacuuuuaaaaggauuauuuuagaaaaaaaugcuucuagguaccuaacucuucaaauagguuuucaaagaaaacuguuaguuucacuucuauaagguaagaugccauuuuugaaaggucaugguauaguguuaaaaagaaucaugugaaguaauuuuccacauggccuauuaaaacauauuugaggaaaaaauaugaguaaaauuuauuuuuaccuagcuagagaaugaaaacgacaggaauuuuuuggccuacuuuucuccaucucacuauuuuauguagguaagaaaaagugcaagaguuuuaucugagcaggcacggugauuugaguuguauuguuccucgacacucuuguaguacuuuaaaauuaugugauauuauaauauuugauauuuauaagaauauauaauaucucuguaguuugugaagcacagugguaaaaugaacacccgugaauccagcuucagaaugggaacauuuucaauaucaugcaucuuccugugugcuccuucucaguuuacuccuuuguugcuccucaauucaugcauucaaagaaauaucuaugguguuccaaguacugcuguagguaccagggauagagcaguaagcaaaaauauacaaaaaccucugcccucauggaacucacauuuuaaugcaaggagaauuuaugaacuuguaaauacuugaaacgcauaguauaugagaaggugauaagugcuauagagagaaauagagcauggcugugaguggagguggagugggaagggauuuuuaggcaaugagccauguggaccucugggugaagagcaggcuaaguagaaggaacagcagcugcaaagagggaggucaguggggcugaaggggguuggggggaaccaaguagaaaguugaaagugaguuaacaguguccaaaguaagguacuauagagaaaaguucuuagccuggguucaugcaucccugguuuuguuggguuuuagagggcucuccaccaaaguuuaugucuauguguaugccccucagaagguuaaaaccacugauuugugaaagggaacugcaggucagaaaauagagauaggugaaaaaaauacauauauauguaguaaguccucacuuaacaucguugauagauucauggaaacugacuuuuaagugaaaugacauauaacaaaaccaauuuucuuucucauugauguuauaaugaaaugaugcaugaaaaaguguuauucuaggaccuacuguacaucauuucacuuaacaucacaguuucugagaaccuauugauguuguuaagugaggacuuacugaauacacaauauaauuccacaguaauauugaacucuugaauauaaaccagcuguugucauuuucauuuggagaaauguuaaauuugcugguggguucaaugaaauggagugagccagcggcauagaauagcaagguuccuggagaaguuagauaguguuggguuugauucucagcuugucauguacuauauuauauuagaugaccucagacauguuacuuaagggggcagagaaugcugugcccacugauaacuguguuuuucuauucuucuuggcccaccauuagacuuccuuuuccccuugcagauagauggagcuauguaacugacuucuggccagugaaauacaggugagagugaugucugucacuuggccucucaagcugugggacucuccaugccuuauguuuucccucaccugccagguagauacagauuauccaguggaagcagccuggaucccugaaugacuucauggagcagagcccuuugugcuccucccugaaucccauuagccacauuggauuuugacaugagggggaaauagagcuuuauuguguuaagucccugagauuugggcauuguuugcuauagcaguuagcauacccugagcaauacacaucaucacucugaauugaggauuucuccauuuccaaauuggacguaguauuccuaccuuguaagguaguaauggugauuaaauaaauauaaaauauguuuuuguaucuguaauuauuauaauuauuuuaaaaaauugguauuaaaauucugauaauuacuccuaugugugucuuuuacauaauuuaaucugugguguguauaggccacugucuuuuguuaaugauuuuucaagugucuuuuuucuuuuuuuuuuuaagacggagucucgcucuguugcccaggcuggagugcaguggcaugaucucagcucacugcagccucugccucugggguuuaagcgauucuccugccucagccucccaaguagcugggauuacaggugcgugccacuguguccugcuaauuauuguauuuuuaguagagacgggguuucucuauguugaccaggcuguucuugaacuccuaacuucaaguggucugcccacguuggccucccaaagugcuaggauuacaggcgugacccaccgcgccuggccuucaagugucuuaugaaaaaauauuuuaauaagaaugaaugaccacuuggaggugguaguggaaauaauuggccagguuggcuuuuaggugcuucuauggccuguucuauuuaaucuugaaauaucuuucuaagagccuucuuaucugcccuucuucagcuucuauuuacucuucauucuacugcagcuauuucaugaaacuucuuuugcaaaggcccuuaguaauuuuaauugcuaaaaucgaguggucucuaguuuucagucaacugcuucuugccaauuuggaugcuauugaccacaucuucucacaucuucucuucuuuugcuuucaaaguuuaaguucucucucuuuuuucuuuuuuuuuuuuuuuauauauauagagucucacucugucauucaggcuggaguacaguggcacaaucuuggcucacugcaaacuccgccuaccagguuuaagugauucuccugcuucagcauuuugagcagcugggauuacaggugcaugccaccacgccuggcuaauuuuuguauuuuuaguagagaugggguuucaccguguuggccaggcuggucucgaacuccugaccucaggugauccaccggccucggccucccaaaguguugggauuacaggcaugagccacugggcacagccaaguucucuuaucuuucuuacugucuuuucacugccucuuagccucuaucccugauuccuuuaucuauugucaaauguuuuuguuuccuagaagucuuaauucuguuugccccuuccuaaguuaaugugauuaauuagauuaggcuuugaccaccaccucuaucggucuuuuucuagccuguacuucugagaucugggccucuaguuccuuugccuaccagacauuuccuguaggggguccccuagccaucucagucuccguauucucaaacugaacauauuugugcagucuacucauucccggccaaauuuugcuccacagcuuuuauguccuguagaauaaauugccucguauagaagggauugacuuuuugucuugcuaaucacuaucauuaauucauuugcuuucaucaaauacccauuuagugccugcuauggccaggcauaguguuaggugcuggugauuuagaaguguaugaaagagacacauccccacccacaaggaccucacucauagucaguggucaccaaauuuguucauuucuguauaucuuagaucuuauuuaauccucauaguaaaacuaugagguagguaaguacaauuauucucuccuuuuuagaaauaagaaaaccaaagauuagauaaguaacaugccccaggucacacaugucaagugacuuguuugaugccugauuuaacuguuuuugaaguggcuauguugucugggguauauacccugggguucauugucacacuccaggaaaacuuaggacauggacacacaggaggaguuuaggagcggcgguuuaauagguagaauaaaagagaaagggaaacaacuuccuccauagaggaaggggucuccgagcagaaaggacuggcugauggcaaaugcacugaguuuuauagucccguuugaggaggcggugucugauuuacauagggcucacagauugguucaaucagguaugauguuuauauagcauguguggaaggcugguugccccacccuaaucuucuuaugcaacugggcuuucccguugaucugcgccaucuugucugcuccuuacaauacacguagcuggcagagaagggaagauggaacugccaucuugaaaaugucuaguccuuaguuccugcaggcauucaccuaugcaagcucccagcuuguaggccgcucuuuguuagaaaaugauuuggggcugcuuuuuauuaaaaagaaaagccuuaccgaggacucccauacucuugcuaucugucuaaguaauuucuucuuaacuccuauaucauuaugauauacugucccuuugcugcaugaaucucuccugaauucauuucucccuuuccauuugcugcuuacccuaacuucauuuaaccuuuauuaucugucauuuggauuuuugccauauauuuccucucuucuccauucucuacuccagugccagaguuaucuuuguaaaagagaaauaugauacauaauacauuuugcauaagcucuuagacuuugcccauuacuggugggauaaagucuaaauuagucuuuucuaauuugauacuaaaugaccuuucuauucauucaaccaauuuuuauugaguucuauucuaggugcugagaugguaaaagaacauaaaagcccugcuguuauagagcuuauagucuaucaagggagaaguuaauuaacguauacacagacacaguucuaucauauagcugguguucauaagcauaaugaaggaagauaaagcaggguaaagggagaaagauggagaguguguguguggguguguguguguguguguguguaaaauauuuggguucaauugaccaggauagacucucuuugauaagguaauauuugaacagagaucuuagugaagugacagaagcuauguaugcagauaucugggcuccaagcacccuaggcagagccaaugccaugguauuccaguuguguuuucugucacugucauccucuguacagucaugcaaacucuucuguuuccaaaguaaggcaggcauuuucauccauccaaguguuacagguaucucccuuuuccuauuucucuguuugacuuuuuauuuauauaccauuauuuccacacauuuuucaaaauauucaaaaugguuuauauuccacacuguguauuaagcuuagguaaaauagggcuagaggacuaugagauuaggaagaagguuagaaggcuaauauauagagugaggugucuugcacagcuagagaugaguuguaaauuugaucccggguagccagagcagcaagaccaguuauaaagucguauuaccagcgggaaaaaagcccucuagauuuuaagggggaaaagcuuuucuagcuuuccuugggggaaccaaagaaauauguucuaucagucuuugaugugggugggagugaggucugcaauauguuccccucaccuacauccacuugggagguguccuuaugauguccucccuugugaggucaggacauaauccagacuucaacuuugugugacaguaguucuguaggagauguaauuaaggcaguuuuaguuacggccaacuucaggcauaaaauccaaauuauuuuugaagauugaauaaauggcauguacuugaaacaguucucggguuaaaccagguaucugcugaaauacuuucaaaguguagaaucucagguuaucugcguuuuuauuuaucuguucacuuguaguugauacaaggggauggagugauauguucuuagcuauuaugggaagaaaaaucugguauuucuugguggcucucauaaaaacugguaaaaugauucuacauucagguuuaaaaaauguucuuuggagcuuuaugagugcauugcagaauauuaaaagcuguguguauuuuaggauuauugugaaaauaguguugacuucauggaccuuugaaaaaggucuugggaacacuugaaaauccugcuagggcaauguaucuggaccuauuuuuuuuuuugaagagagugccaugaggauaucuggaggaagagcagagcaagcugaaagaacagcaaaugcaaagguuuugaggaagagacacaccugacacauuccagggaugagcauucccgaacagcugacacauuccagcuggugggaagggagugaggggaaagugaguagcaggaaaaaaagucagacaucaggggagcaguagagagguugcugugacaauuuccuugacaguuuagcacagugguuagcacauaauuagcacuuaauagaugcuaguuaccauauuaauauuaaaagaauacuauugccgauccauuagcaaguuugaucuuuaaaaucagcaucuaaaacaaacccuuuaaacgagaggagggaaaaaaugaagcaguggcuggagagggaugcuggggucaagcuacagcuuuuuuaaaaaagugaaaugacuuuuuuaggagaaagacugugggcuggccggaugugguggcucacgccugucaucccagcgcuuugggaagcugaggcgggugggucaccugaggucaggaguucgagaccagccugaccaacauggagaaaccccgucucuauuaaaaauacaaaauuagccgggcuuguuggcgcaugcauguaaucccagcuagucgggaggcugaggcaagagaaucucuugaaccuggaaggcggagguuguggugagcugagaucgcaccauugcacuccagccugggcaacaagagcaaaacuccgucugaaaaaaaaaauauauauauauauauacugugggcugaggagaauaaucuagcugagagaaaagauuaaaugaugcaaaaaaagagaggagaauuacuggagcaauguccuuauauaugcgagauggggugggauggcgugaggagcugggcuucccucagagcaggucaguuuauccauacaagccacuuuauccauaaaaugcaguaggggcagagguuggcacuucuagaaauuauuuucugauuauuuugauuuucccaguggaauaugaaguuaggucgucagcugagaaucaagauggagaggguauggaggucugaggcuagaggaaagguaugaaaugcuugaacaggggcgugggaaagggaauagacuagagaaaugcagcagugugaauaucaaguugcauuuagggcacaccugagccgggugaccaggacucuaagcgcugucagccuggugugggaucauguucagcugcuugggugcaguaagugaaguggaggacagggucaaaccacuguugcgguuugucugugugugccaggaaaagcguggguggauacaguaacaagcucuggaaaugauguuggaugaagagugagggcucgagucagguccuagggaguaaccaugggacugagcagcugagguaggaaggaagagaagacuguuggcagagguuaaguccaagaauuaaacuuuaaucauucaaauuuaaaaaaggaaagaaagaaaagaaagaguacuaaaagaaacuguauaauuuuaaugauuuuagauaugcauuagagaugcguuaauaacagguuuugcuggggaaaaucucuagcucauguaugcacagcugggggcccucuuuaguaaaauacaaagaccguuuuacuuagaacacaaaaagaaaguauccuaaagaaagaaauaaaucugauuuggauuuuuuuuuuuaaauuuacaaaugaaacccugaaaugcauugaagaacacgagucccaguuugaguuccuauuaggcaaguuauauaaccucuucaaaccuuacuuuuccucauauguaaacguucauaaggauauucugaggauuaaggagauaaaaccuucagccuggcauacaguaagugcuaguaaaugccaauuacguauucaggaaucuugacgugaagggcacuuuuuccaauagggcaccuccgaacgucagaagggugugagugaaugagaagcuagugaaaucuuccagucacagggaaagaauucucaugcauguucugccuuggacaagccagaaaccagaacuguuuguaaaccuuuuuguagauuuuguagauugaguaucaucuaaguagacagagcuuuuuaucauagaucuagcuaagauuccacaguaggaagggaagaauguugaaggaaauucaaccuucccuugguaauaaacacuucuaccuuaucaucauucauggaugucacaacaauuuuaaauuauuaccguuugaguauuuguggucuuacucuuucuccucuuagagaggcaacacccuagccuguuggaucaacuccuucauugucauuugcuauggaacaagggaguggauauaaugaagggagaggagagaaucacuuuauggcauugccuuaaggccccaggguguguggaguaauugagggucuggagugaacaggugagucacaggaacuuuacuuuccuguacagugguggacuggggguaguugaagggagaggcgaauaugagcauaugugagacauucuguaggaaauacuugggugaggaaggaggccggggucccaucggaguaaguaagggaaauagccaguaguaaaauguggauuauugucaucauuguaaccccauguuugucuguaggcugauaaagcuuggggagcuugauguacucuuuaauuagccacaagcaaugugaucauaugauauauaaaacauuaaaauuauuauuauuuuuugagacagagucuccuucugugauccaggcuggagugcgguggugugaucuuggcucacugcaaccucugccuccuggguucaagcaauucuccugccucagccuccugaguagcugggauuacaggcguguaccacaaugccugacuaauuuucuuguauuuuuauuggagacaggguuucaucauguuggccaggcuggucacuucugagcucaagugauccgcccaccugggccucccaaagugcugggauuacaggugugagccaccgcgcccagccgaaaacaauacaauugugaagcaguucuacaccauguucguagcagcguuauucauaggagccaaaaaguggaagcaacccaacuguucacugauggaugaauggauaaacaaaauguggcacacacauauaauaaugggacauuauucagccuugaacuggagggaaauucugacaggucacugugaggugaaaggucgcauuuucaggugucagggaaucuuuacugcaauuugcugacauuauugaacaccaccacauuuagcauauuuucacauaacaaaaaacacuacauguauguacuuaacauuuuauagggucgaucuuccuuauucaugguuucaguauuugcuaauuuaccuacucacuaacauuuauuugugacuccaaaaucaauacuuguauguaauuuuucacaugugaaaaauuggaguugcccaaugugcacauucgcagcuaagguugaaccuggcugugcucugucuucuuguuuuagcucucaugcaauaaacaagcacccuuucaugacgugguuuugcauuuuuguacuuuuuguugaugaucucacuguuuacagcggcccccugugcggaagugcugucugguuuuuuccuaaaaguaaaauguuaugaugugcauuauugaaaaaauauguguauuagucaggcuuccuucaggcaugagcuauagugccguuggcccugaguucaguguuaaugaaucaaguauacuuacauuuuguuuaaagaauguauguauauguuuuauuaagaauauaacauauaacaugugauguuauauaugucauauauauuguuaauauauauguauauacacauauucuuuaaacagaagcacacauaaaaugaaauuauauguugauuaauugacaaagauguugugaccagagguuugcaggaaccuaaaccuaguauuucccauagggucagugguucaauaucuguuaaucuagaguuguagugacuuuauugaacauaacuacugcaaauaaugagaaucaaaugcguguuaaacuauuuuaagggaaaaauaguauuaauuucugugcuuuucaaggaaaaccaauauuugaguugaaauccaucaguuuagaaccuaucaaaugagaauaguauaucaaaucagaauaguauacccaaaaaucucuucuguaaaaauagauacuaguuuaugcuuuaauuuucaacacgcuuaaaaaagaauuugaagauagaacacagaauuacucauuucauuuaagaagaccauuuuucucuccucaccaagcacauaucuggcuuugagauaauuuguucaugucauagaaaaaugucuuuuauucuagaaagaucauaaaggcuugaaaugacaaauagauaccauugugugugcuaacgccaacauuuuauauuaccucuuaaucuuuaguuuuaauuaauuauugccacaacugaucuagcaauuaauaguacauuucuugcuuuuauaguugauuuaauuaauuaauuaauuaauuuuuuuuuugcuggccauguuuuauuuguccuuuuacuucaaacaggauaaccaaagauauagacaguauucaauaaaauaaaauagaugaaacaaauucuaagagacugugacgccacaugcuacauuuaaccuaauuuuauucaugcuugccuugggauggggaauagaucauucagugaaaacaaaaugucuuaucauguacaacuuuuaaacuauaauaaugauguaccuuaauuacuuccaugcacacaauucuaacauucauuuuuuuaaaaaaauaaacacaauuaagacuucuagagcauuuuauaauaaaguaauuccuaauuaauuuuucuuuguagcuagaucaagcaccuccaaaauacaaauuccuauacacagugagcacguuacuuaaaaugaguauguggaccgccuuaggauaaacugacauagauucggcuagguaggcaacaaaccauagugccaaauggaaaaaguguauuugcaaauaaauuuuaaaaacuaaguuaauuuuuauaauuaaauacagaaaauauauugauuugcuaaaauaaauaagaugugauguauuaacacuucacuauaaagaaugaauaccagaacauuuauaaacagugaaugagucuuauuaagaauaguuuacuacaauacacacuggcuaaauagaagugcguuuugugaagcacuaugggugguauguuuugccgcauauuuuuguuacuuugagguagauaacacacauauaccaaauucagcauucauuuucaguugcuucugguaucguguguuuuacgaaauguguacaguaugaaaaacuugaaacuacucaugaaugaaaaaugucuuaggauaaaaauagauauuuucaugcaauuauguacagucucacuguaaauuucaaggcaaaauuuguuuccuguaaaacagaucauuguucuaugagaggauggucuucacuugucuuagugcauuucuuuugucuccuccugcauugcauuauuuugcucuauucauuuugcaaaugacaugucaguuaaaaugaaaacuaucucacauguagaaaaagaaagucuggauuuuaaaaaccaaguacucauaaaauccuuacuaaaugacaccaucugauucaaguaaaaaaugacuuaaacucuaguaauaaaaaagacaaaauacauuucauaagaauacaaagauaaaugucugcugaguguuuuaguucagauguucagaaugccgcuguauguuugaugaggaauuugaggggaagauuucauagcagaagcuguuaauguggccuguauugacuuaaguggugacccaacuggacugugaaacugcgggaugccuauugggcucgagcugcuuauuaaagaggaacuccucacuguuguucagaaauccuuccucauuucucucuccccaagcuucccauccucuacuggcucaguuucuagcauuucaggaucuucuuuccugcugaagaacuugucuaaguaacuaguguguuuuccuucuuaacuuguucauccuuucuuacuucacaaaacugauuuaugagaaaacaguucuccccaucacucacaaacuggcugucccaagaagauggguacaaaguuucuaauugagccagauuugccauuccuuuuuccuguuuuucuugacuuacugacuuugauaucaaacuuuucaauucuaguugggacacugagcuauucaagucgauuuaauuuaucaacaacaucaguagacucauguuggaaacuaaauugaauaguuccugcaauaaaggaaugaaaaucaaaucccugauucuuuucccuuucuuuuccagccaguugccgugaugcuuccucuagcgcuaucugggcuuuaaccaauccauuccuuucacauuuugauuuucuuuucuuaucagauuuuucuuugcuuuguucuuuccaauuggaaagaucuguaauaagcuuggguucauaguaacaguuaacuucauucucucuccaaacuaaguuaucuaaauaugaucaugaccucguuuuguaauuacaaguauggcuacacuccagaucacaauauuuguuuucaugaugaucuggguacugccaacaaggcucagcagaguaauugguauggaaagcaggaucccccagauaccuuucccgaucuccauccaaauaauuucagggaucgacuuguacuucuucaucagugacaucagacagagcucuuggauuaagcugaacuucaucaauaucaaaguuguuauguauaggccaaucaugcucugaaaacugacagucauaguaccuuucccaguuauaaaugugacugugaguuucauccauaagcaaaauauuaugagcuucaucuucaauaugaaaaggauggcuugaaauuggcuuauccauuggaaaagaacauaugcucauguaaggaugggagagcgcuucuucugcuauuaaccaauccauggggcuaaaugucaaaauuuguuccaggaaauucagugcuucgcgacuaauuccuggaaguagcugaguuaaagguuuguguggcucagucaugugauuucuaauguaaacuggaauuacgcugagaagcuccugacgaucuuccucaugugcaacaggaauagauucuaaagucagcugcaucuguucaaguucaugugcaccugcaaaaaggguuuuacaaaacagucagcauuucagcagagaugcagccugcagcccacaugucaauggcuuuaguauaauuauuaggagaaaguaaaagacauggagaucuguaccauuuaguaaccaauccuucaaaagaugacucuuacgggaauaaugaggauccaugauccgugcaagaccaaagucgccuaucuucagcaccaagucuucaguauuaaugaaaagauuaguugguuugagaucucugugcaguacauuugcagagugaauauacuugagcccccguagcagcugauacaugaaaagccuggcaugcucuuccaguaaagggcccugcuccagcacuuuagacaagucugucuucauguacuccugaacaauguaaacacuguuuaguuccguaagagagcccacaucaucuguuaauuggcucccacugggaccaggaauuucaaacacuuucacaauguuaucauggucaagucuucuaauaaucuugauuucacauagagcauguuugacacucuggggauugguaaggacaauuuucuugauggcuacucuuuugucacaaucauugucuacagcagaaaaaaacaaguaauugccuccacaacccagugguuuuaaguccauauacguagaauccagaucaaaaccaugaauguucaugagacuuucaaauuucucugccacuuugaaacccuuaugauugccuuuuccuuuggaauuguugaacuuguguaaacaaggaagaaaacuggcaucaaaaggaaagaucuuucaaaaagggauaagaaaaauaauuaugcuuccacagcaagaugguuucuugauguucauugcuucugccaaacaggccuguugauuuccccguagguuuaaagcucaaaaagcucuacucauguugagaauuuaaaagauugcaguacucauaguucaagaaaggggcagcaacucugcagacauuuaaagaagacacucaagaaacucaaacagaaugaaaugacauacuaugcacucagauuacucugcuaaacgauuuaacauuuaacaaaaaugugaauaaauaugcacacaacaggcuucuaugaacauucuccucacagugcagauacauucaguguuggacugguccugagcagcaucguucuaaggugcugguaagcacuauuugcguuuugcuucuuuucuuccuuuguugcuauauauuucaacaggaaccccuggcggcuguuggauaacagaagauguccuuuguuaaugaacagguggcuccagcucaccacaauuaaaaucaaagcuacuguccaucuuacucugauacaacgggacuucucugacucaucaagagagugcaggccccgcggacagcccccaaugucagcucaggucucuggcugugcuggcggcaguggugucucugaggcccucacuuugccgcagucaccgccauguaacaccgacccgugagagagggccauguugguuuaauuuaaaaggaacaacccugagacuagagacauucuuagagacagaaggaugugguuuacuuuuaucaguacauuuuauuuccuuuucccuaucguaaagacccuggcaucacuacucaguguuuauguaauagauucccaagauggucuuuaaaaauaggagcuguauuuugcuccuaugaguucauauugcuuaauguuugaauuagaagaaaaaacuuuuguuaggucacuuucuuauuaaguuuauauuugaacaguuaguaagcaggcauauugaaaugcuguaugacauaaccgcucuuaucuuugaggcaaugcaguguugugguuaagaucauggacuuuguguuuugagaaaggccuggucuuaaaucccaguuguccuauuuacccucuaagugacuucggguaaguuacuuaaucucuguaacccagccuuaucucugaaaucuggacaaucaauguaccuaccucacagaguugucgugaugauuugcaugagauaauuugaguauuuagaacuguggcuggaacauauugguucuuaaaagagauaaauuauuguauugauguuaaaagaauauagaugauguuccacaguaaguaaauaaaaucagcaucuaaaacaaacuugaauugugaugaucaagaaaaaaaauguuuaccuugcaaagaaauacagaucugcccacugucaugagacaguggcuucccauuagcucuguuuuagaucauuucuaaauuuacuagauuguaaaaucucauuaugaaagccuagacagggugauguauguggaguucuguuuauaauuaacaccuuauagaauguaauguuuuuaaccaaugaauuuuuaaacaaaagaaaaagggauuuucaacuaauaaaagucccucccucaccucagaggucaccuucucagggcgaccugcccuggugaugcuauccagcauugcaguccccacccccaaccuggcaugccccaacuuccuuuccuucuuaacuucuccccuuagcacugaucaccaccgaauacacuagauaguaccauuuucucuaaauccaucuucuaauauuagaauauaaacuccaugggggcagggauauuugucuauuuuuuucccugcccugucuccugugcccagaacacugccuguuacauagucauugcuuaaacgauauuuguugaaugaaaaagggaaugguucuaguuuugagaaauucuuuuauauauuuuagcuguuaugauaauguucauccuucucuuugcuaucuauuugguaagaggaaugaaauuuuagagcaguguccugcucgauauacccucaagauuuuagagcaggguaugcaguguauuaauucuuuguuuucuuugccauuuauuaaaauaguguguauuuugugcaggagaucaacaauuaguagaaugcaguccuuucuuauagugggggagacagcuauauguacagauauacagauggucuuugacuuuugaugguuugacuuaagauuuuucaaauuuacgguggcaaaagcaauacauauuuaguggaaaacauacuuugaaugcccauacaacuauucuguuuuucacuuucaguacaguacucgauaaauuauaugagauauccaacacuguauuauaaaauaggcuucauguuagaugauuuuguccaacuguagacaaaaugugaguguucugagcacauguaaaguaggcaaagcuaagccgugauauuuggcagguuaggcguauuaaaugcauuuucagcuuaugauauuuuuagcuuucuauggguuuaagaggauguaaugccauuguaaguugaggagcaucuguauaugguauacaaccaugcaugcaaauauauaugguaauggauacaugcugucacagaaacaaacauagcgggcacucuugagcagauauggaaggcuuccagagagggucacauugagcugaguauugaaaugugguuaaugacagucgugcaccaggaaaaggauagcauucuagcaugacugaacugcacaauggcuuuggcauuuccuccuaguacucugcuaugaagcguccacugaauucauggaacuuaguucucauagaaauuaucuugauguuuuuguuagacugucuacaacaggaaagaugaacuagaaaauuuacugaguuguuuauacucuuauuaugaucaaauaaguguuuuugaauuaaauauauauaaaauuagagucauuauugucuuaagguacauaguggaaaacucaauaauaguugaaggaagcugauuuguuugcauugcuguguuuuggacauagagaauuauuacugggguaauguguuuuguuuuaaagaguaauuuggcuuagguauugcuauucuucagaauaugauuucugccauuuuuaaacccuauuauucuuacagcuucaugucuucugucaggucuucacaucauuuaucaaaauuuccauccugaggaugauaaaaguucagguaucucauuccaaauugguugugaaaauuaccuagauuucaucuuccuguuuuccuucaaauaaaggaaauauuugcaaacuuuuuauuuaucagugacauaguaaaauaacuauuaagauaugauuugaaagaauccacauggaagggcaagaaagacacccuugcccuaccuuggcauacaggcuauaacuuaccuguuuauuuccuaacccaaaugauguaucaaaacaggccacugucuguauuguaucuauccguccauccauccauccauccauccauccauccauccauccaugcauccacucauccccuaacaacuugaauauagauccuauuuaugugcuggacuuacaaagacuaaugaaacacgucuacauuuuagcuguucacuaucuagugugguuaucuaauguugaagaaaagcuagagacaugcuucuaauaaaugcauaauuuaauuuagcaaaacaguuuuuggaaaaauagaauuggaauuugaaagugugugccacucaugaaauaaggguuacguggggcuuuguuucacauggagcaugagaguggcaauguguaguaauggagauuaaguuaguacagcaaacaggccuuuaugccuuuuauacuuacuaauugugugauaauaaaggaguuauguaacauauuaaaaccucaguuuccuaauuuuaaaauagagauacauucauaugguuggauuguuauacagauuaaacgagauaacugcaagugagcuuugauuuacuucuuguuuuuucauacuuuuuccuguguuagucguguuucugcaguuuguuaaauucauguguacauuuucuagugguguuugaagguguaauaauccuuccaauuuguuaauacauuuagaauagugcuuuuggggcuagaagauugguggugaccaugcugucacauuguuucucacuguucuaaagugaaagaacuuuauaaugaaaauauuuauuucaucaugaaagugugucucuugggacccaggacaucaaugaauaugagaucuaaguguaaaagugcacuaaggacuuggcgcaacuuccacuaucauuauuuuugcaccauuguuaaucuguauauaaaauaacuuuuucuuuccuuaaaucuuucagaagccccuuugaaacuuagcccuuaacagauuugucaacucaugccuguugcugcugcuagcuuauuuagucuacugaaagguuauuuauuaaugucuacagguugcuggagccacuaacugaaacuuaagaaaggugcagguggggacucuuuuaagccucaugccaugauggauguucauccagucaucaugguuaccauggcaagcacuggcugcuaccuguuucagcagcuuccuccuacucuuuccuauuuucagacugcuaucuacauuuuacaagcucauugucaccuuguuucugccaguguuaccuaauuccauccuugauuucuaugcuucuaauugaacuuuccuguuuuuauuuuuaaaggcaccaaaucuccagaacagucuuaaacaauguuauaauaccauaagcuuuaaguaucauacaauaauagccuuuuccuuuuuaauauagcccacuuucaaugugauucuacuuuccauuugggauuguugcguguaauccucuuauagccuuuuucuggaaauuccagaugguguuuguaaauauugugcaaguguauuuuguaaauaaauuccucaaaauuuagucuaugauuuuuuaaaaaaaccgaagucuguaggcaccaagacaccaacuuaaguuuuuaaaaaucacuuaacaaguaaaaucauuucucauguuguuugcagccuguguaacagacugcuguguuuguuggauaggagacagcucaauucuuuauuggcguaaagaauaaaagaauuauuacacagagagaaauuccauguaugcuauauuuguaugugcagcugaucuaaaguagugauucauuuucuauuaccugucauauucuugucacgcaaacuuucuguacuggccuuuuggauaauggccaauugaagagagaaaagaaaaucaacccccaacauagagcuggagggagaaagacacgguauuuauaucaggagaguguuguguaagaaaacaucguaacccucuuuuuuauugcccauuuuccagaaaucuuacugcuauucaaguuuagguuaaccccuuuuugucugcaguugggucuauuuuuacuuuguuucuaugucuugugaccauaauguuuuaacauauaauguugggaauguaauuauuuuaccacaaauaauuuauggcucuuuuccaagaauauauaagcaacagaauauugguuuaaaaaaaguacuguuuagauuuuuuucuuucuacagaugugacaguguaauucauccaagggaagcugcuugaaucugcuaauuaaaaugacuuguuauagcuccaauuucuguaggaugagaaagaaguuauauaaguuauuggaaguuauggguucuuauuucuuaaacaugcuguaaaaugugucuguguguaauuuuuuucuuucaguaguucauagcugagauuuuuauccuguuaaaugaaagcccucaaagauuuucuucaucaccuuuuauagaauauagaauuaugcaucacuuucucuucauaauguuuacuuacuuucuuuuggcaguuugguuuagauauucuucuugguacuuucaaauugcucauauuuguaauaauucuuccacuagaccauuaauaaauucuguaacauagccccugagagacuggauaguguauaaaaagacuaaaagcugcuuuauuauucugcccauauuaugaauuucacaacauuuguaaaaauaacaguauguuuuccugaugugguuuagaucuccacuuuauuaauacuuaaaauacuuaauaaauuaauacuuagaauacuuaaacaugaguugcaaacuucagagcagaaaaacaucauuagagaaagucugguaucagaaccuuggaaagcuucaugaagcuuuacuauugauuauuacuggugacacuaccuuaauguuucaauagcaagaaagaauaaagucauuuauccaagauauaaaaaaggaucaauaguauggucauacaaggaaugacaaauacaguuuucugaauauuauccaucugaagcagaauagaaauuggaaaauaacuuuuacuaugcuuggcccuggccuugaacuuuuaucugguuaauggaaaaguuagagugauuuaggucagccuauuuagaaacaucuuagacugguuugucuuugguugaaggcauucauauucucuucugucuaaagaaaauaaaagagacagcugaccauccagauuuaaaggcugucuacuuccauuccaaccaaauagaauuaggauaaaaauauccagcuauaaugugagcugcaaggguaguuugggguuauuucaucagcaaucuaagugauuuuucugauuccagcccugcuucccccuaguucuuucucuacaguuaaaaugaucuguuuauuucuuuaaaagagaaauauuuuggggaaaaugaauggaaaaguaaaaagaagauaauagucuuucauagucccaccauccagaauuaaauagcaugaacaucuuguuauauaguugcuccuauucuuguuuuuauuuucuggaacuaaaauuacucuguucuuuuugcaaauauaaauaugauacaucaaagaaucaaaagaaguguaguaaguacugcaucagugagcuuucaauguuggaagcaaaauauuuuaggcguuuuaagcagaaagggauuuaauucagggaauugccuucuuaaaaaauuccugagaggucgggaugugugaaaaucagaggcugccacuggacuguaaguguuaaguugccaucuagaggucaggaggccgcuccuauuacugguagcacugcugccacugccauagcugucucauaccuacagggcuggugacuagaugccggaauauggauucuggucacugcaaacacauacuucuguuggaccuuguuuucuggcuaccuguuaacagcuaaaagauggccuuuacuucacuuucaccuuucaaaucuagugcaucugauuggcagaacucaaaucacauccagaaccuaugggagucugggaaauggaguuuuuagcuuuccugcccaugugcucugagggguugggcgggggacaugggggaugcacauggaugccagaugccaacagauaauaccaaacugaagcauaaaacugaaaacucuaaaaaaaccuugaaauuccacuugccagaaauaacucuaauuaacauuagggguacuucauuccagacauacuuucuaugcauauagacagauagacaaaaauaccuuaagaauuagguucauacaauagauauuuuaaaaguaauucauuuuacuuuaacauacugacagaaugacugaauuucaaauacauuacuuuccucucuuaaagagguauauucuccuuuuuuuuuuuuuuuuuuuuuuuugagauggagucugucucuguugcccagagugcaguggcaugaucuuggcucacugcaaccuccgccuucuggguucaagcgauucuccugccucagccucccgaguagcugggauuuacaggcacccaccaucacacccagcuaauuuuuuauauauuuuuuaguagagacgggguuuugccauguugcccaggcuggucuugaacuacugaccucaggugauccaccugccucggucucccaaagugcugggauuacaggcgugagccaccaugccuggcccaagaggcauauucuuuaaaaauauauguacaaaguuauggaguauaugcacaaaguuauuuguauauuuuuaaaaaauauauaccaaguuauggguauauguacaaaguuaugggguauaugugcaauuucauuacaugcacagauugcauagugaucaacucagggcuuuuaggguauacaucacccagauaauauacaguguacccacuaaccaauuucucaucauccauuccccuccuacccucucgccccuccaagccuccguugucucauuucacuaaaagagggauauucuuaaagaaaccucuagguuuaagaacagaguaaaaaaaugauuucaguugcuuuggucaguggguuuuuuugcucuucacccccauuccaguuuaggugugcucccuugaccuacuaggaaagaugaacuauucucacucacggaguucaucccuguccccucccaccaccuccuaacuuuguaugaucaugucgaccuuuuguuuuguaaccauaaugcuaacuuuaaaaauuauuuuuauuugaaugcauucagcacucaccauaagucauuuuaccacaguuugugcacuucugaguucuuuauuuuugacucuguucuuaauuacuuguauuucauuguuaaguaguacuuccaagaauggugcauggguguuuuuugaguucuuugagguuugaaaaugucugcuuguuguuuuuaauacacaaauaacuuggcuaaauaugacacucuuuggucccauuuuccuuccacuuucuuuugacuuuuuuauuguggaaaaaccugaggucagccugauuuucucacguugcuuuuucgaucaggauaaccugaaaaauucuuucuuuaucuuugaaguucaauaauuuaaugucuuuguuuucacuauacccaaauacaaaauuaaauugcuacuuaacaugguaauuuagauuucuuccucaucuguuggugcccuuuuuauuguaugcuuuuugauguggugcauucuacagaauaguuaauguuuguuagaucaaauguaagaguguuacagaaggcauuuaacugcacgauuccagauucacucuauacuuuaugaggugcugaguuucguaccauauagguggaugagcacuugugguuaugagauggauuucugcccccugggagagaaguuccuucccagcuuuguuauuccuuaaugaguauauuaugacuuccaguauaagcucauaccuaggccguauucuagugaaauuuuuugaguggucauuauguuugguguaaugaaaugaaugaacuguuuccguuucuuggucauaaucucuugaaaacuaacuucugaauucauuuuacagaaaucuuccucgaagaguuuuagauucggaaaaggcuacuaaauaugacaauugugaaugaaggaaaaaucaagucuacaauauuauauuagaguauaacaaauaaucuuugugacuauuuauuugccuguccuacuuuuuuuuuucuugaaaucuguaagcuccagguuuccaggcauuuucugauaaguauaccaauuuuaacuguuauuuaagcuuuccucggaagauuuuuaucucauuauuuauccgaguuuuauauauuacagcuuuuuauaagauuuuauuugaaaaaagaggcuuuauugaauuuaauaguuuagaacuaugaaucuaaguucauaucacuuuacaggcgaggaaacuaagaaucagagaaguaagugaccuagcccagcccagccaguaagucacagagccugacuccuaauuuuuaugcuucuuuagccaaacaauacugggaaaugaaagcuuggauuauucuuuguucaaaauuuaccaugcuauauacauauuuuuuaauauuagagauacauuuuauuuugaaauaauuacuaucaugguugccaaaugaauuuuccaauuuuaucguucuuuauuuucaucauucuuuucucuauuuagguugccaugcuacuaagaaaaaucuuucucuccuauuuuuuuuuuccuggagauguguucucgcucuguugcccaggcuggagugcagcggcacgauguuggcucacugcaacuucuaccuccuggguucaagcgauucuccuaccucagccucccaaguaacugggacuacaggugugcaccaccacgccuggcuaacuuuuguguuuuuaacagagacaggguuucaccauguaggccaggcugguccugaacuccugaccucaagugauccaccugccuugguuucccaaagugcugagauuacaggugugagcuacugcgccuggccuuuuucuccuauuuuuaaaauuaucuuuguauauaucaguuuggacuuaaacagcuccauguuuuauucaauguauauaagccauuagaauuauuauuucuuuggaugccugaauugucucagauuauaacaguaggagccaccucaggcuguuuucucaauucuucugauauguccccagcauucuuaagcacuuaauuuucuggcauaaugagauauccagaguucaucuugcucucucuuugccccagcuuugaaauagcucuuucuccaaggauuccugcuuccuuuccgugaagaauaguauuuagaaaccaagaucugagccuuaggugugcucauugguauugaggugucacuguucccaggcccucucaguggacagaguuacaucuuauuuauuuuuguaucaauuaauauugaaaacaaugaguucacauaggaaccuuugauuccaguccaccccacaaaguucauucacauuuuuuuccuuagacagugagaaauguggcucucauuauccucaauauauuuaaccuaucagaucaauccucauugcuauccucauuccauguagucucucacaccuccuguugggcugcacacguauccuucuugcucugcuuggacucugacacuggcacuggcucaugaggagaccugcauuacccuucugggcauuugacaccccacacuugucuaccuugcucagucucaccuaauggcuuuuggguugaguuauuaaagaagggaaaacaucuuacauguuuauugauagcaauaauagcaaaaguaaagcuauuuuaaaagaguauuuuucuagaccuuacaauuguauuuuuaaugaccuucuuuauguccuuaggauuuucauauucuuuacuuaguguuuauucucauguuguuugccuuauuaucccaaauuauauucagccaucaauuucuauuacaggauuuuuccuuccccagaguuaauacauuuccaagacaaagacccauuuucuuuugaacuuuaguuuaugguacagugauuuugcuugaggucauggaugauuggaucucacugcuuguccugcaguagaaauaauguuuguaaaauaaugcuagguugcuccaaguagucaguauuuucaagucaccauuuucaccagguucuagaaugcugucuaaauuuacuaagagaaaggcacuccauauugacauuucuuguagaagguuagaugccccuucuguggacaucaguaauacucuguauuucccuuuccuuuacauguacaaauugcauugucaauuuauauuuguuuccccacuaaagccuccaaaccuugcuuguuuuguuuaaguaucccuggggcucaucacagggccuguugaaguucuuuugaaaugaauugaagaaugugaauaauaguucuaguucuucgggauaauggaaagcuaauaagguuuaugcuagaggcucuuacugcugggacucucuuccuguuuuugguuuuuaggaaaaaagcuagaaaauccaacuucagcuagaguaacaguaguaacugacuugaaaguaugucaaaacaaaaacuguuaaggucaugaggauuuuaaaagauuagugaauauaaaugaagauguuuaaagaugacacuguuaguaaauaugcugccaguggucagcauuuuaaaaugugugugaagcaaaaaacaaaaacaaaaacacaaaaaaagagggagagagauuugcuucgugcuucaaggaacuugcaacuuaaaugaugagaaauccagagggguggugaugcgaggguguggugauacuguaaguagugguaugacgucggaaggucauugaaacucuuuuuuccgcuuguaaaauggugacaugcucuccucuuucuguuuuauucagcugcgaggcucaaauggagaacuuuuaaaaaccauaguuauacaaaugcaaguuuggguuauuuuacuauuugguaaugcaggaaguucuggcgggguuccuggcgccauuuuaucuagcgccgccgcuguaggcguggaaguaccuucccugcccugggguauagcggaaguuuggaugcgggcugaacugggcuucggguuggacugggcuucuguggcuucccugagcaacucguugcuucuugaggacccaugucugggucacuaacccacccacuaaucuuuucccuuuagggagcccaagcuacuaggacagacaacuuaaccucugucuuuaaaagcuuuuaaagaaauauugaaaaaaugaaacaggcuaaauaaaaagagagagaagagaaaaaguacuccuggaaaccaacgauauuuucucaaguauuguacuuuguaagaaauaaaaguggaauuaguguuaaacccacuuucaagaagcaugaacgacacggggaugggcagcauuccugcccgucucuaccuggaaugcagguagagacagcgaccaaaagugaccuuuuacagguagagacagcgaccaaaauaugagagcaaauuauggugaagccauaacuagaaauugaucacuaaccuuuaaucagaaucuagacauaauuauugauauaaaauaacuccuggucauccauauucauguaaauauauucaauauuuaauauaaaagacaauagacauuuauacauauaugucuugcaucauaguuuguauacgcuuacagaugcuugcuccauaaaauuauuuuuaaaaaucacuuaaaaauuuuuuuuugccauguuuauucacagguaucucuuggaaguucuuugcuguucauuuuauugcuguccaaauagaaauaguacaaucuguuuucuuuuucuuugauacuacaucuuaggaaaugaucccaucugcuauucaguguuguauauaagagugcuuguguguuuuuaguuuagguguaaauauuuaaaacuaccagauuuuuuuaaaggaaguuauucacaauagccucauucaucuuaaagaguuuuauaauuaaaaauuuuagguaacuagaucuauguuuauauagaguuaaccuuaguuauauguauuacaauguauugcguauuuuuaaacaaauguuaaaauaacuuugauggcuauguuuuauuuaaccuuuauauuuuuagaauauaauuuuacaguuaacaauauucuuuauagguugcuacagcuaaggauuagacuuuuuuuuuuccaggcuaguaguauaaacgugcuacuaguuuauauacccuuaauaauuuggguugguagugucuggcaaaaugacaaggacuuuaaugccaccuagguucuaaccauaacuaagauguauagcaauuuggaaaacagauguuagugguuaauuuaaucuugcuuuauuaaccuagugaaaaguuucauaaugauuguucuuaguaaaaaaaaaaaaauuaauccuauaaauagauauguaugcauucuggauuucuguuuuugcucaugauacuuuacauugcuauuuuuauuccuacuuuuaaacaugaagcaguuguccauuuugaguuacccauuuuaugaauuggcauaugauauaauauaagaaaaaaauuuaaauuuagguuauguuaaugcagaugauauaaaaacagcugagacaugcuagaucauuaccugaauuaauagcugggggauacugaccaaugcagucuuuauagggcaugcgaaaccucuuagaauauaacugaauauguaaaucauaauuaauguuacauuucaugcuggugaaauguaggugagcaaaauaguuuauggauucccuuucucccuucccccuaugcuucucucuccccaaaauggccguccugccugugaaccucucuagaagcugcccagaaaugccaugguuccauggaauacacucugagauacauugcuguaaagggaaaagcccagugauugugauuuggaguuuguggcaauagguaauuugaagguucugaccauucucaaaauaugagcaauaaggcugcuaugauauggcagaccuacacugugaaauguuaaaagaaaugauuuaagaugguagguuuacagcagaguaagccuauuauguggauggaaaggauuguuuuuggggaaaaauguaaaguagaaauaacauuuucaaagagaacaaaaaaacgagccagaguuugauucuaagacauaaucuugugcuuuuuacuugaagcuaauauagccagaauauuuaaguugaaauaauuguuuuuaaaaaaauuauucaacucuuggaaaauccagguauguuugaaguccauagucugagugaucucuuuccucuaugaauuucuguaacacuuaagaaauauuuuuccaaagauauuuacuacauacugauacucaugcaugaugucuguauuuuuaucuaaccuauuaaacuaaguuuuuuuuuuugagacagagucuuacucuguugccuaggcuggagugcguaguacagucauggcucacugcagccucugccucuggguucaagcgauucucgugccucagcccuugaguagaugggauuacaggcaugcaccacuacacccaccuaauuuuuguauuuuuaguaaagaugggguuucaucauguuguccaggcugggcuugaacuccugaccucaaguaauccgcccaccuuuguuucccaaaguguugggauuacaggugugagcccccaugcccagcaaaccuuaaauuucuuauaagagcaauaaaaacagggaucuuucacucaucuuugugucaaccuuguugccuaaaguguugcuuuagauauaaucagauucaguaaguguuuauuaugaagaagugagcaaauuuccuugccauuucucuuacuuugcugucucuacaauauugguauaaggacaagccugaaagcuaugauaacuuuauuguuacauggucaaccugaaaauuuuauauuuuuaugguuuuguauacugaggaaaaaauuacucuaacauauaucuuccaacuauaauuuuucucaagcaaacaacaaaaaucaguuauaauauguucuuuuaaaauugauuuuauacaaauggauuuuuagagaaaggaaacaguuuuaauuaauaacaaaauaauuugucuuuggcaagauagacuaacagggacuuucugccuuaaagaacuauucuaaacaauggucuguuuucagaccacaggcaggacaugacagugaucacuuagagaaagagggaaaagcaauguaagaaacaaaccugggugugagcccucugauugucccaacuugcugccuagagaguuuucagaccacagugcuggaggggaaacccaaagaaugcccuauggucuuguugaguugaagcagcagaguucagaguuugaggaggcuagaauuugugggggaaaauaugagagaguugggaaccacacagaaagaaagcucuagagaucugcugugucggccugagucuguggccaagaacuauucugugcguuaaugggagaaaauuguucgaggaaagaaaugccagaaggaaaacacacacacacacacacacacacacacacacacacacaccucagaacagaguaggcacaacaauccuugaagcucauacagaacuaggaguaguucauauucccacuggacagaguggaaaggccucauaauacacagagauccuguagaagccucagaagggccuugccucaguaaugggacagguuagccuuagaguaaaggcugcucuggacaugccauaacagaacuuaaaaaguaagccugaaaugaauuuaaguguaucccacuacaaagccugacaauauuuaaaggaauacaacaaaauccagaucccaacaguguaacauuaauaauguugaauauucauuagagcaucaucacacauacaaaagcuggaaaauucaacccagaaauaggagaaaauguaaccaauagaaaagggguuagaaaugaaagggaugauagaauugguuaacaaguucauucaaacaacuacuauuaguauacuucguuuguucaaggagguaaaaaaaacaugaacacaagaggauucauaaaggacucagauucaacuucuagugaugaaaaugcaauaucugaaaugaaaauacucugaaugggauuaacagauacuacagaaguaaagaaaagucaauuugaagacacagaauuuaaaaauacacaauauaaaacagaauaaaaaguugaugcacugcucauuuuuuuuuuuuuuuugcaaugagcugugggacaguaucaugcuucuuacauaagcguauuuggaguuccaguaggagaagagagagagacagaaaaagcauuugaggaaguaauggccacaauuucccuaaauuugaugaaaauuauaaauucacaaaauccaagaagcuccaucagcuucaaucagaagaaucaugaacaaaacaaccugauagcacaucagaaucaacuugcaggaaaccaggaguaaggagaaaauccuaaaagcagccagaggaacaaagacagauuuuauguagaacaaagauuaaaaauuaauagcagauuucucaacagaaacuaugacagauagaagacaauagagcgacaguuuuaaauggcuaaaagaaaaaaccaucaaccuagaauuauaugcucagugaaaaauaucuuucaaaagugaaggcaaaauaaauaauuuuggacaaacaaaaacugugagaauuuaucaccaggagaccuucacuggaagaaauuuuaaaggaagcuaucuaggccaaauaaaaauaguaccagaugaaaauuugcaaguucagagaggaaugaagagcacuagaaauaauuagaauauggguaaauacaaaagacauuuucugauuauuuuccaaauuagaggauaaucaacuuuuuaaaguaaaacuaauaauguuuucuggggcuuauaaacuugugaaauagcaguagaacaaaggaggggaguuugaggaaauggauguuuaccauuguaagagucucauacuguaaccgaagagaaaauauuauuugagugcacauugugauaaauuaaagauggauauaguaaaccuuagagaaaccacuuuaaaaaauagaaacacuaaaaaaaagagcaugaguaauaagccaaaaauguugauaaauugaauccuagaaaauacugaguuaauccaaaagaaggcaagaaaaaagaaagaagagaugagaccaauauuaaacagcaaaauuguagauuuaaaccuaauuauauugauaaucacauuaauuguaaguuuucuaaacacuuccuuuugaaugccuuguugggcuggauaaaucaauacaauccaauuauuugcucuacaagaaucucacuuuaaauacaaagauacagauguuuuaaaaguaaaaugaugggaaaagauauaccaugcaaauguaaaucaaaaggaaaaacuagaguuguuauauuaauaucagacaaaauagacuucagaacaagaaccauuacuagggauagugagggauauuacauaugacaaagggguaaauucaucaagaagaucuaauauccuaaaugugcaugcagccgauaacagcuuugaaaugcaugaagcaaagauugauggaucugaaaggagaaauggacaaauucccaauuauauuuggaaauuucagcacccuuuuucaauaacugauagaacaaguagacaaaaaucaguaaggauauugacuggaacaucauuaacuaacuugaccuaauuaauauuugcagagcauucaauccaacagcagcagacuguacauucuuuucaaauauauuuccuaagauaggccauauucuagauaauaaaguauuaauaaauuuaauguuuucauuuuuuauggcuauggugacaaaugacugcaaacuuauuggcuuaauacaauacaaauuuauuaucuuauaguucuggaggucugaaguccagaaugggucucagcuaaaaucaagguauuagcaaagcuguguucuuucuggaggcucugggaagagaaucuauuucuuugccuucuccaagugcuagagaccacuaacauucuuggcuugcaguuccauuccucuaucuccaacagcagcaauaucuaauuuuuccucacaccaccaucucugcuucucugccuucugcugccuucuucuacuuauaaggauccuugugauuucauugggcccccuuggguaauccagaauaaccuccaucucucaagaucagcugaugagcaaacuuaacuucaucuggaaacuuaaucccccuuugccacauaaaguaaaguaugcccagguucuggggauuaggacauggucucuuuguggagggacauuacucugccuacuacauuuuaaaugguugaaaucaugucaaauauauucucagauuacaaaaaauuaaauuagaaaaaaaacaaaccccagaaagguauuuggaaaauucucacauauuuggaagccaaauaaugcacuuccaaauaacccauggaucaaagaauaaaucacaacccuaauuauaauauauuuggaaaaguugggugaaaucccagaggagcugacuggaaaaaaggugaagauguggcuacuggagugggacacucugauuuuguggagcaacaguccuggcaucugaggagggaaaacugcacuuaaaauaguaucaaaaugaaauaucuaugaauaaauuuuaaaaaacuguaugcaaaauugugaacuaaauauuauaaaacaugcauaaaauagauaucuuggguuuauauauugggaggaauuaauauuguuaaaauuucaguacucuccaaagugaccuacagauucaguguaaucccuaugaaaguuccaguggcauuuuuuucauaaauagaaaaauacguucuaaauuucauguagaaucucaagggaccccaaauagacaaaacaaaucuuggaaaagaacaaaguuggaugucucacacugccugauuucaaaacuuauaaacuacaauaaugcaaagagugguacuggcauaaagacagacauauagacgaguggaauagaauagagagccuagaaaucaacccauacacauauggucuaaugauuuuccaugacgaugcuaagaucuuucacuagggaaaggacaauuuuuuaacacauuguuuugggagaacuagauaucuguauugcaaaagcaugaaguuagacccuuacugcuaugaucugaauguuuucgucuccuccaaaauucacauugaaacuaaauugccagugugaagguauuaagagguagggcuuuaaagaggugauugagccauggggacagagcccccauggauggcauuagggugcuuaugauaggguuugagggaaugggugugcuucucuucugcucuucugccggugaggagacagcguuccuucucucuggaggaugcagcaacaaggagccaccuuggaagcagagagagcagcccucaccaacacugaaccugcaggugacuugaucauggacuucccagcguucagaacugugagaaauacauuucuguuguuuauaaauuacuaauuuugugguauuuuguuauagcagcacaaauagacuaagacauuuacauuacauuauaugcaaaaauuaucucaaaagugaucaaagaccuaaacauaagagcuaaaacuagaagaacauagauaugcucguagaagaaaacauagaagaaaagcuucaugaagaguuucauuagauuuagcaaugacuucuuggauaugacaccaaaacauagauaauaaaagaaaaaauaaauaaauugaaccacauuaaaauuaaaaacuucugugugucaaaagacacuaucaagguugaaaagguauccuaagaaugggugaagauauuugcaaaucauauaucugauaagcaguuaauauccagaaaaugaaaagaacuccuacaauucaacaaaaauacaaacaacccaauuaaaaaaaugggcaaaggacuugaauagacauuucuucaaagauauacaaaucauuuuguguaaggcacaagcaacaaaagcauaaauagauaaaugguauuacaucgagcuacaaagcucugcauagcaaaggaaacaaugaagugaagagacaaccuacagaaugggaggaaauauuugcaaacuguucaucugacaagggauuaauaaccagaauauggaaggaacucaaacaacucaauaacaacaacaaaaaauccgauuuaaaaaugggcaaaauacuugaauagacauuucuuaaaagaagacauacaaauggccaacagguauauggaaaaaugcucaacaucacuaaucaucagggaaaugcaaaucaaaaccacaaugagcuaucauuuuacaccuguuagaauggcuauuaucaaaaaggcaaaaaauaauaaaugcugggauuguuggaucauaugguaguucuuuuuuaguuuuuugaggaaccuccacgcuguuuucuguaauuggcuguacuacuuuauagucuuaccagcacuguaugaguguucauuucacuucagucagaauggcuauuaucaaaagacaaaagauaacaaguuuuggcaaggauguaaggggaacccuuacacaauauugguaggaauagaaaguaguaaaguagugcagccauuauggaaaguaguagaagguuccucuacaaacuaaaaauagaucuacuguaugauccagcaaucccacugcuggcuauauauccaaaagaaacguaucaguauacugaagaaauaucuguacucccauguuuauugcccacuguucacaauagucaagauauggaaucaaccgaaguauucaucaauggauggguggauaaaaaaugugguauauauacaaaauaaaauauuauucagccaugcagccaugaaaagaaugaaauucugucauuuucugugacauggauggaacuggaggucauuauaugaaggggaauaaaccaaggacagaaagacaaguauugcauguuuucacucaugugagagcuuuaaaaaaggugaaucuuauugagauagagaguggaauggugguuacuagaggcugggaagggaaacggggagggagaggaugaaagagucugguuaaugguacaaaaaauauaguuagauagaaggaguaaguuguagugucugauaguauaaaauggaaauuauaguuaauaauuuauuguuuauuucaagaacuuuagaaaaaaauaaucguaauguuacaagcacaaagaaaagguaaauguuuaaggugauggaugucccaauuaaccugauuuuaucauuacacauuguauacaaguaucaaaaacagcauguguacacccaaaauguuacaauuaugauacaacaaugcaaaaguacaaaaaaauuuaagaagaagguauacaaaucaucagcaagcacacgaaaagaugcucagcauuggccgggcacaguggcucacaccuaaaaucccagcacuuuugggaggccgaggugggcagauugcuugaguccaggaguuccagaccagccagggcaacauggugaagcccuaucucuacuaaaaaugcaaaaauuagccaggcaugguggcacacacuuguagucccagcugcuugggaggcugaggugggaggauuaccugagcccggaagauggagguugcagugaacugagaucaugcuacugcacuccagccugggcgucagagcaaaacucugucuccaaaaaaaaaaaaaaagaugcucaacaucaguaaucauuugggaaaugcaaucaaaacuacgaugagauaccaccuuacacccacuaggauggcugcucuuaaaaaaaaagauaaagaaaauagcaauguuggcaagaauguagagaaagugggacccuucugcacugacguauaauuguguagccaugguggaaaacaguaugauggcucuuuaaaaaaauuaaaauagaauuauuucaugauccagcgauuucacuucugguaauauacucaaaagaauugaaagcagggucuuaaagugauauuuauacaucuauguucauagcaguauuauuccuaauagccaaaagguauaaacaacgcaagugccaauaaacagacgaauggguaaagaaaaugugguguauacauacaguggaguauuuuucagccuuaaacaggaagggaauucugacauguucuacagcauggaugaaccuugaaggcauuaugcuaagugaaauaagccagucauaaagggauauuucuguaugauuccacuuauaugagguaccucgaguagucgaacuuacaaagacagaaaguaggaugguaguugccaggggcugagaagcgggggaguggggaguuguuccauggguguagaguuuugguuuugcaaggugaagaauucuggagauugguugcacaauacugugaauguacuuaacagcacugaacuguacacuuaaaaaugguuaagaugguaaauuuugucauguguauuuucccucaauaaaaaaaacuugcagaaauuguauaacaaugaugucaaauugaacaaugagaacacauggacacaggaaggggaauaucacacacuggggccuguuguggguuggggggaggggggagggauagcauuaggagauauuccuaauguuaaaugaugaguuaaugggugcagcacaccgacauggcacauguauacauguguaacaaaccugcacguugugcaccuguacccuaaaacuuaaaguauaauaauaaaaaaagaugucaaaauagcauuucugaucuaacaauugaucaacucugaugauacuuuuaaauuuuaagcagcuuuaaaaggcaaacuuugacucaaacuuguuaguacaguuuucaucuuuaaauauacauuuuuuucaaucauaaauuagaguugggcuugggggaaauauuagaauuuagugugagucuuugagaagcaucacgaaguucaaagaggucugucuugguaucucugugguaaugcuuuguuugaauguugauguuucacaaagaguuuacauuuuaucuuccuauuucucacaggccuaggucuguguagugaauugagcguccucaguuggauggaguuaagagccaaacguacaacauuguaccauuuacaaguuuuauuucaaaaggagauuuaaauuuuuauacagucaaauuucugccaaaagagagauuccaaauuaauuuuuguuuaugcaaagcccauauguuguuuuccacagucucaaaaagagugcaaauugacagauuccugcaucuguaucucacaggauacauauguaucauugcuaccacucacuuauuuccugccagauuuuuagcaauuguguuugaaaagaaaaccuguagaaagguagcagaaaacaaauggguagugggauaugugucagcuaguucccuaacuauagaaacccuugaaauaaggcaaaaaacuuguguuaaccugggaaggaaaggaaaaauugggcagcaggauaugaaggggccauggaaggagcgguggguccuccugagacgcuuuccugcuuuauaauuuuuuccauuuugacugugggagauacuacuguaauacuuuccuagauauagcagccgcucaauaaauguugacuccuuuuuuuuuuuuuuuuuuuuuuuugagacagagucucccucuguugcccaggcuggagugcaguggugcgaucuuggcucacugcagccucugccucccagguucaagugauucuccugccucagccuccugaguaacugggauuacaggcaccugccaccaugccuggcuaauuuuuuuauuuuuuguagagaugggauuucaccauguuggccaggcuggucuugaacaccugaacucaagugaucccccugccucagccucuccaagugcugggauuauaggcaugagccacugcacccagccaaauguugacuacuuuuaaugagugcuuaauaccuauugguagaagaaauuacauguuggaguuaggagcuguguuuuuagccuuuuaacuugaauuagacacugaugauuaguaauuuuuuguuccucccaauuuucuucuauauucccucuccuucaaagaaaagcaaaggaaacucguucuuccuguuuuucuuaaaaugaauuuaaaauuuuaccaucucuauauaucuaugugaauauauauuuauaugccccacuucuauaaagcaguauuugauuugguaccuauggauaacuauuagccuaauacugccauaauuacaauucaauuaaguuuauaaccugacuuguucacuaguugggaaguaacuaugcauuuguuggcauucugguuuaaaaacuuuacauuugcuugaaccaaucugucuaaauuuauagaacagaguacuuacaaaugucuaauuguuuauuuuaaaguuauauuguuucuaugucauugcuuguuauuuucuuaauagaauugaaaacuuuuuugauuuuaugaauacuuauauuuugauuuuuguaaauucaguaguuuuaggucacaacaaguaauguuuugucuuucaaauuuaauuugauuuucauuuuauuuuaaacuuuuauguucagggggguccaugugcagguuuguuacccggguauauugugggaugcugagguuuggaguaugagugauccugucacccagguacugaacacaguacccaacaguuaauuuuuuaaccccuccccaccugcccaucuaguaguccuuagugucuguuguucccaucuuuauguuuaugaguacccaauguuuagcucccacuuauaaaugagaacaggcaguauuugguuuucuguuccugcguuaauuugcuuaggacaauggccuccagcugcauccauguugcugcaaaggacaugauuucauucuuguuuauggcugcauaguauuccgugguguauauguaccacauuuucuuuaucuaauccaccauugauggacaccugggaugauuccauguuuuugccauaugacaaguaauuuuugagagacuucaaauuuaauucagaucccauuuaugugguaagcuuuucagucacuccagacuugccuguucucuccuggcaaugaauuucaaugacuuuuacccaauaaugucaugcauugcacauucugcaagguuuaguggaauuggcaaagaugaauaaaauugcuacccuacuggaagcuaauguuccuguuaccugacugaggacccuuucaagauggagguaucaucauuugaggugggguugagggaaccacaugagaaaggaaaauguacaaagauuauucagggaccaaugaguuugaucauaugggaagaaaaaguccugcacacguggguuuccgugucugaagaugguuccauuuuucuuuaacacaagauuggugguucaucuggguuuagaauucuaggugagaagccauuuaucucucagaccauugaaggcauuguuccacugaguucuagccuccagaacugggaaauccuuuacaagcuggaucuuuguauaauagcuuuuccccagccuuucccuccggggcuuucaggaucuucucuuuuccuuaggaaucugaaacuucaaagugaaauucguguggguuuauuuucauccauugugugggcuuuuuguauucccuuucaguuuucaguucugggaaauugucuugaauuagcucuuccuucuguuuucucuggucuuucuuuuuggaaucacuauuauuuagauguuggaccucuuccacuuacuguguaauuuuccuaucucccuaucucccccauuuuucaucuuuuugucuuuucauucacacacacaagagaacacgaauacccuugaagccgacuggaaucucuguguugguucaguggggggacuugucgccuguguccgucacuguuuaaucaaacuagucauuuuguugguaaccccuguuaucagcauuuuuuaacucuuuucucucaacuuuguuagauccccaaauaagacucauccaguggaaaguuguagccccagaugccggcaacugggagcccaauaaacaggaaauccagggaacucugaauauuuaauauguaaaauuuguguaacccuccuguuuucaauaauauauucuugcccucaguuauuuuugggucuucuauuccagacauucucugcuggacccucuccagaauaaaccuccagccuuauuccugggugggggaggcaguugcagcuuuccagaggugaagaaauagggagugaggugcaggggguguguaaggggaggaaggagcacuuagugauucuaaaauacauuuucacccaauccuuguuagcuucaucuuauccuggcauccagagguacaugguacugccaguuuuugagacauuugaggauuguuuguucaagugaguugauuuucaacccuauaucugucuucugguugugcuaagucaauucucagccauccaucugcuuuauaucuuacaaaaucuuccaguucuugucuucucucccauuuuguuuuccuuauaguuuuacacauuuuuagaagucucuuuuuuauugggaaugaguagagcuaaaagccuacacucauuaagguguuuuuaauuaggaauuugagaaauuaaaacuuuacacaggugaaaaaauaauuaauauuauaaauugaaaauuaggccagggcacggugccucaugccuguaaucccaguacuuugggaggccaaggugggcagaucacuggaggccagaaguucaagaccagccuggccaacauggcgaaacccugucucuacuaaaaauacaaaaauuagcugggcaugguggcacaugccuguggucccagcuacucgggaggcugaggcaugagaaugacuugaacucgggaugcagagguuccagcgagccaagaucaugccacugcacuucagccugagcaacagagcgagacucugucucaaaaaaaaaaaauaaauuaauacuuaaaaguuuguuaauguguaguggcauuugugucauauuuuaggagccauuccuuuugaugacacuuacaaaaucaaucagaagauucuuaaguauaugauucuucaaguuuuuauuuucuuuauguucuuaaugucaugcuggucucuuugugaucuaaaugaugcagugaauauuucauaaauacaaauaauuuaaucuuaaauuuguuaauaguguguauuuauaaagugaauuuuauuaaaaauccacuaacaacuguuugagugcaucuuugugcuaaugcuaugagguaauuauauucuuaagcuaaagucagcacuuccgaauuacucucaggugagaaaaauaacuuuuaauaugaaaggacacauuccggaaguacacuggagugcauaaggaguuaccaaagaguuuucuuguuggaaaaauuacaaauucauaggaaacaugauuaaaugccaaauucuauauuagacuuaauugcaauagaaggucagagagagagaaaucagugugggccaggauagcaagagguugcuucaucccugcuuguguagccuuuugucaaaaaugcaccuuuaaaacuggacuccucaucuucucgcccacacuaauucauagagucagguuugcgaguaaccuuaaaggugcucaguucacuggcgcuuuccggcugauuucauccuguccugcuuguguuucuuugccuuauuccacauuaucaaggcuuguugauucuuccuuuguaacaggucucaguuuguccauucaaucuagugccucaacauguuuauuuaagcaucuacugugugucagauguugugcagagugcggggcugaauaagggcccugaaggagccugcaucccuucaugugugcaguggacacagaaaauuuccggaaaaauguggggugugcuaggaaaguguucacacugggucuguggcagcauggaggauugaugcugaagccaccuggggagaagaccugagagagcaggggguauuugggcauaguucagugucucugaagugugaauggcggggcugaggccaucuucacugcaggugaagcagcacugguaguaagcaaggguaaaggcuugaaagguguguuacccauucagcaaauauuuauugugugccaacuacgagcuaggcaacuauuuugcaaccgaaugcaacagugaagaaaacaugaaaagcauaaguaugauaaauaagaugacugaguagcgcgugugaaggugaaauguguugucgaaaaugauaaagcaagaugauggaguuggggacuuugggcccuaagcugggguugaaggauguuuaggguguacuccacagaacucugggggcugcagaggugcuucuggggucuauaagaauuguucuaaauuuuguuuuaaaauaugccuuaaaacauuucaaaaacaguaaugaagaacagcaugagcaaacagauacauuauugugaaaauuuacacauuagaucagggguccccauccccugggccaccaguccguggccugugaggaaccaggccacacaguaggaggugaguggggggcaagugagugaagcuucaucuguauuuacaguugcuccccauugcuggcauuaccaccugagcuccgccuccugucagaucugcagcggcauuagauucucauaggagugcaaacccuguugggaacagugcaugccagggaucuagguugugcacuucuuaugagaaucuaacuaaugccugaugaucugucacugucucccaucagccccagaugggacugucuaguugcaagaaaacaagcuuagggcucccacugauuguacauuauggugaguugaauuauuuuauuauauauuacaauguaguaauaauaaaaauaaagugcacaauaaauguaaugugcuugagucauccugaaaccacccccuccacccccgauccauggaaaaacugucuuucacgaaaccggucccuggugcuaaaaagguuggggacugcugcauuagacaccaccagcgcauuaacuggugccgccaugguagcucauguuuggaaaaaugcguggauuuuaaaacaauuuuuuuuauuaauugacuucauaauauauaauuuugcccauuuaaaccuaaaguugaauuuacauuaauaaaacaucucauuuacacauuuuguauaaagagaaucuacugcugaaauuauuggacauucaccuuacaggaauucaacccgccuuacucuuggauuaucauaguugcccucagcaccuucaaauuaucucccuucuaaucucuuuugcauaccauugcuagaguuaauuuucuuaaaucacuaaaucuuuuaauuaaaugcuugaaacucaaacucuguggugggggcaaguagacuuacuaguuacaguucugccacaaaaugcucuguggccuuaagcaagucuuuguuuucucaucuguaagaaucuuuuuugcucucagauuuuacucccauaacucuccucacuagcuguugaugaucuuugugaucugucucuagcuuauccauccagcacuggcucccccacuaaucucugccuuuauccucugcucuagcauggccauucucuucauuccugucuccuuccuucugcaaugcacacaccacuagcugauuaauuaugcucgcauauguugauguuauuuccccagcccagacuggccucuuuaguucauugacuuacauucugcguauccuuuaaaaauagucuucuagaacuuaugguuaaagaaaauuuauuggaagaacaauaacggcaccaaaugauacagcauuaaggcacauugagaacuaggaauaaaccauuugauuuguugaaagcugugcugucuaguacaguagccacuagcuacauguggcuauuuaaauuaaaaccaauuaaaauuucacacaaugaaaaacucaguuucucagucuuaccagucacaguucaaugguuccauuuggcuaguggcuacgcuaucagacagugcagacaacgaacauuuccaucauugcagaaagguuuguuggacagugcuggucauggguggcuugaaaguuuuguuucagggacuucuggaggagaaauaauauauuuacagaugguccagaaggaaauguuugauaaagaaauggaggugaggaguauugauucuagaggucugacaguggcaagaaagagggacggggaacagguaacguccaaguuaaaagagguauguguguaugugugugugugagagagagagagagagagagaaagagagagaaauaagaacauuuuuaaaggcaaagaaaguuguggcaauggaaagacuggaucuguuguagacauuggaagaagaguguguaggaagagguaggcauauuggaugucaggaaaacaagugaaacaggauguugagauagguuucauucugucucaguuuuggcugaggccccaaaacauuaccaagaaaacaauaaguggcaaugaaaucacauuccuuagugaagguuucuaacccucagcccagcaucuugauggugugauugaaguccaagagaucaaggccggggcugggaaggcaggaaggaaagggaugauuccgucucaccucaggcugagugagggaguugcaaggagacugcuuggcucuguugacuugcucuguguccucuggaggcuguggagacacuaaaccuacuaacccugaacuagagaaguuuagaggucaaacaccugcuggagcuacaccugccuggcuggcugcagagcaaagaggcagcugcacugggagccagcugugcuuuugcuaauaaagcagcaggaucugcuguccaggggccaggagaagccugguggcuuuuuaaaaaguggccccacucaagaguccuuccugccaauggacaauguggccuuggcaguggaggcuggaggugugcccagcagacgcagauguuggaguguaggcagcauucuaagugaccaccugcuuggacccugggagcugcagaaggcuccuuccagcaggaaaaccucugcagaaugaaugaagaagucccauuugaggagcagacacucugccuagugaauuaaaggaaggagcugacugauucaggagaauccugcucugccuggaauagcccagaugggggagaggagagacaacuuugaguagaguuuggaauuggggccuggacguuuucccuacugaaauguaacauguuuuugugaguagaggugaccagagaacuuugaauuuuuuaugaaagacuaggaaagccuuggaacggaguucauucaggacaagaaaugaauaggcuucugaaugacuuuagaugccuggagaaagcauggcuuuuugcugcuugcacucuguaggguccuacuuacuugggacaaugacuauacugauuugguguuugaugagaguacagaauguuuagaaaagcucugagagauguguugagaauuaagaaguaagugaauaauaaccugcaagaggccugauugaagagaagcagcaggaauuaaguggacugcucaaaugagauuuuuugccucccuuuccagaagaagucugcagucugggaucaggagauuguuguauauuuauuugggguuauaguguggguaauuggaagccuugugguuuuguggagugucauuuugaaggaagcauaagguaaauggagaaugcuacuugaaugcagcuggguuuucuucugcaugugguggugcaggagcccuuugauguuauuagggugguaguaauuaaacacguuucuuccauaugaaaugauugggauagggaguaguauaauauuucuguuucuagcaugguuuauuuauuaucuacauuauaugaggacucuuguuguauuuuauuuguuaggaugcugcaguuaacaaaaaaacccacaucauguuggcgaagcaccuggagacagggccagcucugacucacuucccucugcgauucccaagucccugcucucccgcaugagugcuauccuuagcaaagugccugaaucaauuccaggugucacauccaggcagcagacagaaaaaggguucucucuugcugugcaccaaaugcagucccccauggcaccuccacuuaccucugauuggcuggaacugggucacaucucaccucugaacuaauugcuaauggcaaggggaaaggaauccucauaagcaauuuauuaaacuaauuaguauguacuugcuaaagccaggaauagagucagcauucccuaagcacaugacuuggagagaaggaguggauaccuaaaccaaaucaggguucgguuaggaaggaggaaaggggaaauggauguuggguagucuugcaccucuuccuagaauuauauagaaugacuacuauaacuaaucaaaaaugagugauuacggauuagaugguaggaacauauuaauaguauauauagacuaacaagcuguggcaaaugucagaaaugcaguggcucaaauaacaucaaaguuuauuucucucucaccaguaacaguucagagguaugugguccuaagcugguggggugccucuaauauagcuuaaauauuagaguuguaaaguuguaauaacaaauaagucccccaaauucagggacuuagggaacaaagacauuucucucuuauaucccaguccaaggaaagcugcugaagugaguaucucuguugcacgggaccauucaagggcccagguuccucccauguuguugcucugccauuucucccccccagggaauugucuuugcuugggcuaaaacugggucaccacuuccagguuccagcuagaaaguggaaaaggagaacaugaaggagauagaccaguuuauaaaggccuaggccaaaguggcacccgugaccauugcucgcauuucauuggcaagaucuuagugacaugggggcuucaaacuucaaauagccugggauauguagucucacagggcaguuuucaguguugcuugagucgucccuauuucuggucaguagaaagaaauaggaccaggugucuuuaagaggaugaaucuuaaguugcaucccucauuuccgcucauguccuguuggccuaaaguuguucacauggccagaugcuagggaggucaggaaauggaguuuguagcugggaggguaaguacugggagaaagaauggauuaugguagaccauuagcuguuucucucacacaaaaauuucucucugcucugcauaggaucuuucuaucuggagaccugacuuauuaaauguuaaagaaaauuuuaucuaaugccuaaagcugguaauuccucaucauuauuuggcugaauuugguaacuugccauucuucuaccauaggaaagacugauauuaauaguaaagcaauauuacuuuuuuguaauagacauuacaaaaaaaaguuccaaaaugcuuuuuauaaaauauaugaacuuggccuucuaaaacaacuuguauaguuguaucauguguuuauguacauacauauguauguauguauguauguauguauguguaguuuuaaaccuuuaugacugucuuagucuguuuagugcugcuauaauagaauaccugagauuggauaauuuauaaugaacagaaauugacuggcucacaguuccagaggcugggaaguccaguaucaaggggcuggcaucuuguaaggaccuucuugcugugacaucccauggcugaaggcagaagggcaagagagggccagagagagagagagagaggaaaugagagcaagugcacgaggggguuaaacucguccuuuuacaaggaacccccucuaugauaacaacauuaauccauucaugagggcagagccccugugacccagacaccucucauuaggccccaccucccaacaccaccacacuggggaucaaguuuucaacacaugaacugugggagauacauuccaaccauagcagugaccuaaaauuguauguuugauuuuuuuuaaaaggcauccuuuuggagaugaguagugaauuaucuucucaaagucuguuuagacuuugauucugcuacuuugauguggacuucugcuuucuuaucuggaaaaguauugucugaguugucauaggauguuguccuaaacuuugauguuuauucuuccacaugcuagcucagguuuucuuuggucaugccuacaaacugguaagcuuuauaaguagauaaggagauuaaacaaaccuuuuauauguagguaaaugaaauuaggugucagaaauccuuucuagaucuuaaauauggccuucgauauaugguuagcucccugcaagcaggcauuuuucuuuguuuuguuuacugcuauaucuccagcacucucagcacuuccuggcaugcaguaggcacucaguaacuauguuuaauuaaugaauagaucugugaaaacaauguauuucauaugugaauaauuaaaccugauuuuuaccuuggaacuuaaggaaugugguuuuuuuuuuuuuaauuuuuuuuauuuugagacagagucuugcucugucacccaggcuggagugcaguggcacaaucuuggcucacugcaaccuucgccuccuugguucaagugaugguccugacucagccuccugaguagcuggaauuacaggcguguaccaccaugccuggcuaguuuuuguauuuuuaguagagaugggguuucacaauguuggccaggcuggucuucaacuccugaccucaggugauucacccaccuuggccucccaaagugcugggauuacaggcaugagccacugugccuggccucaggaauguguguuucuuaggcaucuggaugaagucaucuuuauuugccaugccuuccaagugaaaagcucagcaagccuucgaguccugccuggcucugcauacucucagcagaggacgacugcaccgugugcagagcagcauagacaaugagaguaacaugugauauggccucacauccaggacguaggaaaagaaaugcuucacuucaucccaacaaugaaaaaagucuacucuuuucaagacagcuauucucaaguagaguggcauguggguaggaugaagaaauaaaguaauuuggaugcuggaaugacuuuugggguuagggagauaaaguuagacuaucuucuaaagauugaguggauaaacuuaaccuguuuuaugauuuaccuucuccucauacuguaauacagauuucagaauucauauaccacugaaaauauugaaaaaagaggcugggcgcgguggcucaugccuguaaucucagcgcuuuggaaggccgaggcggguggaucacaagucaggaguucaagaccagcguggcuaagauggugaaaccccgucucuacuaaaaauacaaaaaaaaguagccaggcacaguggcaggugccuguaaucacagcuacucggaagguugaggcaggagaaucacuugaaccugggcagcagagguugcagugagcugagauugcaccacugcacuccagccugggcgacagagugagacugugucucaaaaaaaaagagagaaaagauaauuuugugcaucacacuccugugugaaucuauugcaauuuacaaauauggcucugugaggacugacaacauagaauugcaaaugagugagcucugcuugagugacauuuggaggagcgguuauuuaaguccagcauuuaagggugagucacgagaggaaagguccagggcgggggugugcauucugcaccugcagaaagccacccauaugaagaacccaaggugggaggaagaugaguguuuuguuuggccaauggcagguagaccagaaugccaggagcagacacugcaggcaguggggaguggggauagaagugauguuucaagagggugaagcugugaagaugaaaccagugggaggccuuccaugccgaauuaaagggcuuugccuuguucuguaguugaugaacaaccaauaaagauuuugagcagggaagugaccagaugagaucugccuuaaggaaacaauucuggagggagggagggaguauggaggauuaauuagacagggggcuaguucaguguaaggaaauacaucuguuuuuccuguuucuguccaugugauugucuugugaacagugggggacuuuugugggacugugguguucaguugaggccugcccggguaaggcagccccgcugugaguacaggaacaagaacugcaaggacagaucguagacaggcaagcaggagggcucggcuucuuagcuuugguguggagaccuugagugugcugucucucugagcuugugcuccuuggccuuuggggaccccugguaugccccugaugggggagcugagacagaaggguccuagagucucucuuugggcucagaggcauggaggacaaaagggauuuuguccuauugucuaaaaugguacuuucugucuacuucccuuuuauuagugccaaccuuuagaaaagucuuguuugaguguucugugucaccucugcuuuauuacgaguccuuaaaagaagagucauuuuucacacucgggccaaacuucaagaggaaucaaaugaagaguuaguguugugacaggcagguggugguucuggcccugcucaccaucaggagguucuuucuggugugcuggucuuggaagcauuucuucauagggggucauuguuauagucuaggcaagaauaauaaaaucacaagcauuaggucacugggcacaggagcaaaaaggaagaccaguuuucagaaaccuuuugauuggcagauuaauuuaagggugagggaaaauaaauuuaagggugagggaaaauaaaagauagguugggaguucugggguuccuaagcagugcuuaggaaaauacacugcugcuagcaggugaggucauaggaagaggagcagaauugccacgggaaggugcugaauucauuuggaauuccguauagagugacuuuuacccagugccguguaguuagcugcuggcaauuuuggaauuagaaucuagguuuucugaagccaggccagugucuuuucuauuaaacuaagacauguguuacgugaaauaaaauguacuugaguuucagguggugacggcaucucuaaguggagaugucaggcaggcaguuguaaauggagcuggagugaaaaugagaauaaauacagaaauuuauuuuaggaguuauguauauauuuagaggagauaauuggaacuaugggaagaaguucauucagagagauuuggcacauaggcuguaauuggaaauagccaagggguagauuuccugaaaaggagggaguggaagcuauaaugcaugcaguaaggcugaaggaaaggaaaggacagaggcagcgagaggauucuaauuuuuuaaagcgguuuugucauaauggagaggaaggcauagcuuggaagcugggacauaaucaagagguggaaaaaguuguuauuuuuaaaaauaagauaugccaacgggaaggaauggauggagagagaacgauuagagaugaaagacagagggacuaguucaauuuaguuuaacaaacaaauuguaaguaccacugaggugauaggcauagugcugggugcuaaggagacaaagaugaaguaaacaugaaucugacuuggggacauuuacugucuaauaaaggacaggaacgagaguaacacaagaccagcugguauuuacugagcaccgugugucaggaaccauugcagauacuuuacaugcauugacucacugaguccucacaacaccccuauggcuuaguuauuguuauuauccauaaagaagcagaaacucagucacagaaacguuaaguaauuuguucaaagucuuuaacaacuagucagccguggagccaagguuugaacccaggccguaccucugcaccucugugcaugauggagauggacgauuacaccacaacgcaaagguggaaauaagaacaauaaacagaaguagccuaagggagagagggcuuagauuuuuuuggcaaaugauagagaaauauagaaagaucucaaaggaggaauaaauggaagacaggauggauccagaugaagggaugcaagaaaaugcugucaagaccaaaguagagaacccaugugcagcugugcgugcgugccugugcgugcgugugugugcgugugugugugugugugugucuguugcuguuuuuucuaguaauuugcacagccuucaucucugaccauuucuugguuccaugcuaaccauuucuugguuccaugcuaaucacagaggacacucacauuugauucucuucauuucugugaacaguuauuaauaagauauuuuuaaaaaaucuacuagaacuggguuauccuuuuuagggguaucagucugguccaucaaaaucaucauuggaguggaguuuaugauauuaaauauaacauauauauguguaucuaucuauaucuaucuaucuauguaucuaaucugucuacccauccagagaacugacagauuucuaacugauuucugauuucccauguaguugggacucagauauucuuuggggaaagaacuagagaauuucagaggcagauuauugaagaugcaguugaaauuccagaaaauaagcagaucuuuugcgugaaaugcugaguagcucuuucugagauaacuguaugugguagaugugagauuccugauugucuguggcucagcagucagaugccugcacuucacccuguuucccaucccacccuugaccuuaccacugacccccagcuccuccugcagccacaaacugcauuccaggauaggggacauuguaagcgcagcaguccugugagacucagguauggugugaggcucucuacuuugcacauuaguuauuaguuaaaaaaacaaacgugaugucuagugguuuauuuuagacaacaucagaauguccccacaucaaaauaguugcaucauuguggccaugggggaaagugguugguuacaucaaaaugucaugugugggcaaagggauuauucuuggaugugaguaggggcauuugauaaggaagaaguaaauucagaauuugaaggauaaucauucauucauucauucauucguuguuuuacccauuuacaacacaguuacacauacgacauucaggcauuuaccaguuacgggaaggauuugugcaacugaagaaaagcccaucuguguucacauuugagaaagaaaauccuaaucauuagcauagcaccacugccaccuugugguaaugcaugguaguucauuauauuuuaugaaaaaacuguuaugucugguauuuauacagcauguacauuuuguaccuucugcauguaacgguacguuauaaagccauauacuuuuaccuaauacuaauuuaaaaauacacucaguggggggaggaagagcauuaggaaaaauagcuaauaccugcugggcuuaacaccuaggugauggguugauaggugcagcaaaccacuauggcacauguuuaccuacguaacaaaccugcacauccugcacaugcaccccggaacuuaaaauaaaaauuaaaaaaagaaaaauacauucagaaacugcucuaaagaagguacauauaaaaaaaggagagacagcuuaauuuuagaaauuaauaaauaaauguucacaaaauacagucucaaggagguaauuacaucauuauagauauucucgagaaaauuauaagccauugcaagggacaaaguacauuagcaaucacuagaugguuuacugauacagagggugauuagaauauguuggauaggccaggcacaguggcucaugccuguaaucccaguacuuugggaggcgaggugggcagaucucuugaggucaggaguucgagaccagccucggcaacauggugaaaccccguuucuacuaaaaauacaaaaauuagccgggcgugguggcacgugccuguagucccagcuacuugggagguugaggugcgagaaucgcuugaaccugggaggcggagguugcagugagcugagagugugccacugcacuccagccuggggaagagugagacuccaucucaaaaaaaaauauguuggauaaucuucauuauuuugcuuuagaaugcauaauuuauauuuaaauguaaaugucccaaauauuagaguuuauaguauuucaaacaaaauaauaaagauauuugaauauauccagagguguuggaauacuucacuagacagggggaagcuugcuucugugcauuucuugggcauacauucccucaauuaggucucgcggggcagacauaaccacuucucagguuugcacaggcugcagcauaacuggcuuuugacagguugaauuucuuccuuucuggacagggaaaagggcacaggaauugugguggaaagccauuuuuuuuauaccuggguugagcauggcaggauggaauacugcagacagacccacugaagagcgagcgcuucacugggcuucacccuggcaugcccugcacagagagugaaugcugccagcacacauuacacuguggccagacuacagcuuucugucacauggaugucucagacaaccagaaucagaacauguguguguuuuauauguaaaaguaaacgauuacuucuagugaaauuaaaaacaaaaacaaaagucguauaugguuuuugugaaugaaaacagacuauuguacaaaccucuagaauauuaaauaucaagguuuuauguaauguuaaaugucauuauagucaaugcauaccaucuagccuuguggcuuuuuuuuuuuuuuuuugacuuagucucguucuguugcccaggcuggagugcaguggugcaaucauagcucacugcagccuugacauccugggcucaagcgauccucuggccuuggccuccugaguaggugggacuacaagagugagccacgaugccuggccccacguggcuuuggaacucuguuucacagagccauagaauuccucagaggcaucccagaauggggaggcugugcugcuuagauucuggauggccuguucaaagugccuggucacauguauuugggaaaagcucagaugauccugauacaccaaacugcuugagaacaacuacuccugguggcaguuuauaaaaagggaaauguuuugugauauuguaaaugacaaaucacccucaucaucugauugcauugucauuaaauguugaucccagaaacaucccucaccgccauucuccuguaagcggggacaucauucucugaagcuccccuuguucccgcuguaguucuuccaccagcauuugcuuuccuggcgaggucagcgagacagugcggggauggacauaucacaaaagggggcauacagcagcuggagccauucuucucugcccguguccagaaauuucccagcacacaggguugaguccaguacccaugcagcucuuauucccucguuggaggucauauuccagucuucaucugcaguuggaucuggcuuuuguucggaucauaguugaguguagcuugguuucuuguggguggcuagcccugaagagcuacagugagcaugcucagucauuaaaccuaaauuagcuucugcuccuacuccugggugggggcagagcuuccuaaaaauguguuuuaggaagauuuugacaccagauuuuuaaaaugcacagagccagguaaaaguaagugguuacacuuaaugauauuaguuaaaggugcguggaaaaaggaacaaaagugcugaauuauaccuuuuuaaaggguuuaugcaaauuauuauauguacaauagucuuuuaagccugauaauuccaaucaccaaaagagauuuuaguauguguagguuccuaugcccuacucuaaaccaauugaaucaaagugcauuaauguuuauaaaggucuccaaguaaugaucagccagacuuuagagcaacuggcuuauuuaauagagcuuagugucauguauguauccuuauuuaaauacagagucuuacauuuacuuuuaagaaaguaggaaauucauggugggacaaaauucacaaggggaaaggaggauaccagcacaaagccaagagucuggagucaaaaggagcugaugggaaaguuuggaggcugauacgaaagccaggcuugaagcaguuucacagguggccgaugaaggagguugacagauggaaucagagcaagaucaaaugacuucccuuccagacccacgggaggaggagcagucauugcugagauaugaguuccggcauggcuacggggaaaaauaguucuuauaugauaaucacauaaaaauauuuagaagggcaaauaaaaggaaaaagcaauguuaugauaggagacacaauauauugaauauauuguggugaagauaggcuuuaggaugggguaaaacaugggucugugugguuuguguuuggccaccuuugaagcuaaauuaugcuaaguuuaacugcuggauaaaauauggaaggauagaaaaucuacugucuuuuaauuucacucucuacaaauaguaguucauuuacacauuuuguagguauaucucuucuguauacccauccucuccacaaagauaauauuaauguggacaagauagauagcuuccccuaauaacaaugaaaugguaguggauaaaagcagaauggcuuuuaauuugggggaaaaaaguccagaauagacaacagcuaauugcuuauauuugccacagggacaauuugcaagugaggagaugacccgccacaaaauaggcaccucuggcuagaguucuuacagugcugcuggguuccugccaagggucugccugaagagcuccuaaagauaggcuucugugcaaguuucccccaaaagccaucucagcuacuuuaucggaaugucaguguucauucauucauuuguucaguauaucauuacuaagagcuauuaucugugccaggaacucugguaagcgccagggcuccagugaugacugagguggacauggccucugcucucgcugagcaugcaggcuacucagggagacagacauauuaguuuggggcuuauugaauuuugaagagccaguggcauccaaguggaguuauccagcagcaauucuaaucauuuccuaauuuucacugguaaacaagauaagaucgguguucuaagaaguaaaauaauauacauagcuuguuauaaaccaugcuccauuauuauauuaaauaaaauuucaugauugauuuuugcuuuuaugcuuaagauuuagaaaacuuuagacauuuucuuuaugugguuaaauuaggguuuugugcaauaauuuauccaaauagaagcauuaggcccuuguccaggauugucucuuuauguacuuuguaucagucccacuaaaaacaccuuuuuccccaaagugugaccuacucaaauaguaccuuacuucugauacuucauagcauuucggaguuuacaggagauauuugcuuaucauuuuguuucuuccugacaagucugaggaauacagggcaggugauguuuauuuauuuacagauggggaaacuuagguucauagauaugauuacuuaugugaagucacagagcuaguaaaugguggaggcggaaguggaacccagccuggggcucuuuuacaggagucaggucuauuuuuguuuuaugcuuccugccaguauagugacuugcuggaaagaaaaaucgaauugucuuuuuccacugaauuccuccaguuguuaucaaagaaaaaaaguuuuaaucguuuaauuucuuacuuuuuguuuccugauucuucaacaaauuaguuaacauguauuaauuauuuucuucauaucaaauacuuggcuauaugugggauagaaaaauaaaugagguacaguuuuugucacugagaaacucaguccuauaggagagacccaggcauuaaaaaaaaucccuaugcagcaugauuaaugcuauaaauaaugcaugagcauagagcuguggguauaccaaggaugugauaguggccagagcuuugaaggaggaugggauggggugggagguuuagaagaggcaguggaggacgauauugaguagaagggagagcuggugaaaaagcuuggacacagggaagcaugguguauuuggggauuaccaaguacuucucuuuuacuuuacuauuaggggaacuuaggaggauugcugaagauggggcuguuaaggaagguggggcacuuauggacaaaagagucuuguaugaccagcuaagaggucuggaauuaugcgggugauggguacaccuugaacauauugaaccagaguuuggcaguuuuucagagauaauuuuguccacaguggaaggaauggacuaguggugggaaaaauugauagcauggagagcaccuaguaaacuauugaguccaagagaauuagaggagcccaaacuaaggcaauagcaagaggaguggaaagggauggauuuaaggaacaaaaacuuuuccauaauaaauaaugcuuaggaugaggacuguuaugaugauaauaucuugacaugccauguuuuuaaagaauuauauauuauuuugaauccauugccucacauaucaucauagcacauagugauaugcaggcauuauuuccauuucagagguguaagucuguuaacuauagaggcuuaguuugaccauuaaagauagucagauagauucaugauguuacagguuuuguacagacacccaagaaagccuaacacagcuuuccuggaauuuauaugacaaaugaauaaggaaauauauaggccaaagaaaaauuguuugagaggacacaauagauaguaguuagaagagacaggaaagaagugacacaaauaaaauguagaguguugaaaucuccccugauccaucucucccaugacgccaaauuccauuccuuagaugagaaguggaggucaugcugggacaugacugguagaagcuagagguucuucuggaauucuugaaggcaucuguaaaagacaugcauccucacugaccuuugcacuuuacacaccuguuuaacacuccucuaaaagccagcaucgcauaugaaaguguauaccuacuggauaaaucaggcagugccugauuuuucaaggauucuuagcuuuacaaaaggcucaucgaagggcuguuuuuaaaguugcauucuccuuggggcauuaaagugguuuuccaucuaaggagcuuccacuugugacacagaggcguuucugaaaauuuaggugacauccuggagcauccauguguguauauaauuuaaaagagaaauuacuuuuauuuucuuuaagcaaagggcaugaaaugagcaauucugcagcuuuaagacauuggacuaaaaacaguuacagaaagccagcuauauaaaaauuuauucaacuuguaaugcuuuuauuuuuggaaaacgauuuuucaaagucagguucauugaucuuuuugcuuuuaauuuuuuuaaacuagguuauuggauuccaguuggagucuauauggcuuuacugauuuuccaugagggucagguaguacuaaaccauuaacugccagauuauaugacuaaauggcaguuaauacaaauguuucuaagcccuuuuugggaggaggggggaguuaaugccucauccuagaauuugugaacaaaguaaaacuaaaacauacuugcuuuuaacagauucuuaaccauaacucugauuauaacuauuucuuauauuuguuacuaacuuuguuauuuugguugaacauuaauaucgaauauaauagcaugauuuuuaaaaaaugaaucuuuguuucuucacuugguauacucauuauuuugaaauauuuggagccacuugcuuuuuucuuaaccacacuuugauuguaugauuauauuugcuagagcuguuacaaauuaaucacuuuuugguuaugcuuguucuuuuaugagaagcgucuguuuagccguacauaaacagaaguuuauuuugaggauuaacuuucacgugaauaacugccucccagcuaaaucuuuuuaaucauaucuuuuagaggaaggcaagaauguuuuuuccuuuucuuuuuuuucuucaagaauuuaaaauuagcuguuuguauauuguaacauagagagguuuguagcuucgugaaggcaaggacuauauuuuauacaucuuuauauauacaccacagccucacacaucacaggagauuaauacaugcuuauguaagauuugaagaauguaauaauucuauagaaaaaacauaaauuauuugcuuugaaaaugacucuauaaggaacaucucuaaaugcacaauauucucauaaaaaaucaggauagacauuuucugccccuccagagguauaccuuugagcguuguguccauuuucauacacgugaaaagaaacagccugaaaucugcugaacccuggaaaccauaaaggcauuuccggccaggcgugguggcucacaccuguaaucccagcacuuugggaggccgagacaggcggaucacgaggucaggagauggagaccaucuuggcuaacauggugaaaccccgucucuaccaaaaagacaaaaaauuagccgggcguguuggcgggcgccuguagucccagcuacucgggaggcugaggcaggagaauggcaugaacccgggaggcggagcuugcagugagcccaggucgcaccacugcacuccagccugggcaagagagagagacuccgucucaaaaaaaaaagcauuuccagccuguguuucuuguuuacucauugauaccauuuccccucaaucaggggcccagcgcuuucccguuuucuaauuuuuugucuuuguuuuaaaauacacaguuaccuuacauaccauuguauacuguugguaaaaguuguuuaggucaacucaaccaacauuuauuuauggaggcccuaugauguguuaccuaaugccauggauggugauguuacaaaaauggguagguugcugucuuugcccucuuaaaggccgcgaccuggugggaccauaaauauguggauggacacuguucagugucauaggugcuguuacacagacaggauaaggauguauuagagacccgaaggugggagugguggcuucuuccuaccccuacggggucaaggacgccuucccagggcuaauggugcuggaugaauguugagaugaauagauuucaagacagacaaguggagcagaggauauuuagggcagaggaaggagcuuaggagggguaggccacgcauuuggagggcuguguaggggccuucuaugguacauguaggagcuuggacuuuauguagcaggcagaagagaacuaaugaagggcuugaagcgguggcguaauuuaacuagauuuucauuuuagaaaauuacacgcaaaaccaugggagaaugaaguagguuauuuacauuuccuuaaaacaguacuuuuagaacauaaauagaccaaacauuaacuuuucuuccccauugccuuaaacagaacuuuacaaaaauccgaauacacccacuucugccauuugaauuuccaaaugauuuauucuuuggccaagauguauuuuuauagcacuuuaauguucuguguuuggguuuaggaauuaugggcugccuaccuugggugacaccagaugcuacggugaugcagcucaucauauaacucuccggaaucccccuuggcaguggcugcaggcuucccguauuucuccucaaagcaucuugaaauaggacuguauugaaugggcaugacuggacugcauauuuuaggcauuuucaggaaaagaaauaaagaauuuguaugugaaugaaucugagcaagcaucugaaagaagaggaauggauuuagaguaacaaaagacuagcaugaugucacaugacaaaguucagagacgcuccucuuagccgagguggcuucccaugguguuacuggucaucugcacucugguccaaaaagcaguccuguggucagugcuaggccauaagucuucaguucugaacacggugagauggcucuuccaugacauucaguguaguuucuuucuccuucucucacuaacuuuguuagacuagaagcuacauuauccucuuaaaaguuuuuagcucuuaucccaaggacuuucugggauauuuaagaguguuguaaucucuucuuuuuaaaaaaauuauuuacauuaugguaaaaauuuuauaacaaaaauuuuauaacagaauuuacuaucuuaaucauuucuaaaugugcauuucaguagcuuuaaguauauucacauuguuuugccauguaaucuguauguuuuuaaaugaauacuucauauuccuuucucaucaaguuaaugauuauuuaacauacuaucaagucuugauuuuuauaccucuuauuuuuugcacauucucuuuuuaaucauaaaugcugaaucaauguuauuuuuuugaagaauaacucucuuaaauacugauaauacaaacuuugauacuuccuuucuacugugguuauauuuuccccauauuaucuuuugaccucucucuauggcaguguccuuuuaugagucacaagugcacacuuuaugcagcagugaaccaugaaacuggauaggacauuaaagacucugaaccguuguuugguuauuucagguuauugaggugugggugcuaauugagcuuuccuagucuaaagugaaaauaauauguuacccagagguuccacaucuccaaucuugguuugaaaauaaacuaggacugaaaacauggaaugaaaauauauucuuuuguguuuugaaggaaugaauauuugaauucaaauuaauuuuucuuaggguaagcuuuucauuuuuauaaaauaauguuuaaucaucuugggaagaacaacuauguaguauaucuucaaaaauaaaauuuucaaauugaauaaauaaguauauuucaaacuuucgaauuaggaaaugccuguauauuuuaggauuuguuugguuauauaauuauuaacuacugcugaaaaugcaacagaaaauuggaacucaaaauuuuucaguuauugcucucuaaccucaaguaauaucaaauuacgcuguuucaaaugguauaggagaccauuaagcuaacugaagacaaaguuuaaaagaauuauuauuuguuacccauaaccauauuaaggauaugauuuauuuaaaaaacaacaaccaaaaaacuaauccaauuauuuaaaaaacaaccaccaaaacacuaauccaauuuacuguuauauggaggcuguaauuuuuaguuaugguagaucucgaaaguucaugaacccucuaaaauuguauguaauuuuuaguguguauauuguguguguaugugcgcacaugcaggcauguuucuggagagauaguauucacaacuuucaacagauucugaaaaggcaucuugauccaaccaaaguuaugaaccacugucacagagguuacuuugcccauuuuccuuuuuacuuacagaccccaacccacaacuagauuuuguuccagaaguaguuuguuuaugaacugguuguuuggaacuuagaccacauuuuucuaugaaaguaauaauauauauuauacacacacacacacacacacacacaacaugcgcacacacacacacacgcacacaagacauucccugacuuacagugguucaacuuaauaauuuuccaauuuucugauaugaaagcaguaugaauucaguacaaaacguacuuugaguucucaugcaaccauucuguuuucacuuucagugugauauucaauuacaugagauauucaauacuuuauuagaaaauaggcuuuguauuagaugauuuugcccaccuguaggcuaacguaaguguucugagcacguuuaagguagauuaggcuaagcugugauguucaguaggcuagguauaugaaaugcauuuuugacuuacaauauuuucaacuuaugaugaguuuauuaguauguucauuguaacuugaggagcaucuguacuuacauaaauuauagaaccuucacaauggugauacaaagacaaaugagauagaccucccggacuccaaggaguuuauaauccaggccagugcaaaaggcagguaaaaccuauccucaguugagauugaccuccuaauuugccugugaccuuccuguucauuuuucugcagcuaugucaggacucauuccuucucaccacuacacccauagaaguauuaggcaacugguauccuugggauucagacacaugagacuauagcauggggacuuaagcguuaaggcagauuuaugacaugguuucuauggaaagauguacuccuaguucuaacuuggaacccagguuccugggacacagagaguccuucacuuggagccucauuaguggauacugucugugugaugaaugaagaguacaccucaccuccgccguggagucucucccucaagaguucuuuacacagccagaauaaagaccuucucauuacuaaugaccauuuguguuugaaauauucauaagucagacuuuucuuucugaggugcggcaugaaaaauuuuccccacuaccccaauuagguucuugaugagggacaugauaguucuuuguagcuagacuacauaauuucugguagaacuuuuauaauauauguuaguuguugaccaaagggagaagcuaaagggugaaagagggcagaaagagaaaguggaaugagagggcaugagugcuucaugaugucaucacaagauuuagcuucucauuaugccacauaaagaguggcaguuucuuaguucauuuuucuugcuuagaacaccugaggcugggugauuuauaaggaaaauaaauuuauuuguuacaguucuggaggcuggaaaguccaagggcauagcugggcaucuggugagagccuucuuccuggcagggacucucugcagagucccaagguuacacagaguaucacauggcaagggggcugagcaugcuaaugugcuagcucagaucuuucuuucuucucuuguaaagccaucaguuccacucucauguuagcccauugauccauuaaccauuaaucuauguauggauuaauccauucaugcaggcagagcacucaugaccccauagcuucuugaaggcucuaggucucaacacugccauauugaggauuguauuucaucauaaguuucagaggggacaucaaauuauaauagacagugucagucuuucuuuauaauucuucauguuuucuacagguccugggaaagcuuuuuagauuagacuguuagcguaucuugucauugcauaugaugugugcacauauuuugaaacauggaucaagaagacaugcuccaccuauauagaugaauaggaggaaauuuugucuucagagaauacagcaaagaguggucauguuuuggaguuaaacaugaauuuacacuaagaauuauaauuacuuuagccaaauaauuuugcaagauguucuuugauuugacuaaaaaaucuguaugauccaagaccacaauaauuuuuagcguuauaaaaagaugugacuaacuuuagaaaagucagauuggauuagcuuguacauucaccauuugcuaccaaaaagccaacguagaggacuguggucuauuucuuaguuacauauuagcuacauuaagucgcuaauuccucaaauauggaggugccucuuuauggauaugcaaaauguauauuauaaauuucaaaaguuauacauuuuaugauguuccucuaauaguuuaucuacaggguaauugcuacaaaccaguauuuuagauaauuauaccuguucauauuuucuaaaaaaaaaauaaagcaauguagacaggaaauuaguaacagaacaacugaaaauuggaaugacuagauucuauguugagauuaauagucaugcaugugcaaauaauguuuucccauagaagauaaucuuugugacuuuggguuagacaaagcuguuuuagauuugacaugauucauaaaagaaaaaaauugauaaauaggacuucaucaaauucaggauccucugcucuucaaaagaugccauuaauacaauggaaaaaaaaagucacagacugggaagaaauauuugcaaaucacauauuagauaaauaucuugcauccagaauauguaaagggcauuuaagaugcaaaaauaggaaaacaguucaauuuuaaaaauggacuaaagauucaaacagacauuucaccagugaagaugugcacaugaaaaauaagcagaggaaaaugcucaaagucaguagucuuuagggaaacgcacauuaaaaccacaaugagauacuauguaccuauuagaaugccuaaaauuaaagugacugacugaauguuggugaggaugugaagcaacuguuggcagcagaccagugguugccuggggacagguagugauuauaaagggaugcaaggaaaguuuugaguguggcgaauauguucaguaucuugacuaugguagugguuucauggccauauuuguaugucaaaacauaucaaauuguauacuuuaugugcaguuucuaauaugaucaugauaucucaauaaaguuguaaauuuuuuuuccuguaauguugcuuccuuugguuuguauuucugacuuaauuggugauaacauagauuuuauuucagggguaaauucucaagauauaugacauuuaaaauauacaaaauaauuagaugauuaauauggauuuuuagucuuucugguauaaaugucacauaauaaaucugaauauuuuugguaacugacauguagcuaauacugauacgcacuuacuauaacacucucagccucaauagauuuaaauaauuugacuuauuuagaaauuuauaucauuuauguuuuuccccuuuuuaaaaauaccuuuguuaugcauguguuuuaauuuuuauuguuauaagcaaaacuuuagugugauuuauggaauaaaaagguaauuauagaauauaagucagugugaauugcugguacauguuauuuccuuucuguauugggauuccauguuaugaaauauugcuaaaaauaaguaggcuuuggggugagacuuggggaccuuuuaauuccugcuacagucaguggugguaaugguguauuuggugaugggauuugcccuguguuuacauggguccugagcucuggugaugggagagaugauagaagauaacuuauucccaucccuguauauuaagcugguaccaugugguaggacauugaaaugguuguuuacacuauaaaaaaugaguugcaauuauaaaaacaaaggcggaggagggaggccauagaaugcuggcauuaaaucuuauuuuucuuaagagucugugcaaaauggggccuggaguuucacuccaggagcacuuuuagcugcugccacaugaagcuuauuaagggcaagauuuucuccugacaccuggccuuucucacugcuuccucucaggagaccucucuuaccauugcuucuguguggacuccgacagcuauaauugguuuagaugugcagcuagacccuccccuagucuaaggcagugguuuuccaccguggcugccauuugaaucgccaccuccuuucucacccguuuccccauugucacuuuccugccuuaaacauuucccuagcuuuuugcacuuagaagaaaaagcacacucccuguuguguccagcauauucugacucuugucuccuauaaccuccucucuugauacaguccuacuccagcuguuauuuguccugacaguggcugcaaacacuuauuuacuucuuacaagaagcucuuauaauuugaugccuggcaaacacucccuggacuuaauagcauaaugauaucauaauaauaacacuuucugccaucuauugaauguuuucucuaacccagacagugugcuaagugcucuacaggcauuaucuuauaauuaaguuagaugcaacaagcuugugaaguugguauuguuauuuccgauuuuuaggagacaaaacugaggcauagaguugggguaauuuguccagguucauacuguuauuguaugcuggagccuggcuugaaaucugucugucugacucuaaauuugcucuuugguacugacuuucaaaaguguuuuguuacgauuaaauuguaaugauuucauaacaguuccaggaagacagucuuagagcaagcuguagaguaaaauucuuauugaaauucaaaguaaauauuaacucaacuuaacugucuuauuggagacaacaaacuuuucucaauauauuaugucuuuaugguaguaagaaauagugucauguaaaaguuggaaaugaacuguggaaucagacagacagaaauaugaucucagcaccugccauuuauucauauagaucucauuaucauauguagcagauaauguucuaggcacuggagauauugucagugugcaauccagugggaugauuaaaaauuuugguucuacaagcuguuuuugucuuggaggcucacuauagcacuguaacucuuuauugaaugcuguauaaaugugauccaucuuggacccuauccuaagggggucuauuugagccaguguugugacauggccucuaagguaauccuauagaaaggcucuaguguaguuugcuuucuuuuuuccuuccucucuucuuuccauccaauuaaaaugaaacauuaaauuuaacuuuuuuagauauaauaaacucagggaccuuauauucuaauagggguagcacaauaaacguaguaaauuacauuaugugucagaagauggaaaguacuucgugggguggguaauaagaucaggaugggggaaaauauggugagcaagcacaaguuucagugugaaacacgcaguuacucaggugggucucauugagauggucaagaccugaaggaggugaaggggucagccagagggauaucugagggaggagaggggagguagugccagccuacagcaggaguauguaggcccacugcagaagaacgcagccauugugauggaggaaaucaagagagggaaacgcuagaugaggucagagagguucaaaguauuuugcuggugaaaacaaaaugaacuagcauaccuaaggcacuuaaccagagccuggcccagggccacagagucccugccuaccucuuacagcugcaucucccucugcucccucuugcaaacuuuucacugcauuuauagcagaaagcucuuugaagaugccucaaauauccauguuguuuuaaccuuucuacuuuugcacacaccuaaaaugcccuucccccaucucuugucauaaacuccuucaagacccaccuugggcccuugucugggaacauugcuuugacucccucugaggcgaguugaugcuuccuucucuggaccaccugcauaguacuguguauauguuagaaauaacaccuggcugaugguaacuaacuuuaaugagcacauacuauacaccaugcacuaaguccuuuaacguguuuuucauuuauuucucacaacaacccuauaagguauguccuauugucauccccauuuuacagaugaauaaauaaagccaugaagaaguuuaguaacuugccugagaucauccagcuacuaagugguggcaccaggaggugaacccaagguuucuggcuccaggaccucugcucuuucguaaucauauuauacugcaccuccaccauacuuaauauauacaaggcagugugcacauaacacuguauugcaaguauuaguguaugugcaugugucuugccuauuauuugugaauucuuugagggcggagaaccaugucacauucacuuuugcucuuuggggcuuugcacauaugcaaagcuguggugagaguaaaauauucuccuguaauuuguaagacaugagaaauauuauucaaaauguuaaugaaaaugcaccauuggcucugaauuucauuugguuuugaauuucauuuuaaucgugucauugugcuucugcuucucucuagaccaguauuaaagagggacagcuauugaagcaaaccaguucuuuccaaagguggaaaaagcgauacuucaaacuucgaggccgcacccuuuacuaugcaaaggacucaaagguaacucacgagaauacuaguuucaagcaauugaggcuauggauggauguaaaauuuugguucuguaagcuguuuuugucuuggaagcgcacuguagcauuaugcucuuauaugaauucaauauaaaugugaucuaucggugaccccaucccaagcgggucuauuugagucagucccauaacaggucccuaagaauaaucuuuuaggaaggcucuaguguaguuucauuucguucuuccuuucuucuuucuuuccaauuaaaauaaaacauuaaauguaaccuuauuagauguaauaaacgcaacauucuggguuuccaccuuuuaccuuguaaaucuuucccugaccaugagagagagagagagagagagcugcuauaguugcuaagaauucaugcucuguguucagacaagagcucauaucccacuuccagcauauuccaauggaguggcuguggacagcauguguugcugagaggaggcuuaaaggagaaaauacacaucaagagcuuccauaguaccugauucaaaauaaucacuccaguaugcuagcaauuaggaauacaaaucauauugaaauaaaaucaagacuuaaaauauuuuuuauauaaccauugaaucaaauaauaauaauauaguuuugggagaagcaauuuguaaaaacucguauuuuaguauucaaaaauaaauuaagauuucuggcuacugugccaguugaauaauuaauuauuuucauuuuuauaaauguaugcuccugauauaauugguaggguuguacaccaggagguaaaaacaagcaaacaaaccuaauucuaaguuuauguaucuauagaaguaauaaccauguaaaauaaucuuauuuuacaagucauuauguucaaaauugucccugaucugucuccauccugauuuuucacauuuaucucuagacagcauuggcuauuugacagccuccaguuugggcucaugcuaccaucacuaggaugacuuuuccuuuuccaucugcacuugacaaaguucccuguuuucuucaagauccccucaaauaguccuuauuccaugauucacgagagagaguucaguuuucugcuggauaaaucaucugugaucuucuauagcauuucauuguauuucuucucuuuuaauugucuaucuuaccuuaaaguuaguugugucuauuuaaucuccugugcuagacuguagguuccuuccagucaacgaacaagucuuacagucacauugguugaauugaaguagacuaguucuacagucuacuucaguuucaaguuccgcugucaacuacuucaaguucuaguuuccgcaguucuugcggugcaccguuaucccugccuugcuggaacaacgcugaaugaguaugaacaaugagugacuaaaagugggaagccuacauuuauugacuaggauuuccuacuugcuaccuuggauguuaagaguauacaaaaaaggucaucugcuacuugcaaagcaaauucauuaccucauuugaacgcauaguuauagaugaggaaaauaagguucagaagguucaguuacuuguugugagcuaagccaggacugguucucagcucucaccuugcaaaccuggaaacaaugauauugccucugccucccuggcagagcuguuacaagcuucagagacauugcauugugcauguguaugccacgcacucagcagguuccccguaagugguagcuguuaugcuuccagagagcacagcacauuugcauugaaacaguguucccagggugucuuuaaagcccuuuucaguuggggauuuauggauuaguuguacuuuaugcuuuuauuuuuccuuucuaggaagaaauugcagaaaguaccaccaacuuaacuuuuuucccccauuuucuauuccuaauuccuguauugaaaaaauguauugaagagcauugaguuagguuuucuucuaaugucuuuguauguuuuuuuucauuaacagucucugauauuugaugaaguugaccucucagaugcuaguguagcugaagcaagcacgaaaaaugcuaacaacagcuucacgguaugguuauauucugcuaacucccuucucaaaaguuauagaaugaccuuucuuaagcguguacagaaugcccuguucaauuacaaacuguugcuaacuuaugcauguuggaguuccuaccaacacaaucagcuuuaaauacacuguauauucuaacacccaguaccaguuaugacucaguuaaccugagguuaaauauacuuuuuaaaaauuuuauaauuuuucccuuuuaauuuuagugcuuuaaguuuuucaccuccucuaaauuaauacuucaauuaauuccauuguucuugaauauuuaagaaguuuauuuaccuucagucuuaaauauaauauuuucuccauguagccuacuuucacuccauuucaccccaguugccaucguucaggcaguugccauaguucaggucacuucucacuuaggugauucauucggcagcucuguuccaguuucuucuuuucugaucacagaucacauugcuuaaaaagaccucacugguuccacauugccugcaaauggcaucccccaacucagucuucagaucuuguaagaucaugccucagcauucuaguauuaccagacaauuuauuuguccuucucugucccaccagugcagcaauucuacccaugccuaugcuuuuccuguucccucugacuucagugauuccucccccaucugucacggugggaauccuaccaauucuucaaagcuuauuucagauaacccauuuuuuuccagcuucuuucauucacaaaguauggauugaguucccaccauguguuaagcacaagaaauucagaggugaauguguauguauauaauuucccucaagauauuccugacgucguucagcccaauuucaugugggcuacuuuuuauaacuacauacucccuaggucuucaaaggugcauuguucuugcuguguugucacucccauccacacucccaguccucccuggaaagcuaccacuccugacagcagugugcaguguccauccccuaggcaugacagagcaggggagacagacugcuaaacaggugcacagcggugccaugauagaggugagcacugguagggguugggggaagagaggacacaaaugaauucagauguugccuuauugauuuaugggcauguggguuaauucauaguguaaauauuccuccccgucuccccugauccccagggagaguuuaguuugagaagaggaaagccaagaauagaguccugggaaaauguuaaaauucaagguuuaaccaauaaagacugagagcauucuuaaguaaaggagaaucaggagucagugauguuauaaaaaccaagcagaagagaguuucaagacagaugcuuugacacguccuauacuguagagaggucaagucaaagaagaauugaaaagugaugguucaauuuguuaacuuggaggucauuuggucccauugaugugaguaguuucaguguggggcaggcugggggcaggcauuaggcuguacugugaaugcaaagugaaaggcaggcagagacaagguagguaacuguuuucuaaaagcuuggcuguuaaaaggagaacagagauagcuaguaaaauguuucauccagaagagaauuuuaguuuuguuguuguucuuuuguuguguuuuaaaaaugauuuugaaugcauuuauaugaagagaggaggaauaguuagaaccaaaaguugaagacucaggagagagagggaaugacugaugaagcaugauugcugaguaagcugacggguguaggaaucagagcgcagguuaagagaucagcauugaacgggagacagaaagcuuacagaggcaggugugaccaggaaguuuauauauuucaaaaccaaauacuguuuucucauugaaauugaaggauaagguuauuugcugugagugaaaguugaggaugguuaauaguggcuucuauagaaaaagauaaucgaaacugaacagggaccuauagaugauuacuaaguagugaguggugucuaccaaagauuggagaucaaguuuaguaauguuguuacucgcugugcuuauaacauuuucuuuaagugggaguagagaacaaacaaaugaauugauccaggguuggugguuuauagggcauauuggacagaaagagaaagggagagauugcuagauauuugagggauuguuaacucauccaucucccugcucuucucaguuuuugagacuacaguacaaagaguaggggacagcuuuggcugaacaggauccaacaaccacuaaaugcagagcuucugaugaauuguuggagaccuaaggccaaaaccuugcuuauuccuucuuucuuccacuugaaggugggguagggugagauagaaagaacuucaccaguccuacuaguaggauuagccacuugcuuuucccugagcagugaagaauaaucgucucucugcuggagccucauggagggugaauaagguuuucccccaaucaacauuuauuuguuuuuuaaugcuuuuuauuuuuuuaaugacacacaaugauuguacauauuuguaggauacauagugauguuucgauauaugcaauguacagugaucagaucaagguaauuaggauauccaucaucucaaacaucaaccauuucuuuguguugcacacauucaauauuuuccuguggcuguuugaagcuauauaauauguuauuguuaacuauagucauccuacggugcuauagaacacugaaaauuauucuuccuauuuagcuagaauuuuguauccuuuaagaguuuaaucugaaagaggguuucagaauuuaagauuugaagcaugcauuaauuucuggugaagacaaggucuaggguuuuggaguaggaaauuauucaaauccuuauacaggucuuucuuggcccuucagcugggcuugugaucucuccuguaaugucuuucuuacagaauuuagcauaugcugccuuauacuuaguuaaguauuuauuuuugaccaggcacaguggcucacaccuguaaucccaacacuuugagaggcugaagcaggaggauuacuugaggccaggaguuugagaccagccuggggaacauagauucccaucucuacaacaaauacaaaaauuagcuggguaugguggcaugcaccuauagucccagccacucaggaggcugauugcuugaggaguuugaggcucuagugagccaugaucccagccugggcaacagagugagacccugucuaaaaaaaauuuuuuuuuggccgggcgugauggcucacgucuguaaucccagcacuuugggaggcugaggugggcagaucaugaggucaggagaucgagaccauccuggcuaacacggugaaaccccgucuuuacuaaaaaaaauacaaaaaauuagucaggcauggugccacgugccuguagucccagcuacuuggguggcugaggcaggagaaucgcuugaacccagcagguggagguugcagugagucgagauugcgccacugcacuccagccugggugacagagcaagacuuugucucaaaaaaaaaaaaaauuuuuuuuuuuacuauuuauuuuuauuauaaccuccuugaggauagggacucugucauaccuuuuuaaucuuauggugccuuauccauaaguauuuguugauuuuaacuaauaagaugaauguuuauuuuaggcaugagaagacuuuuuguugaaauauuuugaagaaguuucuucauucaaccaaauacuauuuuuuuaguuuacuggacuagaaauauagggacugguugggcacaguggcucacgccuauaaugccagcauuuugggaggcuggugguaggaucucaugaagccaggacuuugagaccagccuggggaacauagugagacaccccuucucuacaaaaaaaauccaaaaauuagccagguguaguggugcgugccuguagugccagcuauucuggaggcugagaugggaggaucgcuugagcucuggaguuugagguugcagugagcuaugauugcaccacugcucuccagccuggacaacaaagugauucccugucucuaaaacaaaacaaaacaaaauaaaagaacaaagaacaaagaaacaaaaacaaauguagggacuaaaaaguuaggcagauugcuuaggguuuuagagcaaaugaauuugguagaacuuuccaggguauaaaauggagcaagagacauguuuucaaccaguaauugacaaaccuuccucucuuuaaauauuuaaauaucuuaccuuccucaauuauugugacugcuacugaugcuguuauuguggcugguuugugucagaggcuaauggugcaguuugguguauuauggcuggaggauccaggaauggccaaauucgacuucauuucagccaucccuccucuugcugaaguuucuaagggugauauauugacaaaguacaauaguggguggaaacuacauaaacgguaaauggaaaauggaaaaccugugcuuugccugaaaacccagugcugaacucucugguaaaauggguucuagagaucagggcagugauugaccuagccugggaaguuccucagugucauuuccacgacauucaguugguauucaauugguaugaaugagucacuaaggccagccaggcuucaaggggggccacagacauuaagacagucgugucaaaggauuugggacaugauuuaaaaccuacacacaguaagauuacucuuccuuucuugugcagucucucacucccaucucuggaguuaauaacuuuguuuuuucaguuaucuaaauugccucagguauucuauuaguuuucuauugcuguauaacaaccaaccacaaacuuaguggcuuaaaaaaacaaagcccauuuaucucagguuuuauaggccacacaguauugcuagauucuucugcuccaggucuuacaauauaaauaaauagauauggguugggcaggguggcucaugucuguaaucccugcacuuugggaggcugaggugggugggucacuugaggucaggaguuugaagccagccuggccaacauggugaaacccugucucuacuaaauacaaaaauuugcugggcgugguggcucaugccuguaaucccagcacuuugggaggcccaggcagguggaucgcuugaggcuaggcgaaccccccuugucuacuaaauauacaaaaauuagcuggacguauuggugcaugccaguaguuccagcuauuugggaggcugaggcaggagaauugcuugaacccgggaagcggagguugcagugagccgagaucgugccacugcacuccagccugggcaacaggaaaagacucugucucuaaaaaaaagaaagaaacagauaugacaaauuuauauauauacuuguauugacucaaauuaagcuaauuuuagccauaguuugaguuuaugauuacacaagugucuucugccauaauaaaacuuacuaacaaugaaaguauuuuuuugugauuuuagguggcagugaugcaaucagggaauggaaaaggacaauuucugacaggauuuagguuaauguuuauuaauauauuuguaguucaagccaggcaugguggcucaugccuguaaucccaacacuuugggaggccgaggugggagaaucacuugagcccaagaguuuaagaccagccugggcaaaauggcgaaaccccaucucuacaaaaaaugaaaaaauuaacugagcaucguggugcaugccuguagucaaagcuacucaggaggcugaggugggaggaucucuugagcggagguugcaguaagccaagaucgcaccacugcacuccagucuggguggcagagaaagacccugucucagaaaaaaaaaaaaaaaaagagagagagagaaaaagaaaaaaaauaauaauuuauuuguaguuuaaguucuaccauggcauuuucuaugauuguuaaaucaauaaaauguucuuuuuuguuguucauuuaaaaaaauucauuuuaaaaauuugauugcuaucugcaugguguucuggaaguuucauuuuuaucuuuaacauagcccuaugcuguaugugaauguauuccucccagaugaggcuagagagaauugaucuccuuuuggucacacugaugccacccugggaaagggcucccagaccuccugauguuuaaucuaaggcucuuuccaaucagacagaguccuuucuaucuggguagucucugccucuacuguucucuuucuuccucaaacacugcucucuuuucucacuaaucaugauaugucuauccccagauuuguuuuuauuuacccaauuuguagaggauaggagcuuagaccaugaaagucaaacagccuggguuuggguccugacuuggcuacauccaguuaugugaccuuggacaaauggguuaaccuuucuaaaucccaguuuccucaacagucauugagaauaacaagaguaccuaccucauaggauuauaaggauuaaauuaaaugugauaauacaccacaauaccugcaguuuaauaaaaguggcaguuauucucccgaguuuaucaucucccuauuuccaaguagcaguauguugccgauuccugaaaguuugggaauuuggaagaagaauguggaugaacuuuaucuugagaaaacauuccaugcugcuuaucuuucagagauauagcaaagauuuauuuccacuuuuaucucauauuaauaacuaugacugggaauaauaaaugaaauuauaaucugaccauguuagguaaauguuauuugcgaaagaagagcuauuuaaugauaugaaagucaucacaaucacauggcauauguuaaccuuucaaagcaugcuguucaaaugacuguuuucuuuaaauuuuaaugaagauuaggcuaacucuuaaaugagucacaauuuuaaagaaauuuuuguacugguauuguuaaaacuucuuauggaaguuugcuagagaaaguagcauguguuuuuuauuuguuuguuugaaguagaaagaaauacauagguaauuuaauucauuuauuuaaccacccauaacauuuucugggggcagucuguaggugugugugaaauuucauggguacggcacacccacaugggcuuacucgguugaugaaacacaggcacccucugguaacacuuauauuuagaacuaaaugaucacuggaagaaaaagggauuuuaguucaggggucccuuuccacagcagaugugaguaaaguuuauuagcauuagauuauuauucuuucuacgaggguuuaaaaggucuacauaaaaagacaccaauaaacaugagaacauacucuuauggcacaucaaauaucagaaauuaugcauucauaauauaauugaaaugagcagaguggguuuuagugguacagaacaaaauguucuuaagaauuccuuuaauguuuccuuucuauuuauucugcuuuucccuuagcuuccucucaguuaauacaguuuacuucaucucucucuuagagggagaucacauccuuugaacuuaaaaagcugucaguuuauuuuucuccauuaaucuaucaauauuuacuuacaaaggcaauaacuaaaagcuacuuucuuuucauaucacuugugaaugcacacacacaaaagguauuuagauuaucaccugaauaaucacugacaaguaaguugccuaccuuauuugauauuuguuguaacuguuauauuucuguucugaaugcuuuaugucugauaacucauucaauucuuuauaugaauccuagagugcaagaauuauugugauucccauuugauagaugaagaaucugaaacagagaggcuaacaucuaauaauauaaugacuagaaucugaaccuguccacaucaucuggccucaauuucuaucuucaugacuuugcuaugcugcgucuuuauuguggaguuuuaaauaaaugugguuuagguaguauuccucuaacugguuauuacauguucaguuguuuuuucuacaagucaagcagagucuuaugcugcaucaccagaugaauagcaagcacuugcuggucagacuacaaauuuagaauauuucauuguauuuuggcacuguacuuuaaagagaaauguugacuaaagagcucacagaggaugguaaccauuauuauaaaaaaggucugggaauccugggauugauuggcauuucagggcacucuuuauuuuaaaaauuuggaaaaaugugacaaauguauuuuuaauauuugaggcguuaucauauaggagaggcuguagacagguuuuguguuacugcagugcgcaggaccugugguugaauucguggaggaauaauucaagcucaguauaacagagaacuuucuaacuugagucaucugauagaacaggccccuugugagguaauagcucuucccauuauuagaaaucuuuagucaucucauucccugugagcugaaaggggccuucaagaagagaguucucagagcagacucagcuuuaggugcugaaaugaauuucucaagguuagauggcuaauagcagggcacagcuaauauggaauucagggcucucagcucuugauguuuguugggaauaggcaaagaagaguggauuuagagacugcugggcacuaugcuagacacuuuacauauggaggcccauuauaccacacagcaagagcuaaaugaccaucuuucuagaaugcaguuggggaguucuuugcacagugugugcaugugagagggggugaggagagaugguggaaacugaaauuuccuugcagaugcaaagacugugucuucuuuaccacugaauccucaaggcuaacacagugccuggcacagagggaaagcuaauaaauauuuguugaauaaaugaagggauauauccuuguuggaugaaugaauuagugacauuuguaaacuguaguggguuuuuuuggacaaaaaguauuaggucauguuuuggcuuagagaacaguuuucuaaucccucccuaugauauugguuuauauauauuauacccauaaauucuugcacccucauugaaauauuuauguaaugacuugacuauuuuauaccauguuuacaaacaugauucuugccuuucauuaaucauugcaguggucccaccuuugcuuacauaauuuuuagaugacugauagcagcaaaccucauauuuuaacauuuauauuaguuaaaauauuuuauagcacucuaaaaugaugccauauuaaugcaauuuaagugguuguguuuuuugccuuuuaaaacugauuuaaguacaauuuagauggcuuuauacucugaaagcugauaauuuauguuaaguuuaaaauucauauuccuuuuucuaucuuagaaauuaggggcuuuuagaaaugaaauaucuuaucuuuguuucuguggguguuucauauuuaucuuuuuauuuagugauauagcaucuuuuccaagacuaacccagagaaauagcucuuaagguuauuauuggcuuccucacaccaaagucuuagggcguaagaaaccauugguccuuuuguagcuagacgaaaaucuuggggugaagauaagguguggaagaagaacagaaccggugucuccaccuucacuaguagccuuccagaaaucuuucaaaugggcuuucuaaaguaaggcaagacccagugagcauguccucgguucuucugccaacucuggagcucugggaaccuaggacuugcuugcaaaaccagaccaggggagucccaggacauagaucaguuucaucaaaggguccgaggugguuaauagacacuaucaauagguugggagagggcacuugucauccaaagagcugugucggacuuucagucagggugucaugaucauuugcugugccugguguuaccauguuccccuugcccuuacugaagauccaugacucggaaaacauagugcuccugcucaguaaccuucaaccugcugccucuaguacuuuuucuguccuagucuguugcacagcagcccacuccccaucuaucuguccacuuccaggacugcccuuagaauucauucauucauuuauuuaacaaauauuuaucgaagaguucauuauauauagcaggcauuugugcuagauuuuggauauacagugcuaaauaaaaaaaauuggccacugaguaccaaauuuuuaaaaaguuuuugcuugaauuuaaacaaauuuaaaggcuaugcugccugccuucagggauaggucccugucuuuaaaguauguggccuugugaauaggauuauuuggauaccaaaaacgaggaacucgccucccaacugggacuggaaacugugccaucauaggggcccagguuauaggaaggaggggacggaauuacaaucuucuuagaacuugaggcccagaccauucaggauuccauaaacaaacuucugugagacuaguucaucugcucuucuccacaaacaugccccccucccaguauuucugaggccaaacccuggccacuguguagaacuuuuuaucccugagucugaauauccauguuuuaugaagcugauuuccuagguggccuuuagccuuuggcaccuuguggauugccaguggcagacugcugucacaugaaaagcuuggccaguuauaaccuuguaucauggaggacugaccuucccagugugugugccauguuguagcucccagugcauggccacgugcugugcugccuccuggucuuggggcugguuauaaaucugcaguucacucauguguuccuauacgaggccuuuuacagacuccaaauagaugguccugagcugauacugucauugucaccaugauccuggagacacagccuguagcuguguggaaguaaacuucuaaaaccugucucuucugagaguuacugcaugaaaacaggcaaggaugggucaaguuuuggaccagcagcccaaguuccaccaaccacucuguuauacagaggcuucuaagcuaugcagagugcuaugaaggguuuauucuucuuuugcccaccugacugauauacugauguacuuuuugaagaagggcaauggaauuuaccuagacgucacuguggucuugauguggcugaaguguuuuguugaaggcucuuuaguccuguacucauuuagauugacucucacuucuggucccuuuuuguggugcagacuaaagccucaaacucuguaaaagacaauggcuugucucauguaaguauguggaauaggggccuaauacgggaaaauaagcuacuggcaguaaaaaaauuuuauauuuuuauuuauuuuuuauuuuuuuauuuuuauuuuuauuauacuuuaaguuuuaggguacaugugcacaacgugcagauuaguuacauauguauacaugugccauguuggugugcugaacccuccuaaugcuaucccuccccccucccaccaaccccacaacaggccccagugcgugauguuccccuuccuguguccauguguucucauucuucaauucccaccuaugagugagaacaugcaguguuugguuuuuugucccugagauaguuugcugagaaucaugguuuccagcuucauccaugucccuacaaaggacaugaacucaucauuuuuuauggcugcauaguauuccaugguguauaugugccacauuuucuuaauccagucuaucauuguugggcauuuggguugguuucaagucugcuauugugaauagugcugcagcaaacauacaugugcgugugucuguauagcagcaugauuuauaguccuuuggguauauacccaguaaugggauggcugggucaaauggcauuucuaguucuagauuccugaggaaucaccacacugacuuccacaacgguugaacuaguuuacagucccaccaacaguguaaaaguguuccuauaucuccacauccucuccagcaccuguuguuuccugccuuuuaaugaucuccauucuaacuggugugagaugguaucucauugugguuuugauuugcauuucucugauggccaguauugaugagcauuuuuucaugugucuuuuggcuguauaaaugucuucuuuugagaagugucuguucauauccuucaccuacuuuuugaugggguguuuguuuuuuucuuguaaguuuguuggaguucauuguagauucuggauacccuuugucagaugaguagauugcaaaaauuuucucccauucuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaaucguuuccccauuucuuguuuuagucagguuugucaaagaucgaaugguuguagauauguggcauuauuucugagggcucuauucuguuucauuggucuauaugucuguuuugguaccaguaccaugcuguuuugguuacuguagccuuguaguauaguuugaagucagguagcgugaugccuccagcuuuguucuuuuggcuugggauugacuuggcaaugcgggcucuuuuuugguuccauaugaacuuuaaagucguuuuuuccaauucugugaagaaagucauugguagcuugauggggauggcauugaaucuauaaauuaccuugggcaguauggccauuuucaugauauugauucuuccuacccaugagcauggaauguucuuccauuuguuuguauccucuuuuauuucauugagcagugguuuguaguucuccuugaagagguccuucaugucccuuguaaguuggauuccuagguauuuuauucuuuuugaagcaauugugaaugggaguucacucaugauuuggcucucuguuugucuguuauugguguauaagaaugcuugugauuuuugcacauugauuuuguauccugagacuuugcugaaguugccuaucaccuuaaggagauuuugggcugagacgaugggguuuucuagauaugcaaucaugucaucuacaaaaagggacaauuugacuuccuguuuuccuaacugaauaccguuuauuuccuucuccugccuaauugcccuggccagaacuuccaacacuguguugaauaggaguggugagagagggcaucccugucuugugccaguuuucaaagggaaugcuuccaguuuuugcccauucaguaugauauuggcuguggguuugucauaaauagcucuuauuacuuugagauacaucccaucaauaccuaauuuuuuugagaguuuuuagcaugaaggguuguugaauuuugucaaaggccuuuucugcaucuguugagauaaucauaugguuuuuguugucgguucuguuuauaugcuggauuauguuuauugauuugcguauguugaaccagccuugcaucccagggaugaagcccacuugaucaugguggauaagcuuuuugaugugcugcuggauucgguuugccaguauuuuauuggggauuuuugcauugauguucaucagggauauuggucuaaaauucucuuuuuuuugucgugucucugccaggcuuuaguaucaggaugaugcugcccucauaaaaugaguuagggaggauuccuucuuuuucuauugauuggaaugguuucagaaggaauaguaccagcuccuccuuguaccucugguagaauucagcugugaauccgucugguccuggacuuuuuuugguugguaagcuauuaauuauugccucaauuucagagccuguuauuggucuauucagagauucaacuucuuccugguuucgucuugggaggguguaugugucgaggaauuuauccauuucuucuagauuuucuaguuuauuugcguagagguguuuauaguauucucugaugguaguuuguauuucugugggaucaguggugauauccccuuuaucauuuuuuauuguaucuauuugauucuucucucuuuuuuucuuuauuagucuugcuaguggucuaucaauuuuguugaucuuuuaaaaaaaccagcuucuggauucauugauuuuuugaaggguuuuuugugucucuauuuccuuuaguucugcucugaucuuaguuauuucuaacaucacaauuaaaagaacuagagaagcaagagcaaacacauucaaaagcuagcagaaggcaagaaauaacuaaaaaaaauuauuuuaauucccacuauaaauaucuggauauuagcaaaagagagucugauacacaguaaccaucucauugaaacagcagagcucugaagaguuuuaauaucuugacaguucuauccuggcuagcaugauggaguucuguuugcugaaauuuuuuauguuccauaaccuccuugaaagccagaaucuuugguguuaacuacaguuucuuaacuauaccuguuaagaaauaagguauaguagggaggcauggugcucaaacucucuggaaaaucccagagauguuugcaacccuaugccucgugaacaacccaagccuggugaaguccugaaucacccuaagaggcccccagugaugugcacgaaaaucuuagggugaagguaagggguucagugggccagacccgguggcucacgccuguaauccuagcauguugggaggccgagguggguggaucaccugaggccuggaguuagagaccagccuggccaacauggugaaaccccuucucuacuaaaaauacaaaaaugggcagggcaugguggcgcgugccuguaauuccagcuacucaggaggcagagacaggagaauugcuugaacccuggaggcagagauugagcugagaucgugccacugcacucuugcuugggugguagagugagacugugucucaaaaaaaaaaaaaagaaagaaagaaaagaaagggguuccauguccaucacacguggucuuauugacaacuccagaauugggcuuuacauccuguaugaaaugcuuuaaaaauaugaacacauuguuauaccucacagauuuugguuccauuagacaguaaaaucacaguaaccaaguaaaagcccacccuuuuaaauaggauuuagucuagccuggccauuccuagugaauccuuauuaccuucaagugagaagaaagcucaccuagaacaguguugcagcuagcagugauuaaagugcuugugccauggcauugauucuugcggucacuagguugauugucuuuaauggaugagagaggauuagcaauuuugauuccccuuugcauuuuauucuuacguaaggauuuaauuuccaacaagaaaaucaugaaauuaguuucuggcaaaaagagauuuucuauuuacugguuucugccuuacacauuuuuguggucucuggauccaguuuaagcuucgcugagcccaaaucucaauuuaugaaggcaaaaguagguuuguacuuaagagagacaaaugacaaucuagucagcaacagauaagggaagucagaagcaagaucuuccuguugacaacagauagguugaguguuaucuaguuggagauuuuauuuuuuaguuguuuauuuugucgguugccacagguugagacuugcugguagcacaucuaaggucuuugggacaauccuggaacucaggguugagguggaggguuggccagcugucaggaugcucucggaaccuucugguaagcugcucccacugagauggaacucaaggcagaaguuagucuuuguaucuuggaaauaaacagauuaguaguaagaaacuauuaaagagagcugacaucuuagaagguguggcuacacaacagcccuggcccuugacaucaggacuugguaaggccaagacaucagcgaugucuuccacugauccaaacaccaggcaaugccuagugauguaguuuuuuggaaucaguugguaggguuucuuguugguaggggaugcuuugacauacuucauuaaugcuuuguaauaaucuagcauaacacuauuuaguaugaaaugucugacaguaguuagcuacugggggaguaacuagcagccacauaggccuaauauuucaaguggcaagagucacagcauucuguguuauagaucucauguuuguaagagcaguaggcugaguguuuggccuuuguggucugguuucugcacaaauuuuggucauuuuauuuuucaaaauuccgccaguaaagggugcuaauaauaacuaauuuuucccaauuacucaacaauauuauuagagcugccccauuuguuagaaccauaaugugagaaaagcugucaguacaaagcaguuaauccuuuucccuuuggagccuuuguaagaguucagauucuggggaggcuuuuuuuuuuuuuuuuuuguacagguaaaguauucauaugaauguacuuuagauugcauggaccuuuuuaggaaaauguaggaucuuguccaccagcaaggacagacgugacuauccucaaaaugacuguagauaaacuucuaaaaggcguuuaccugaaguuuaacacaauaucaggacacacacuuuauaggacagaguguaaagaaagguuuucaagucuuuagauucaucagugccuucacuacuaucauuaucuggaaucagcaggcguacugaagugugccauuuauguguacaaagacauguauacaaggauaugauugcacauuguaauagcaaaagauuggaaacaacccaaaugcacaaguuagagacccguuggaguagauugugaaauauaucaugcaauggaauguuaugcagccauuaaaaagaugaaugaguucugucuguaacaauacauaccaaacuucaaguuuuauucaguaggaaaagccagaugggaaacagugugaauuguaagauguuacucuguguguguuugugugugugcacacaugcaugcauuuaaaccucaacagagcauauaguuguuguauauggauagaauaucccuggagagaaauacaagaagauaaauaguugccuucaguaaaggaagucaguagcugggggcaggcuuaggagggauaugugcuuuucauucuaaauacauuuugaauuuuguaucauaaauguuuauugccuauucagaauuuuaaaaaaugcuacaugggacccaccuucuggaaugcauuugauaggagugauggauucagcaggaagaccaccuuagacacugucaggauguucagggaaaccaggauaaggacauagauuagcuugucugcacugggaaggaaggaagggcuagaugagagacuuugugcacaaggacuggagagcuguguggccgaagggaggggagaaggagaggaggaagugaauguggaguuacugauuuggggaggauugguauauaaaugaugccuuuaauuaagaguugaaaaugggaauaaaagcagguugguaguggggguugugaaaagaagacuucagguccagacauggugaauuugaagugaugugagauacccuggugaugucuugcagucaauucagagaacagcuuuaaacacuauuaaaauggcuuaaaguacuuuuuugcuaucauuuucauaguucuuuugaaguuuuuagcauacucaaauaucuuuuccauuccuuaaguaugauuaugguguaauggaaaauuuagguuuuaaaaauauuuuaguuuuguggugaccaauacaaaacaagauaauuauuuuguuuugaaauuucccauuacauaugugucuuguacaaagccauuuaccguuauaaacuaaaagagcuugugccaagggaaugagacuaauggauuguuccaaucucugguacagucggaaaauauuaaaugaaugguaaaacauuuaauguguccauuaacuaauacugcuaauuuacagugggagugugugugaaagccuacauaaauaauuucugaagucacugugaucccuguaauuacaauuaauacugaaaaaacuucucaauuucccaugugcguuguaauaguuccaaaacaaugcccuguguuaauauauaucuuguaaauauuuuguucucggaaggugccuggcuuacauagacuugccuaugugagugaaugaagucauuauuacuauuauuauuacuagccagcacuuucacauuuccuuucuugcucaccauuuaaaaaugcauaguaagguauaaggcugagaugcaacugugcagcagcccucaauauuguucuuaaggggagaaaaagugagcagcacgugcagucuuuucugccuguccuuucaggauaaugucaguaaauucuuugccaauccuucauucucucguagauggcuagggaggaaggcagauauaguuucaaaucuuaccuacacaucgugaccuuggacaaguugcaaaccuuucuaagccuuaggguccucccagcaaaggacugcuugccacucuuugaauuauguggaugaaaugagaugauauaccuggccuguuauaauuacuccauaaaugguaaaucuuaguauuuuggacuugugaaaugauuucaacuccaaacaugaauaauggagucaucuaaacccucccucacggucacuccucacaaugaguuagcaagucccaugaauucuaccuccuaaaaaucuauggaauccuuuuuuaucucugucagcugcugaaaucuucauggagugcuccuaugcacagcagccucacugcaccccuaacucaugcccugccaugccuuuccugccauuuaauaagagucucccaccacggcuuuccacuaccaaguggaccaucuacacugcugcccugccaguuaucuuccuaaaaugaguaucugguuugugucucuuccuggcuuaaaccccuuuaguaaccgugcucugucacuuuuaggaucaaaucuguacucuuuggugugguuaaaagguuccucauaauugccccucugcuuuuauuuuccauuugcagcccaugguugucacaucacgcuguuuauaaugcccagccccugccugaucucucuucuucaaugugcucaugugucccuuggcuuacaguauccaugccuucuccuucucccuccuuguggcuucuuccccgccgacauacacaggaaaccuuacuuggccuucccacccacaaccccgcccgccccuucuuuuuuuuuuuuuuuuuuuuugagacaagucucacucuuggcugggcuggaaugcaguggcgugaucauagcucacuguagccucaaucuccugggcucaggugauccuccugcuccggcuuucccaggcauaugccaccaugcuaggcuaauuuuugaguuuuuguagagauggggccuugugauauugcccaggcuggucucaaacuucuggccucaaguagucuucccacguuggccuccuaaauugaugggauuacagacaugaggcaucgcuccugaccucuuccucccuucuuauuugaguaucuucuuccccgacaaagcauucucagauccucuagucuugguuaguuuccccuucacuguguucucauugcaccccagauguugaaagcauaaauacaguucagaucacgaagggucuuguaagccaugccaagugguuuagaagaugacaggaaccuacuccacugaaauuaguuucacuuaucuguguuuccccauuggacugugagcucucugagugaaaggacuggguauuucauuucuguuuccuggaggcugcaacauuguuuggcagaaaauaggaauacuuuguauuuucuaaugaaugaacggauggauucaaauggagaguguaaguuuuaaacuaucacaauaggugaccuucugcacuuugcucacaaccuuauagcuuaucuaacccuucaccuuugcccaucacugaaaacauuaacauacucuguuguuggauugucuuuuagaauaaagucacaaaacagacaugaagugggugcagcaaaucaaauguuaauauguaaguggagaaaagugcuauaaagauaagaauagcaugucgugauggagaauaaaaggggagaccuuagauaaacuuauaagggaaaaccagaaaacucuuauuuuucaaacacuuguuuauugaacucacaaggagcucacaaacuuggagacacuaggcaaacuacauagaauuaugcugcagauuuguguggcuugcgugucaguuuugaguucuuuuauuuaccuuguaaaauaugcuugcuuuauauuggcaguguaguauuaauugacuuuagucuguucuuagaguacuaaguacuuuuuagauuuuuaaaaccaauuuuaguaauaagacauagcuauguauuauauagugaaaugaaauuaugcuuaauuauuuuaaaaauuaugauaggaaaaauaauuuuguuauugguaaucugaaacuuucuuuccauaucuuaaccuuuuuauuucuguugaacaguuguuuuuuaugaccuuugaaaucuuagaguuccauauaacaaaauauggcaaaauggauugugcccuagacaggguuccauggacuacguggaggagccugagaaauaggcacuauuugucuaguauaacaggagaaagagguugugauuuaaagcugaaagaccugacuacaucuucugccugcgugacuuaccaaguuugcaauuuuaaaaaaguuacauuucuuuuuaccucuuauauacaccaguuacauggaagauuaaaugagauggugaauaugaucauauugauagcaaagcacuuugaaaauguaagaugcugcggaaguaauccuucuguuuauuuaucaaaaucagagccccauuaaguguccuguguuuaaugagcuuaauuauuaguucuuuugguuguuuguaaccauagauauuaauugauauuauugaaauuacgaauauaagagaauagauuucagguauuauugauuuaccaguuuauuacaauaucaaaauuuguaauuauuuuuuuuaugggugugguaggcugaauaauggacccccaaagauguucacauccuaaucccuggaacuuacagaaugaguggcacguuaccuggcaaaagaaacuuuguaauugugaucaugugaucuucauaugagaugauccuggauuaucuaggugggcccagugcaauaagagggaagcaagaggaaucagagagucagagaaggugugacuaugaaggcaagagguuggagagaugcaaggaaggggcugcaagcggaggaagguaggcagacccuggaagcugagaagggcaaagacauggauucuccucuagagucgagagucucuggaaggaauggagcccucccaacaucuuuauuuuauuuuauucauuuuuaaaaauagauuuagaggguacaggagcagcuuuauuacauggauauauugcauaguggugaagucuggauuuuuaguguaaccaucaccugaauagugcacauugugcaaauuaaguaauuuaucaucagucaccucccuuccacccuuuagagucuccaguguccauuauuccacacuauguccauguguacacauuauuuaacucccacguauaagugagaacaugugguacuucugcuucugaguuauuucgcugaagauuaauggcuucuaguuccauccauuauucugcagaagacaugauuuuauucuuuuuugugacugaguaguauuccaugguguguguguguguguguguguguguguauacacauguauauauauacacguguauauauauauauacacguguauauauguaguuucacuuauauguauacacacacacacacacacacacacacacacacacaccccauggaaaacuacucagucauaaaaaagaauaaaauauauauauaucacauuuucuuuaugcaaucaucuguugauggauacuggauacuuagguugauuccauaucuuugcuauuguuaauaguguuguaauaaacauauaagugcagguaucuuuuuaauauaaugauuucuuuuccuguagguagauacccaguggugagauugcugugucaaaugguaguacaauuuuuaguucuuugagaaaucucuauacuguuuuccauagauguuguacuaauuuacauucacaccaacaguguacaagcauucccuuugcuccacauucuugcuaauaccuguuguuuuuugacuuuuuaaugacugcucuaagauggugucucauugugguuuuaguuugcauuucucaugaugagugauguugagcauuuuuuuuguauguuucuuggccguuuguaugucuuuugaaaaaugucuguuccuguccuuugcccacuuuuuaaugaggcuauuuguuguugucauuuuguucaacaucuugauuuuaaacuucugaaaucuacaacuuuaagagaguacauuuguguuguuuuaagccacuaaaauugugauaauuuguuacaauggcaauaggaaacuaguacaauguggauugacuaaacauuaauaacuauaauuuguuugaauucuaagaaauuaaauucuagcuuuguccaauagucuucaaaagaaaugguggugaaauugaauucuagcuuugaccaauagucuucaaaagaaauggggguuuauuauugaacauaugauuauauauguguauauauauauauacauacacacacauauauauacauacacauguauacacacacauacacacacaaacauauauauauuauauauauauauaaaucacauaauaagauaccccaacaaguaacacaugaagccuuucuuggugauuccucaaggccaaguccuuugucaugucauuuucccauggaaggcagggcagaagggcacagcugcacagggaccucuuuauucuugaugguuucacuaucaccuucuauuuuugaugcucuggugaaccagagacuucugugaaguaacaguuagaaccaugauucugaaauacaggcuuaaagacauuaagaggggacaguucccuggacuccuccgcgggaccugugacaggggugggagggguggcuuguuucgcugggccgaguucaaacccauugugggagggggagcacaugggccagcagguccuggggcaggugugagugcuuuugggcuccagccccacgguagcaucuggggguguguuacaauuaaugcucuuuuagcaguugcuguccguggacaaaucuaaucaguagauuucuuaaucacaaggccuauaaaucaaaauaauuuuccaguuuuuuuugccucuggaaaacguaacuguauuaaguguguuaugaucuuuccuugcucauuacuguucacuuuaaaacaaguuuuuauugaaaaggagaaauugcaaauguauacauuuuacuuuaguaguauauaaguacacaugguuuauuuugcugaaaucauuuagaauugaggcauuuguguaauuccaaauacacaaagaaaaauuagaagcuauucuuuauccuucuuucuccccuuuuucuugaauucacaaugacuuuacaagacauuuaauguaaaggcacuaaagacaguuaaaaccauuagucaucaugcuuuacuuagaauucagcaaagaacaaaguuaaagaacaaaauagcaagccugguuuauuugucugaauaaugcuugucucaugauacuuuaucucauauaagggaaggagaggaaauccuuaguuacaucauauaagguagcaaaaaauaaauacaauaaaugcuagagacaauauuuauucagaaaacaucagugaguccagugaaacuuggagacucugaaaugcugugccagucauuagagccaggaguguauuaugauuuaaugguaccucucugcugcaucucaugagcuguccuagaaaaacauuuugaagcaauaaagcauccauuuggcuccuaaguaaugagaggcauuguucuuugcauuaacuauuuauucaggaagagaagugaccaacuguuaauaagcuuuauccaaagagggucguggaaaacaagaaaaugcaaaagugagguucucuucaauuucauaugcaauuaacaaauauccagagcugacugauuggugcuccucuuccaugugacuuuuggcuggcuguauuuaagggugagugccuguuagauguauucaaagcuucuggguuuaaggaaggauucuguagccuaaacccaugacaaaugagaggcggcaaugacucgugaguagcuaagacuggauugaucucuguuguuuugaauauuggacuuauuuucuaagaugaauaguaaugauuuaggcuuacuaguuuauuccuuuugggaaggauucuuuuuguuuguuuguuuuagaagauuauugcuuuuucauuacuugugaaaucugcucuauaauccaauguaauguuuagacuuaucacuugaucaagaagcuuuuaacuugagaaaaauucuuauuugguauauaaauagguaugugcuuuauucuuuggaaauaguuuccagguaggaaugcaacauuuuucucuuguucugcaaguaaauaaaugaucucuucuugacaguaaauguguaggauuuaguaacuuugagauuccaaccagaauauuguauucacaaauaaauaggggcuucuuucaagucauuucagaaccuuacuuugaagcacuuugauccuaugagagugugaaguuuucauuccacuugcuuuaagguccuuaauauaauuaaguugccuuuuuaauaacaugagaaaagauaaaagucgcaauucuuuccuucccuaaagccaacaaaaggauguuuaugguaauucuuugucccugcucucgcuaaauacuaguacaguggaguucuacacagugggggaagaaucuucauaaaucauuaaaauagacaguggaagugauauguaaacucaauauuauuuaaauauuaacagaauauucuugauaccauaauaaaucaauuagguggccgggcgcaguggcucacggcuguaaucccagcacuuugggaggccgaggggggcggaucacgaggucaagagauccagaccauccuggccaacauggugaaacccugccucuacuaaaaaaaaaaaaauuaagaaaucauuuaauauugcauuccuuugauuuuuaauuuaaaaauauuuuccauauugaaaacuauguauuccugcuaagcuuacuaugaauuauuuugaaguauauuuaaaaucaguuuguaagauguauuucguggaauaagaaugcauuguguauuuggguccauagccuuagaaaaaagggcuaaagagcccaagucaguagcaaaaggaucaaagguagaaaaacuccuuaggcuuuuucuuuccuagaccacauuauuuuaucauacagauuacaaaaacguaagaaauaaagacucaaguuagaaauggaauuaccucagaagauguuagguuuugcaacaaucuuucucuuuggguauuaacaaucauuagauugaauuaucccuuucagaucaucacuccauucagaaggcuaaugcugugugcugagaacagaaaggagauggaggauuggaucagcucacugaagucuguacagaccagagaacccuacgagguaaaauagcaucuuuucuuucaucucguguucuuaggaaauaaauguuaaccaaagggcuagagcucuaccgugcaaacauaaguauguguacacucauucagcaacuuguuuaaaccagauuuugaaauucuuaucuuaaagcaaagugcuuugguuuuaaaaaugauggauuugaaaauuugaccauaacuauaugcauuccaaacaguucagcaucuguagccuuguucacuggcuuggcaaaucuguccucacaucucauuucuagguggcccaguuuaauguggaacauuucucagggaugcacaacugguacgccugcucccacgcccgacccaccuucuguaacgugugcagagagagucuuucuggagucaccucccauggccuguccugcgaagguacuguagcaccuagcauguguuuucucccaacaguaaccauacuguagacaugcugccacugguuuuauuguagcuuaaaauugagcucuccacacauaggacuagcuuggaaaauauuuuugcucaggaaaaaaaaacauagucauuuaaaggaaacauacaucaaaauacagcauuucacccccaagaaacuaggaacuacugucuaaaaaaaaaaaucuuuggacuuuguauaaucauucugguauucuuuauucugguugauuauggagagcaaaacuuuuugugaggacaguauauacucuuuggcagaauuucugauuguuaauuauauugcauuguuuuaaauauuguuuucuuucauuucauuuguuuaaucugaauagguaucauccuuuuuaauuuccuuaaaauuuucuaaaaauaaggccuaugcuguuguuacuuuguuuuguuucgagaaggggucucacucugucacccauccuggaaugcaguggcaugaucaagucucccugcagccucagccuccugggcucaaacgauccuccuaccucagucucccuaguagcugggacuacagucaagcaccaccacaccuggcuaaucuuuuuuuuuuaaguuuuuuaagucucacuauguugcccaggcuggucucaaacuccugggcucaagcaauccucccacauuggccucccaaagaggcaugagcaaauuugugaguuauuuuuaauauaagagcagugaccaccaaaagcaaauacauuaauaauugccaacagaaaacucauaacuucuuuagauuuauuuuauuucauacuucagugauuacacuguuguauacuacuuuuugaacuauauaugauaauaauaauaccagcuuuuuuucucuaauccaaaaauuucguaauuuggaauaucacuuauuuauaauuaaguaauaaaguaguaauagaaucacagccuuaauugauuuuaaacuauaaaaucugugauaugucauuguuucaacuauuuaauaugauacaccauagugguuaagaauagagcucuucagucaaacccucuuccacuuccaccauuacaaacuauaaccaggagaaguuguuuaacucacuuaggcuuuccucuccucaucgauaagauggggauaauagucauuuaugccucauagaaucacuauaaaaauuaaaugagggaauacauacaauaaaacuacuuuucuaguucaauaaauuggaagaaguuuguaacuguuuuguaagaaacuuauuccaaauuugcaucaugggcuugaugcauuaaaauucaugaaggagaaaauuuggagaaggcauuaaagcuuucuuuuuagacuuaaagaaugauugcaaaagagaucugauuggccuguauuaugacuuuaguaaucuaaaaggauucacauagagcugaauaacuccuaccaggucuguaauaugguauuauuuuaaagauuuuacuaaaaucuuuauuccaaaaaugcugaaaagacaccacaucugagacacucugugguacccuucugauuugaguguuauacauuauuaaauauuuuuauuuaaaaauugagucaguaguggaaugacugaguauuuuucuaagcauuuuaaaagaaaaaugaaaauuacauuauuuggugagaauaagaaacuuaaaagucuuuaaauaaauuuguuauauucggccgggcacgguggcucacgccuguaaucccagcacuucgggaggccaaggcaggcggaucaccugagguugggaguuguaagccaccacgcccagccucaagugaaguauuauuuucuauaugaagucuguguucuaguuacacacucauuuauaacaaaaaugguggaagggaaagaauuuuucaaaguacacaaaagagaagguaagcaaaacauuuucaguguguauacauuauuaucauuauuauuauuguuauuauuuuuugagacagaguguugcugugucucccaggcuggagugcaguggcaugaucuuggcucauugcaaccucugccuuccugggcucaagcaauucuuaugucucauaagaaucccgaguagcugggauuacaggcaugcgccaucacacccggcuaauuuuuuuauuuuuaguagagacaagguuucaccuuugugaccaggcuggucucaaacuccugaccucaggugauccaccaccucagcgucccagagugcugggauuacaggcgugagccacugugccuggccuagacgaauauuuuucaaggauaaaccagcucaguuuaaccauccauuuguacauagacuagucaugauaccugaagcacuuugaacauuuggcuaaagacaucuuaguuauuuuaccugaaacuuuuguuuucguguuauauccaauuaagacaguuucaagagaaugguguguaaugcaaaauuuguuaaugauugacuuagaaauccagaaaaaucacaugaaaaggagauaccuuucauuuaaauuuagcaacacuuaccuuaguauguuuccacugaaaugcucucuacuuuuaacuguuuagcuaaaagucaggagcugaccuaauaucaguauccccucauacuugaauaauuuccuuagagagauaaacauguuuaauaauagucaaguuccaauuuuuguaaguauggucaauuuuucaaauaaccuauaguucauuuguuuuuccauauaugugcugcuuuuuuucccuaguuauuuccuccaauuucucuuuuauaaguuccuuuugauaauauggcuggggagauuuagugaagccuguagugacaacaucacuucaucaucccuucuuucuacauuugucauuuggucaucucaacauaauacuuuccaaagauagggccguguuggucacccucaccaaccuauuuuccaugaugccuggcugucuuguugguauacuugcacuuuacagcccccuggaucaacuuuaucguacugacauuuucagacuuauaaucaguauuuuauauguauagaaaaauacaauaccagaaauguacagcuugaugaauuuucacaaauuaaacacauucguauaaucagcaccuacauuuaaaaugggaugucaccagcagaccugcuaccaaauuuuauuugcuucccucucucccucucuccuauguguguguugucugccuucucaagcaguaauucuuuugcauuuauuucuuuucuguuccucuaaguagcagucuacuuauagcuuuauaaaagugcuucauaaauacauagccguauuuguuuucuagaauaccauuacuauuguugcagaauaauuuaaucuuuuaaauauauuuguuuucuucuacuuccuccuucccuuuuaaaauuuuaugcugugauuuccuuuaaucauugguccaaaauuucuuguccacuuaaaagcaguugcucuuuuuuuuuuuuuuuuuuuaguguguaaauucaaggcucacaaaagaugugcagugagagcaacaaauaacuguaaauggacuacccuggccuccaucgggaaggacauuauagaagaugaagauggcguaagcugcugcucugucucugcucucuucccacuaacuccucuuuuauguucugcucuuguggaagcugagaaagauaaguaggaaugcuuauuauuaggauuuaauagaagguuugguugauucugaguuuuuauuuuuaauucaauccuucauagcuucuuuagcucuuagauuuugaaggaaaucuguugugaauagggcuuagaaguggccguugugcugggcuguuguugucgaccucugaugaacucugagauguucuuuaaggcuuagcugagagguucacucuucagacauugggguugccucucaacaguauaccuccacuuucaaaaccucaccuccacugcaccaugcauauggauuucugggaacgcuuagugaucacuuuauuguaaucccuuuacaugccucagcuaaaucuaccugaacccugaagggaaaagcuuuuaccuuacuuuuauauuccuugaacguucauaauagaugcucaauaaacgugggguaaaugagugaaugcuaugcaugaaacguacuacugacccucuagagugagaaaugauucaaaaucuccccugggguaagguugguguccgccagucuucaccuggcugcccuuucuuccuucuccacaggucgcgaugccucaccaguggcuugagggcaaccugccuguaagugccaagugugcugucugcgacaaaacauguggcaguguucuccgucuacaggauuggaaaugccuuugguguaagacaauggugaggguuuuggaaucaguucauccuuuuuaauuagcuucuuucccuaacuuugucauccacgugguuuagaggcaaagcaaagaauuuaugacagagcugaaccugguagcauacgcaucucaugaugacauucuucuuuccuuacaguauaguccuccuagucuggucauuguuucaaaugcccuguaaaacuuauucuuguucauccguguccugugccucaggaucucuuacccauaguuguauuguuuuuucauuuugcuuuaucaacaaagugauuugcuguauucaggccuauuuuacuaccugaaagcccuucucugguaugucaccaaauuuugguugacaugugacauguaaauuugcuacaacccuaccagugcucucugacagaggugaacagcacaugcagccgaacaugaagccaacagcugauuauuuaugccagauauggugaggacagggccucuggacugugugaagacagucagaguaggaaggagaucauguagacaguggcaugggacugaaaaacugcaggaugaggaggucgugggugugagcguucaucucagcacugggcgaugcugcucuacaaugauagugauugccuugcacuggggcugacuuauuuggugguuuugagucuugucuuuuaacauugcuggcugaaauuuggaagccagccucaaauuuuaaaauauggaaaaacuauuguuuuugguauguaugguguagaucagcaaauguaagagaugugugauguauugcuuuccuaaucaaugagauugucugauaggcuacaaaggaaaauaaguccuacaacuuuuuaguuaggccugauagguaaaucuguguuucuuuucuuuguccucaugcuuuuguuauucuucauugauugccucuuuuacuagccuuagauauguuacuaauacuuuuucucuuaucucauuuaaucuaauauauagacuguaacaggugucucucuuuacaaucuuagugcaagccuagccccuaaaaccuugucaugccauuuuuuuauuuuaaaggaauucuacccauaaacaagauuuuaaaucaucauuccaccucagauuucuuuuugagaggacaaccacugauaacaaauuuuccugcuauuuuuauuggccuguacauuuacuaaagucgauuucucuacuucuagagcuucaacuguucacuuccaauguauuagaaagaaaacacggccgggcgcgguggcucacaccuguaaucccagcacuuugggaggccaaggugggcggaucauggggucaggagaucaagaccauccuggcuaacacagugaaaccccaucucuacuaaaaauacaaaaauuagcugggcgugguggugggcgccuguaaucccagcacuuugggaggccaaggugggcggaucauggggucaggagaucaagaccauccuggcuaacacagugaaaccccaucucuacuaaaaauacaaaaauuagcugggcgugguggugggcgccuguaaucccagcuacucgggaggcugaggcaggagaauugcuugaacccaggaggcggagguugcagugagcugagaucgugccacugcacuccagccugggugacagagcaagacucugccucucaaaaaaaaaaaaagaaaagaaaagaaaaagaaaacacauaaugugugaugaauuauuuuagaaagguuuuauguaaauuuuuuucccugcaauuuguauaucuuuacuuuaaaaaaaaaucaguaguuuuuaaacucuguuaacuuuaacagcaggaguuaauuagguuuauuacuugcucauucuauucaccccuaacuuuuaaacauuucuuaacuagaauagcagugguauuacagaugguagaagggaggaugccuuuucucucguuuuucguggcaaacucaaauuucaccuugugacaucauuccugccccacccuauguaaguuggacuugcugguuucugagcuaccaucaccuuauagcaccucucuuagucuugcacuuccuauacacaaccauuugccuguuuacauauuauuuugccuuuaaaacaugaguuucuggccuggugcaguggcucaugccuguaaucccagcaccuugggaggccaaggcaugugaaucaccugaggucaggaguucgagaccagcuugaccaacaugguggaaccccaucuguacuaaaaauacaaaaaaauuagcugggcacgguagugcauaccuguaaucccagcuacuugggaugcugaggcaggagaaucgcuugaaccugggaguuggagguugcagugagcugagauugcaccauuccacuccagccugggcaacaagagcaaaacaucaucucaaaaaauaaaaaauaaaaaaacaugaacaccuguaauuccagcacuuugggaggccaaggcggguggaucaucugaggucagaaguucaagaccagccuggcuaacauggugaaaccccguuuuuacuaaaaauacaaaaauuagccaggagcaguggcagguaccuguaaucccagccacuugggaggcugaggcaguagaguugcuugaacccuggagguggagguugcagugagcugagauugcgccauugcacuccagcuugggcaacaagagugaaacuccaugucaaaacacaaacaaaaacaugaguuucuuuuuuuuuuuuuuauuuugcguaugucuuuuuuuuuaauuauuauuauacuuuuaguuuuaggguacaugugcacaaugugcagguuaguuacauagguauacaugugccaugcuagugugcugcacccauuaacucaucauuuagcauuagguauaucuccuaaugcuaucccuccccccucccccaaccccacaacaguccccagagugugauguuccccuuccuguguccacguguucucauuguucaauucccaucuaugagugagaacaugcgguguuugguuuuuuguccuugcuauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuuuugugaauagugccgcaauaaacauacgugugcaugugucuuuauagcagcaugauuuauagucuuuggguauauacccaguaaugggauggcugggucaaaugguauuucuaguucuagaucccugaggaaucgccacacugacuuccacaaugguugaaccagguuacagucccaccaacaguguaaaaguguuccuauuucuccacauccucuccagcaccuguuguuuccugacuuuuuaaugauugccauucuaacgggugugagaugguaucucauugugguuuugaucugcauuucucugauggccagugauagugagcauuuuuucaugugucuuuuggcugcauaaaugucuucuuuugagaagugucuguucauauccuuugcccacuuuuugaugggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccacugcuuuugguguuucagacaugaaguccuugcccaugccuauguccugaaugguaaugccuagguuuucuucuaggguuuuuaugguuuuaggucuaaaguuuaagucuuuaauccaucuugaauugauuuuuguauaagguguaaggaagggauccaguuucagcuuuaugaguuucuaacagcaggauaucuagugccuaaaacauaaucuauguagugaaaaaagaaaacaaacaaaauaaaaaagcccauagcccuauaaaccuaaugaaucaacuuauaauuuuuccuacugucauccaggucuguggacauaguuuuaccuuuucuguaaaaauugugaagauauaauuugaucaucugcuuuucuuauuuagcauuauuauaaauaccuuucuguuuugcuccaugguucuuauacauuuuaaaauuacuuuuaaagcuaucugugugugcuaguuuuucuaaaaugcauuuggauuguuaauuauuguaaagcauaauagaaaacugucuaaaaacaggucuucaccagaauuagaauuauuauugaauuuuaguuauucucccaaagguuuugauaaauacagguuuaauuaugccaguuuucuaaaaggacuaauaaaauaaagucauauuaaauaagaacuugaugaaaagugucugcuuuuacugguuaaaacauuuagaaggcucuccagacaaguacacaaacuaaauugccuggguccuacuuaauaaguuauccuuguuuuuguucucaguaguaccuugcaugaccaugaaacucauuucuacugaaagcacauuuacugggugccugugauacgcaucacuuuccuuuaccuuacagggcagcaguccagcugagaaaauaagcauggggguacuuguaacuuuaauaauagggaaaugucauaaaagaaaugugaauagaaaguuaugggauuacugcagaaaaagcaggcacuuuauagauuuuaucuuuguuaaauuuuauaagaauuuuuauaagaacaaaauaaauguucugucaucaauuuauuuuaugggcaaugauauugacacacugguuaguuuccguccuucuucuuccuuuuccccuucuuuuucucuucucugccucccuuccucugcacuuggucucuucucuuucucucucuucgccuucaacaguuauucauuaacuauauauuccucucugagauaauuacaaaaauugguugcauggacuaaaaucaaauuuccauuucuaaaauguuuagucauuuccugaaguauaaauguuauaccauuuaaaguaguuuaugaauuacugaacauuuugugguacaguugauucuagauuaucaguuccuuagaugugauuuauaauggcagaacauuauuuuuaugauucuugaagguauauuuguuugucauuagguacacacugccugcaaagauuuauaccauccaauauguccacuuggucaauguaaaguaucuaucauaccuccaauugcacuaaacagcaccgauuccgaugguauguagcaguaguguaaguacguauauuucugguauauuuaacauugauauguauauuucuuuuccuagaauaauaacuaugaugguaauugacuauuguagucaguuuuucuaaaauaauuccauuuaaauugcugaaaguacauuccauuuuuaaaagaauauauuuaagugaaaguuguagaauagcuguuaacauuggcgaaauuacuguauauaagacuucuagauuuuauguuuuaguaaauaaaacaagaucauuacucuguacggcaauacaaucugaaaagguuaauuuuuauaaguguuuuuuuccucuauaauugaaacugccuauuagcauggcuguuauuaaaaucuguuuuucuguaauuucauuguaggaauuuauauuccuauaaaugcacuuuucccaaaaucuuacaacuuaacucuaaagugcugaggaaccccucuacaacaccgguuuugggauugcauacuaauuacuuccuucuaagcaaaccguauugcaaaggcuuuuuaccauguauaaugcuaugcuguuuuauguaacagacuugagcaacuguggauuuugauauucauaggguuccugcagccaauucccccaaaauauacagggaggacuguacuauuauuaaugucuugcauugauaucaugccuuaugcuuuucaaacuuuuuaauuuaugccaauagauaucuuagauauaaguuuauaaaccugaagauguaaguuuauaaaccucaaaauaugugacuuuuuuaaaaaccugugcuauuaacagcccucucccccaaccuaagcccugauuuuguuuacuauaaauuuuaaaauauucucucagacuucagaaaagagcaguuaaaauacuuugaaauauugaauaugaacauaagaauuacauacaaacauauagguuuguauguaaauaguuaaccuaucucuauuuggagagcuaaauuauaacuuaaugcuccaguuuuuaugaauuuauuuucuuuucucugaauguuugcuaauaauuuaaaagagaaagcuguauguauugaucuuguguuguguuuuuuucacagguuucuguagagcaacauuuucguucuguguuaguccucuauugguuuuugucaauucuaagaguggagauaaucagggaguaaaguuccuccgucgcuuuaaacaguugcuaaauccggcucagguguuugauuuaaugaauggagguccucauuuaggguaacugauuauugauaaaucuuauuugaauacaauguaggacuagguguuaaauguguuugguuuuucagcucaugaaaauuacagauuccucuagaucccucccucguuuuuaaagcucuaauuauaaguuuuaacacaaccuuuuggauaguuauacaacugucuuguauaaauuccuaauuucucaauuccaaaauuuguuuagaaaauguuuuagaauauauucuacaucaaacaauacuaacaauuucuuuagcuccaagaaagaucaacuugcguaaauauagaaauauaaaguaauauuagaaaaugauuugcauggaaggcugauauugauuuacauacaauauaaauaaucgauuauuaaaccaaaguacagggacucucauggcugucaagggcaguucuucaaggaucucagacucaguucacauaaaugacaaagaaauacuuuauugaugauucuuuucagcuuucuggaugucauauaacuuaaaaucuguaagauaaaaugaacuaagugguauuuucacugagggaaaauauaccuuuuggcacuuucaauacauuuuuaggguaugcauaugauuuuucuuaagaggcgauauuaugucuucugaaccaggggccuucaaaccucuauguaacauacuuacagcaacucagcuuuucucuuggguuccaccauuaccuuaaagcaugaacacggaaguagaaguggggauuuuugauaccagugccugaaaaggcauuuuguguuucguaaugugauacuuuccucugucuucucuauuucucuccuuucuucucucuuggugccucuguucacuuuugcccccugagucuuccuuccugcuuccauugccuuuaucuugcuaagucucaggcccuucuggucacauggauguuggucuucuucauuuauacccagcuuccuccuuaucuacguguacugcccuuccuuuccucugcugagguccuagaguuuccucaucuagccucucuucucaccuucuuugucucugccaugcuaggguaguuuugucccccuuucuaacacguccauuuuauaauccuuuauaguuccauuaucuuauagucuugauuuauuuucccauuuguccucgaaggcuucaaggaccucucuugaugaaacuuccugagauugucccucuaauauuuuucagauuuuccauaauacuugaaguaaguguacaaggguacauuuaggagacgggaugugucaaaaguugagaugagggaaaauagaaggaugggccugagaauaggagaagaggaggagaaaaagccaguugggaguccugagagcaauacaaugauuggugucuuuaggaacugccugagcgucacucauuagcaucagcacccuagauuccuuacccaugguuuguaauucuuaaggaaagaauuuauucuuguaauagaaagagaagaaccacuacuuccaccaucuuguauuacuuuaccuuucccgguuucugcugcuuuuuuguuuucucauuucucacccccauuccuccuaauuuuaucuucauuucuacuuaucauucccuuuccuccuuaugauucagaaguuuucuugaguuaaaauuacacuucagugaauguuuaugguauaauuaacauguaaguaggaguucuuauauuuaaucugaauaugaauacugauacagaauaacaaagaauugaggaaagugauuuuuauuucuuuauacuaaaauaaaauccuuuuugcuuucaguuuaagauuauuucagaaguuugacaauuuccggauucuuguuuguggaggcgauggaaguguagguuggguuuugucagaaaucgauaagcucaacuugaauaaacaggcaagugcuaauucuuuuacuugcuaguuaacaugaaugcauacuaacauacuuaccagagaggugcagaaaugcaguagucccuauuucucaacuugucugaaagucacccuguugcacugucuuucagugucagcugggaguguugccuuuggguacaggaaaugaccuugcccgaguucuuggcuggggagguucauaugacgaugacacccaacuuccucagauccuagagaaacuggaacgagccaguaccaaaauguuggacagguaaaaguaaauucuuuucuacaacuagauggaaaauggcauacugaaaucauuuuuuugaugauuucuuaauaaauauuuauuaauaaauuuuacugacuagaagcuccacgaaggcagagccuuccugaucuuguccacugguuaaucccugagauggagaacagggccuaucacagagaagacacucaauaaagauguuuuauagugaaugaaugaauuauaaaaaacuagucugaggaacucauuauuuuaaauacagaaggcuauguuacuacuauuuacuuuuaauugcaguucaggucagaaaacgaaaauaguucauuuuguggggggccuuuugaugaguaugguagguagucuccugucauuguaugguuuccaaaaagcuaaagaggacauauaaacguuagauuuguuagaauaucuccucuuaaauauacauauuaagaaugcauugauccaauaagaacuagauauguuaaaauauaagcaguccuuucccaggggcaggaaaauauuaggaagacagcuucaaaugaagggacuaucauuguguuuaugcuguucuugaucacaucucuuaauugcuuucucucugaauguccguguauaaaaaagaagcuacaauguguguacccugcguguuauggaggaaguguuuaaaauuuggguauaaggaacaacaggacucaguaaccagccacuccccaacccccaaugucaguagaagacagaugucaaaauaucaugaucaacuugagguagcauaaaucaaaacaauuuugauagaauuagccaucuguggaacucuucccgaaaauaacaaaauuucaccagggagccaccaaucugaaauguaauuacucuaagaugggcuauaaccuaauuaauuguaaccuugccugucauaagguaaaauauuuugcugacagaauauuuaaaaagagagcugggaaauagaacauuugucucuguucauccaaaauuacaugagagagauacuccaguagcuugggugcauaaaaguuuauaaucuuaugugcuacuggguucagccuccauccuuuaaaauaaucuggagguuaaaagaagaaaaggaaugaaaaagagaaaugguaccuauggauauguuaguuagcuugauuguguuguauauauauccaaacaucaaguuguacaccuuaaauauauacaauuuuuuauuugucaauuauaccuaacuggggaaaaaagauuggaaauaaauaaauaaaaucaccauuauuuguaaaugagccuggaggugacuucccagacaacuguccaauucugugguuaccaaacaaaagggguuauuuaaaugcugucuuuguugcaaauguaaagaccacuuccccugcuguuaggcauuucaucuacccuggguaugugcuuuccccucgugugcuauagaaauucacuucucagucgggggagguggcucacgccuauaaucccaacacuuuggaaggccgaugugggaggaucacuugagcccaggagguggagguggcagugagccacaauugcaccacugcccuacaaucugggcgacagagugagacccugucucaaaaaaaauuaaaaauaaauaaauaaaugaauaaaaagucacuucuccaggugguuagccaagaaacagcacccccauggugaaauuccuugaauaccaacugauaugcaaaaucaaaacaaaacaaaagaaaauacacacacacaaaaaucaaaguggauucagaaacuuaagaucuuuguuagaaacauaggaauauuuuauuccuauguuuccuuuauuaauuuacuguuuguaaagaacaaguggguugguugcaguggcucacgccuguaaucccagcacuuugggaggcccaggugggcgaauuaccugaggucaggaguucgagaccagccuggccaacacggugaaaccccgucucuacuaaaaauacaaaaauuaacugggcauggugguggguaccuguaaucccagcuacucgggaggcugaggcaggagaaucgcuugaacccgggaggcggagguugcagugagccaagaucaugccaaugcacugaagccuggccaacagagcgagacucugucucaaaaaaaaaaaaaaaaauacaccaguuaaaaagucauuguuuaauguuuuaaauuagaugaguuuuucaaauauauuuauuugauccucagaacaacacuuuggguugggucagaaaagcauuauuuuacaaagaugaaaauguaguuuucuggauacagugggaauaaaaacaacuaauuuuuugucugcuagcacuuucuaguugcuuuacuucguguaucaucucauuuaauuaaaucccuucuccuagagauagcuaauauugccaucuccauuuuacuggugaaaagguuuaggaggcuuucacauuaucuaaguuaaauagcuaauaaguaauagaacgggcaugguaaacugcaaucccugcucugucuaguguccaggguccuuucucaacucugcacucuuuccccuuuauguguguaggccagaugguuccuuccuucuggccugugccucugcuuagcugauacucauaugcaccucuuccucacuuuuucaucucuugcugccacuuucuccuuuuuauuuagcuccaaccauuuccuaucgaguggggagguauagcauggagggugcaaggaacucagacauuuggauggauuuauuuaccauuuauuuaacugucuuugaccagaaaaguauuuccagcuauaaggaacuugacuuuuauguuucuacucgugguuuucccuguuuggauauuuacaaaguuuaauuguuuuguuugcuugcaucauaccuauuuuuugcacuggaauguuagcuucauuggggaagccuauucacccuuguguuuccagacccugugacuuugagaugcucaauauaguauaucugcugcauggauaaaugauggcuuuugguuuucaaauauaaauuucuuuuuuuuuuuuuuuuuuugagacggagucucgcucuguagcccaggcuggagugcaguggugcgaucuugccucacugcaagcuccgccucccagguucacgccauucuccugccucagccucccaaguagcugggacuauaggugcccgccaccacgcccggcuaauuuuuguauuuuuaguagagacgggguuucaccauguuagccaggauggucuugaucuccugaccucgugauccgcccgccucggccucccaaagugcugggauuauaggcaugagccaccacacccagccucuuuuuuuugagauagaguuucgcucugucaccaggcuggaguucaguggcacaaucucggcucacuguaaccuccacauucaagcgauacuccugccucagccucccaaguaguugggacuacaggcgugugccaccacacccagcugauuuuuguauuuuuaguagagaugggguuucaccauguuggccaggauggucuugaucuuuugaccucuugaccucgugaucugcccgccucagccucccaaaguaaauuucuuuuaaaguauuuucaugggaagaguugaauaguagcuaaaaguaacuaguuuacaugucccaaaauauaauguaugucuauuggggggcuuucugggaauuugaauuuuuaugcaaauauuuauucucauaggcugaaugauacacuagguucuguuuaaauauugaucuugggauuuuccucuggguucuaucaguagcuucagcuguguuaugcuuuucuuaaaauucauuuguuaagguacugcuuuuauuaugcuuuguuucuguguaaaaaucuuuauuuuacaucuuuuucuuugagauggaguuuugcuguugucaucgaggcuggagugcaguggcaugaucuuggcucacugcaaccucugccucgcagguucaagugauucuccugccucagccuccugaguagcugggauuacaggugcccgccaccacaccuggcuaauuuuuaauauuuuuaguagagacgggguuucaccauguuggccaggcugaucuugaacuccugaccgcaggugauccaccugccauggccucccaaagugcugggauuauaggcaugauuuacugcaccuggccuuuuuucuuuuuuuugagacagggucuggcucugucgcccaggcuggagugcaguggcaugaucucagcucacugcaaccuccaccucccaggcucaagugauccucccuccucagcaauccaaguagcugggauuacaggugcacagcaccaugccaggcuauuuuuaauuuuuuuguagagacaagguuucaccauguugcccaggcuggucuggaacuccugagccccagcaauucauucacuucagucucccaaagugcugggauuacaggcaugaggcaccacaccuggccuuuauuucauauuuuguuagucuacaauaauguccuggcccaacucuucuucccaaauuuugaaauuacuauuuuggauagaaaacuggacuuaucuugaguugauugcuuuucucuaacaccaaaugauuuuauguuugcuuugaaauuaauacuuguagcuaauugaaauaaauuuacuucaguuaaguauuauuaauauuuucccccuacucucaugcuuacauucauuauuucuuaauuuaagaagggguauuuagcuaauuuucauuuuauguauguauaagcugauuuggcaagugugauugaguaacaguuuauagguaguauguauuuauuuaauuuaagacauuguuuuaaaacuuuggguuaugacucauuaguaauuuauaaccuaguuaguaaacugcaaugagcauuauuuuuuaaauagaacagaaaagaauggaaaagucagaaugcauugcaccugagaagaaaugggggcguuguaacguguggauuucuuauugugggcuaugggucuuaaaacauuuggaagccacuaauuggagaaaugguaagauguagaaaucauaaauuauaaauucaacauuuuaugagauuacugaaaugugaucucuuuucccauuuuugguuguuuuaagauaaaauaaaccauaguucaugaaugugugugugugugugugcgugcgugugugugugugugugugcgcguuuaugagaugcuaacaguuaguuuauccaauuuuaaggaaaucuuugaccaaagaguuuuucucccuucagguggaguauaaugacauaugaacucaaauugccaccaaaagcuucccuacuuccaggaccuccagaagcaucugaagaauuuuauguaagacuuaacccuuuaccuaucauuugaaauggggguggauaucuugagaaaaaaaaaagaaagagagagaaaauguacuccuaauauauugugguagcauguuaacuuaauuuuauuuuugggguauggucucauugacugacuaccucuaguccucucccccagagagaagaauccugaaucuaggcuagaguccuuccaugaccacccacaccgggagugcccagucacuccucuuccugggacucuucauguguaaagugaggcuacaaagucaugggaguuaaaugauguaacagauguguaaagcacuaucucuucuccugcccagauaauuccucccugcauguucuaucugccuguuuccguuuuaucagcagagcucuaggaaggucagcugguguuuccuguuaguguuuauucaucuucuacuuuggccauuagauuguuugauuauaagauguuagcuucuuuaaacaguauccaaacauaccaauacucguggccagaauauuaugcaauuucugucuuacugcuugcuuugcguacucuuuucuuguucuuuucuuuuugagacagggucuugcucuguggcccaggcuggcuggaaugcgaugaugcaaacacagcucacugcagccuugaccuccuggucucaagagauccuccugccuuagccucccaaagugcugggauuacaggcaugagacacuguggccggccccuacucuucugaagggacagcaagacaggucucuggguuaagccuguugauauaguuaaagaaagaccacuuaauuccaucucuacuacagaccauaaaugacuaacguuuuuaaagauucagcauucugauuaaaccucaaagcgguguagauuuaaaacagaaccugacuuucaaaggauuagucucugacucauuaagaccauuugaucuaugcuagcuuauuuuucccuccaggaaaauucaucuguuuauuuuacaguugaaaucuuuguuuugucauuaagaaaauuaugaucuugucaaaaccaaggcaaggaaugauaacuaaaaacauggggccguuucuuagagaagcuaauuguauuuuaaaaacuuuuucugacauaaaaacugcugauagccaaaacugcuucuaaaaaaauuugggaaauacaaaauuauaugaaaaagaaaauaaaaucaccuguaguccuaccacccagagauaaucacuauuaaagauuaauauauuuaccauuuuauuuucagcagcauuuuuaguuaugugauuccauaaacauaacacauuuuuauggaaaucaguccuuuaucuuaacaguauuuuuguaaauguuauuaauuucuuuccaaaaaagacaaaaaggagaauuuuuuucuuccauuuacuucagaaaugucuguuuucuagcauauaaaauaacaguaaauauuuacuuuuaucacguguauaaucacuaaauaugagguacaauucuaaagauaugaaggaaaucucucuuuuuuuguacaaaagaguuuuaaaugaaacuuugcuuuuuaaaaauaaacuuacuuuuguaacaaagggauagcauacuuuaagauaacagauuaaaugaguguucugaauggcccugacuaggcccugaacuaggcuggcaccaggaaugcauuuuacuguguguggccuuuuuaccuugaaaacugcgauaaaaguagacuaaaucuuucuucuuagcuuuuguauacuucauuagcugugggucuuaggcaaauuacucaguaagccucagguucuuuggcuauaaaacaggacagagggguaaauauauacagagugcuuaauuacagcgccugguacacaaugcaaaauauuaacucuuauuauuacuuaccuuucugaccgugcuaagugacugcauaguagguuaauaaguuacaucuauaauuuuaucuuugaacauagaggcuauuuuauuuuccucugagagaaauuguauuuuuugaucuucaaauauuuuuaauggacaaaaacuuggauuuuuugaauguaaguuucaaauggcauuaaucaaauguuauuaauuaauacauuagucaacuggcauuaaugaauuuauuaauagcauuaaugaucauguaaaauauuuucuacccugcagggaagaaaaauaaaaccaaucucuggagaacauuuucuuuuuucaaauuuuaaaguuuauuuuuagauuauauauuuucauuuuucucauccuagcuguaaagauguaauuuuuaguguuuaagagaucaguaagguggauuuguggguaaaugcaacaucuuguguaacuugggagcuccuggccucacuuccuuucuuugauguaaaauugcuuuccuguaguggucugccuuugaaggagaauguagaaauuuaaaagaguaacauacuuuugaaagaguaacauaaccacuuguggaaugaagguaaauuaggaaugugguucuuuugggaagagucuagucaggaaagcuuuguggggaaggcuuauucagacuuaauugaaucuucaaauaagucugaauaaacugaggcugauugguagaaguaaugaaaagauaccugagucaggcagaagagcauaggcggccagcuugccuagagcagaucauuuauacuagaaaauuuugcgcugugugaaauggaauauuauuugaggcauacauuugauguaaggcucugaauaugaggcuguuuaaauauugugcacauuuuuacauauuaggaaaauguauguggucuuucaacgggauguuaaaguuugagucaaauagaaaagggauuauggaugcuuuuggcauuuugacuauuguuuaacagaaauauuuauuuacaugauuauaugaaaguguauucagcauuuuuaaaaacuuuuuuauugaauuauacauacagaagagugcacaggucauaaauguauagcuugguaaauuuucacaaacuaaacaaaucuaugccaggccacccgucaguguucaaguaucccauaagcccccucaugcccucuuucagucaagacccccaccuccuaccccaauaaucacugugcugacuucuaauagcauagauugguaucuguuuuguacuuauaaaauagaaucauuuuguaugcucucauuuguuucuggauucuuucacucaauguuauguuuaucagauugaucuauacuguggcuuggcuauaaaucauucauucucauucuccuauggucuuccauugcacaaauacacugcaauuugucaucuauucuacuauuagaugaaugcugcugugaacauccuagugcaugucuuuuggugaacacaauuuugcauuucuuuuggguguagauauagaaguugaauuucugaguccugugauaucauugcauauguucagcuuuaagagacacuaucaaaucguuugugagaguguaucaguuugcauucccaucagcagcguuugagaauucuguagcuccauagccuugcuagcacuugccauuuucuaguuguuuucauuuuagccauuuuggagcugcauggugguacugcauugugguuuuaguuuccauuugccugauggcugagauuggauauguuuucaucgguuuaugggccauuuggauauuuuuauauuuaaaugucuagucuuuugcccaauuuuuauuagauuuuuuggcuuuuauuguacuacuuuguaggaauuauuuuuauauugagauauuuuuacauuaaaaaauuuuguaaaggaguuuuuauggauuucuauaagaauauaaauuaaagaauuccagaaaccgaaagccuuuugccaaaaggaaauaucuauuuugcaugaugacucuuucauauauuucauuauagugauugccuugccuaaacauaugucaugaaggguuccauuucuggagcagcaauaagugaguuguauaaaugccagcaacaauaauacaguguagaguuuucuuuucuucagaugacgauuuaugaagacucaguugcaacgcaucuuacaaaaauccucaauucugaugaacaugcaguggucauaucuucugccaagugaguuguggguuuuaagucuuuaaauauggugaaaaugaaaugauagcuggcuccuaccauuuaggucauuucuuugugaguuuucuucucaaaaaauaucuuggaaguagcuuauaaaauuagauguacuaaauuugaauugauuuuuaaaaaucauguuagcaucuuauuugcagugguguauacuuagaggguauuuuuuuaauguuuaauuugaaacauuuuuaucaaaaagguguaagaagcguuuagaguuuaauuaaccuaaaugucuauuuaaggaaauguuuaugauuacuuauaauauggaaaacacauuucauuauaauucauuauuuccauaaacacuacuauuuaggaacuguuuacaucacauuagaaaaaggaaaaugaugagauuuuucaaaaugauguuucucagcauguuuaaauugaauaauuacauuuuaauucaaaguuaucauauuuuagugaaguugauuuuguacauggagccaaagcuacuugauguuauuaucccaaauguugccuggcuggaauuuagaauuuaguuuugaaacauccuaugcugaugucaagagacuggaaagucgacuagaagaaggggugacaccaacugaaauuuucaacugauaagcaaaagaaugcauucaaauucuggcuuagcaagcacggguuacuguuaugcaggaagagagcagaaaaggggaagaaagaaagaaaaggagugggaaagugguaaagaaaaaauauacaaauuuugguauauuauguacuuaauucacaguaaaguugaggaaagacaagaucaaucauuauaaacaaauuugcuugugaaaaaaguacaaauguaguaacaauugcuuuugacaacauauuccccagaaauaggaagcaggacugcacaacaggaaaagaauugaauggcuuacagcaagggaagcacacuaguuggcccaggagaggugggcugcagacuguauuuggcgggcagugcugcagguuucuguuuugugcaaauauuggacuaaagcaucuucugccauuuuuacuuaauugaaaacaauuuuccuuacaaucaugcaacuaaaauaaaauacagaaauaauuggaaacugcaucgaauagaagacuguaacugucaucuguaacuuuauugcuuaauuuuucuuguaaaggagaaaauuuaauucuaucuaauuuauuaaugucaacaaaacagaguuuuaguauuuuaauauuggaauucuguguaagauuguauuugaaccagguaccguggcucaugccuguaauuccaacacuuugggaggccaaggugggcagauuacuugaagcccaggaguucaagaccagccugggcaauaugacaaaaccucaucucuacucaaaguauacauacuaaaauuagccaggugugguggugcuugccuguagucccagcuucucaggaggcugaggugggaggaucacuugagccugggagguggagguuguacuagagcuaagauggcaccacugcacuccagccugggugacagagugagaucuugucucaaaaaaaaaaaaaaaagauuuuauuagagaaaagguuuccacugccaaaaauguuguacuacaaagguguuaagauuaagaaugauagggagaaaaagggguggcuacucuaauuauccuguuugcaucuguagaaauuucuuaacaagaauuccacuucauuaaaaauaugugaaauauaugaaagguagugaucaaacacaugaaaguaaauauaaagguuuugcugacauccaaacuauaaaaaguggccaguuaaaauauuuacuuaacuauauuaaacaaaaaauaauucucuuaugacuugcuauaccuuaaaaaagcuuccauuacagcuuuccaccuuuucuagcaauguccucugaaaugucauaucaaaauacauuugauucacagggcaagggccagcccaucacuuagguguaugaacugggccugggaugagaaagacaauagggagugcuaaagccugggacaaacuggagauuuguccauuucaccaucaagcaauacaauucauugaaaaccccaguggcacugcccaccaaacaaagagaguguguagcccaccucuccugggccagucauugugcuuccauucagcguuuuuucuaguguucaauccuguuuccuauuugugggggauauggaaagaaggccuguuauuucucccucauggaacugcuaggauaauuaagcugaguaauauaauaaguauagagcuuauaaaugacagagggcuguauuaaauuaugguagcaucaccucacguuuuacccgauuacauuucagauguuuucuuugaccuuggccugacucuuugucuaaggcucugcucccagcccuagcuuuggguuucucccuaaccagcuugccugcccuuaagcagauuccauucugaugcagcaucccuccugucacucacucaucuaugcuuccaggccuuuacaaccccagauacaauucuagggaauuugccauaaagaggcugaagagaaaaaagaggagacaauauauaauuauuugguacuaguaauacaauauauguuaaauuuuauuucuucuucuuauuauuuuuggaagaaaaucacuuuauuccaguuaucucacaaacaauaaaaucacaacagcugguuuaaggaggccacacauuuacccagucccaaauucuauaccaucuuaaugaaauucugcacaguaagaauauccucuucggccgggcgcgguggcucacgcuuguaaucccagcacuuuggaaggccgaggcgggcggaucacgaggucaggagaucgagaccauccuggcuaacacggugaaaccccgucucuacuaaaaauacaaaaaaauuagccgggcgugauggugggcgccuguaguccuagcuacucgggaggcugaggcaggagaauggcgugaacccgggaggcggagcuugcagugagcggagauugcgccacugcacucccgccugggccacagagcgagacucugucucaaaaaaaaaaaaaaaaaaaaaaaagaauauccucuuccacugcaauucugaagcaaggaagcuaugaaugacagaggagaggcuuaacugcugguuucucacuuuauaccuucacuaucuguuacauuuuuaugcuaaauuuacuuggucaugaaagcugauuuuccaugucuucagcugaacuugauuaggccaguccaugugcacgucugcacuguuucagcaccuccuuggaacccucacugagcuugacaucacccuaguucugggaacacuccagaaacuguucugucuuauacaagcaaggcugcugcugcugugcagcuagucucccagaggcuccugguaagugaugucaggccuugugagcccagcauuacuuccucuguuuaagccaccccauucccaugauaguugacccaguauaugccccacagcagggcccacagccacgccagcugcagugguugccaucuggaccaucagaccuggcugccaggaugcagcagcaggagacucaacugcaguggguggggccacugcuggcagcugagcugcuggugcuggcagcugagcugcuggugcuggcagcugagcugcuggugcuggcagcugagcugcuggugcuggcagcugagcugcuggugcuggcagcugagcugcuggugcuggcagcugagcugcuggugcuggcagcugagcugcuggugcuggcagcugagcugcuggugcuggcagcugagcugcuggugcuggcagcugagcugcuggugcuggcagcugagcugcuggugcuggcagcugagcugcuggugcuggcagcugagcugcuggugcuggccggggugcaggucucauuggagguggcuggcuggccagaggggccaugcuggaggugcagcuuugacuuccaugugccaucacaaaugggcaguggcucagcaucucuaaauuuuauuuuuauggacauuuucaaacaaaacugauauaauuacuucccacuguacccaucauucaguuucaguauuuaccaacauuuugccaucugcuuccuacuuuauuuugcuacaguaucucuaagaacauccugaaaauuauucuacuacacuuuugguauauaguccucccucucuauccaugggggauuggcuccaggacccccuuggauaccaauauucauagguacucaagucccucauagaaaaugccauaguauuugcauauaaccuacacacauccuuccacauacuuuaaucaucucuagauuauuuauaauaacaaauguauuugcuauguaaauaguuguuauacuguauuguucagggaaugaugacaaaaaaaagucugcacauauucaguguagacaaaacaaucuguuuucuuuuucaaauguuuucagaccaugguugguugacuccauggauguggaacccaugaauauggagggcuaacuguaugugugugugugugcuugugugcacgugugcaugugcgcacauauaaucuuuuuaaaaaucuaaaaauuaauaauaauucucuaacacuaucaauauuacuuaagccauaucccauuucccuuaguuuucucagagguuuuucugugaaccuugucugaauuuugacaaggucuuuaaaaaaaaaaaaaaccacacacacuuuauuuguucaaaauucagacaaugcucacacacuacauuugagugauaucucuuuaagacuuuaaaaaucuugaccaggcauggugguccaugccuauaaucucaacacuuugggaggccaaggugggaggauuacuugagcccaggaguucaagaccagccugggcaacauaguggaaucccaucucuacaaaaaguuuuaaaauuagcuggguguggugguaugugccuguaguccuagcuacucaggaggcugaguugagaggauccuuugagcaugagaguucgaggcugcagugagcugugaucacgccauugcacuccaaucuggaugacagagugagaucccgucuuaaaaaaaaaaaacacuuaaaaauucuauaaugguuucccuuuaaaaaacaauucuuacugaggcaugacauauacaguaaagcaccuaaaucacaagagcacaacucaaugauuaaaaaaauacugcauguacgcacagucacacacagacacacauacacacuuguaauuacuaccuagauaaagaauucccuuuuuuugugaauguuauuuauuuauucagugauacaauauuaaggcaaaauguuuaaacccucuugugccuguuuguauuuauuucaugcaauaauaauucccaguagccuuaacuguuuucagcuauuuuuaaaauguugaaaugcuaauggaaaaguuguauuccacuaacauagcuaacauguagguuaaccuaaaacaacauuucuuugaccuuagaacuucaucaauuugguaugguaauaagaguuaucuucugagaaucacagcucuaacuagcaaucauagauaccauuuauuaguaaaaauguaaaacaguuauuaaauaaguugucuuuagcuacaauguaugucucuccuuuuauuuagucaguaguuuaaaaacuuuuuuagcuuuaacaguaggaguuaauuagguuuuuuacuuacgcacucuacucaccccccaaguuuugaaauaaaugcauuuuguucuguguacaaaaguuucagaaaaugggauaacuagcuagcaggaauauugacgccauugucauagaaccauagaauuuagauuuggaaucuacuuuagggauaauuuaggccaacccgccucauuuaauugguaaagugagguaguuguuaaaaauauuuccucagagcacaaagacagcuagagacaaagauagcuagagauuuuuauguauuaugcauugauacuucuaaaucaucuucaguuucaaauuggaacuuuuuauuagaugaaaaaugaauuuuucagauaugaugacccugccugccaaucuaugauucugucuggguaccauugccauauuuaucuuaguguaguaugugcauauuuuacugucauuugcccacacuuuaagaaauuaaguggaaaggugauaaaugaggguacuaauacuagugaugagaaguaugggucuaacauauguaauauaguagagaugauaguggaaaucaucagguaugugaaauguggacuguuguuagccucaacugaguauuugguucacacaguugacuauguucaauuuugaaggaagagaacaaaauuaaggaaauaaaauguuggaaaugccaaaaguucugucuaggccuuaugcaguggcucaccccuguaaucucauugcuuugggagugcaagucaggaggaucgcuugaggccaugaguuagagaccagcuggggcgacacagagagacuacaucucuaccaaaaaaaauuuuuuuaaauuagcucagcauggugacauggaccugugguccuagcuacucaggaggcuaagcugggaggaucacuugagcccaggaguucagggaugcaguuaccuaugaucacaccauugcacuccagccuaggcaacugagcaagacccccaucucuaaaaauguuuuuuuuuuuuuaaaaaaaaaguucuaacauugauuaaagauauaauuaggaauuuagaauuuuuuaaucucuaugggaaaaucugcauucuacuuucauuuauuugacuuuugcacauauuuucuggaagucuuauguauaaaguagaaaacuguguguauaguuggagaauaucuuuugucuuccuauaguaaauacaucuuaagauuguuuuuucuccaauuugcacguuucugguugguaggacuuugcaaucauacuguuuuuaaguauauauuuuauuucuguuuuaauaacucuacauucacuauuuagguauaauaaaagguuacuucauucccccagaauauaaauauccuauauuccuuuuagcauauggaacuuaaugagcaauaagauagagcaugucuucugauucuuuccacacuuguguggcgagcacucuccuaaccuucacaugccccuuccucagcuccuuuggccaccacugccacaggaucauagugucucugucagccucuguuugccucagugacauggcacacugaggaggggcaccccugcugcccuuuucauuccuaggcugauggacugaagggcucugucucuaggagugaauaagauaccaacaaaagcagcuaugauaaugauaugacauaugcaguuucacaaaccaagagaaaauuaugacaagaugauguuauaauaauggcaagaaaaaccucuauuucagaguuacaggaagaugcaucaaugcuccucucccuuaaaguagcgcauuuuacagaaacuuucaguaaaaugccuagaagagauuuugugauaguguuauauauauuucgagaaaucccaugaaguauuguucaugaucaaagaagacaaaacuugacaugaaguacaugaaugcaugucuaguaaaugauaagcuagauucucuguagaaauuugaguuuaaaaagccaacaaagaagguucaggauuagaaaauauuaccuuuuguucaaauaaaaucuagaaauguuugcuaaaaaauaauaaaacaaaaauuguuaggaggaauacaauuuccaaggugauaaaucugaagguugguagugugugugucuguugggggaggagugguggugguggugguguguguguguguguguguguguguguguguguguguguauguccugugucuauugaauugcucaaguucauaauacugaaguauauggaaauuuaccauuuugccacucaacuaccagagaaaguugugaguguaauagaaaaaauaacugcuggaaccuuuuuuaaauuuaaauuucucaauuuauaucaaugauagaaagcaauacuaugauuuaaaaaauagccugauucuaucagcauaagccuuggcuuuaaaaaagcuggucauauaccauucuguugauuguuguuuuuaauccagcaccagauccagauccagauccaaagccuuucaaaaggcagauuuuguuaguguuucaaguuauuuugucuuuuagcuuauuucuaucgcaaagaagccaaauguaauuaaaauaaacaaacaaguaaaccauauacugcugacacuaacaagaccuaaauuaaauuagucuuguaguuauugcauugauuaucucaaggaaaaaaugaauagauuuacagagaauauaacucaaguggcagauuuguuuucagcauaacgcacaaccucuuucucuucaguaauaauauauuguaacuguaacaaucaaaauauccauaugaugagucguggcuugacagugacaagugacaaucuuauuuuuguucagcaauguaauuucuguuaugaaaauauguaaguuuagaauuucaguggagaaagcaagaugaugcuuuaucauuuuuaaaugggaucuaaaaauaauuuaaauguuugaggaaagcuucuuauaacauuaauuacuauaauuuaaguaauauacagcaaggcuuauucauguaugcauuuaucacuuagaaugucuuggacuuaugugagacaaacugcacagcagauagaagcauagauuuauauacagaugacccagauauuugacaguuugcuuaauuguguuucuuuuuaaauauauucauaaaucaaggcaaauuaauucaugaagcuuacuaaauuguacaacuucuuuuccucaaaggacgcuaugugaaacuguaaaggacuucguugccaaaguagaaaagacguaugacaaaaccuuggaaaaugccguuguagcugaugccguggccaguaaaguaagaggggacucuucagggcaugagaguuguuuauggacaaugcucacauucaacuguguuucaaagcuaaauugauuaggugguuuuccugccaaaacaucuuaaaucgagagaaaaauuacuuuggaucagaucugagaauuuuaaaaaauauucuauuuuauuguuacccuuuaauauguaggaaaacugcauugcugaaaaccuaacucaaaucccugucccagugauugauuuuuuuuggagacagagucuugcucugucacccaggcuagagugcagugaugcucucucuacucacugcaaccuucaccucccagguucaagcgauucuccugucucagccccccaaguagcuggauuacaggugcuugccaccacacucaaauaauuuuuguauuucuaguagagacgggguuucaccauguuggccaggcuggucuugaacuccugaccucaggugauccguccaccucagccucccaaaaugcugggauuacaagugugagccaccacaccuggccaugauugacugaaggggagaugcauagcagucagaccacaggggaucccaugcagcugggcuccaguggagaaagcaagguuuuccauuuccaagcagauuugggccaguucagcugucuuccagcaugguucuuuggauuuccuagacauuacaauucuuggucucuuucagagugcugcuucuugcauugcuuuuuucuuuacagauuucuuucccccuuuauaaacuaaaauaagaacaguuuacugaaucuuaaaaacuaccaucuuugcuuucauugguucacaacaggaccuucuuacaaaaggcuugaguaucuugggcuugcaaaggaauuaacuuccccaaauccauguuggagauggcaguuuaauugaguggaagaaaaagaaaauagaaauaaauauacauuugaaguuuucugccuuuuucucuugucuuucugcucuguggagaguuucagaaaauagaaacccuuucuggccauacuucugucucuaaaguauuucugcucuaaccuugucucagcauaucaucaaagacaaauagaugaggaggaaagggacuggaaauuuuauggagaugaaaaguauauugggggguagcaucaacagcuucaguccuaaauguuucuucaccucucguaauacaagaaaagcagaaagaaacaagggcuugccuagugcaugcuuuucuuucuguaucccucuucuuuucccuccuuauccuugugcauuuuccuuccugcacuuucuuugagccaauaaucccuuaggcauuguucacuccuuugcaaaccaaagcuuugaaggggaguuugccacaacucagccagaugugccauuuaugacgcucaaaauggugcauuaagucaauuacuuuuuuuaaaaaguugauccaauguuuuguguaauguauagcaaauuuuguguaauuuuuuauauaaagcaucccuuuguauaaaaugucuguuguguuauuuugagaaaaauagcuguauaaauauuauaaagauguuuuuccccaugaaauggagucugaguggcucugaaauuauauaauaauugugccaacuuaaaaaauuauaaauuauuucauguaguaaacaucaauaaagccauugucccucuaaaucaaaagccauaauuuaaauuauaguugucuaucucuacuaaauggagauuuuaaaauuagcugcuuccagaaccaaaacaucuacaaaauuaaaggugagaauuuugguguuuuucucucuagugauuaaacuuucaaaacaucucuauaaaaauuucuuguacuuugucugcugaucuugauucuuuuugaguauuuuucucauugccauauuuuccucucaguguucaguccuaaacgagaagcucgaacaacugcugcaggcuuugcacacagauucccaggcugcgccuguucucccuggccucagcccucucauuguggaagaagaugcuguggaaucguccagugaagagucccugggugaaagcaaagagcagcuuggggaugacguuacaaaaccuuccucccagaaagccgucaaaccaagggaaaucauguugcgggcaaauaguuuaaagaaagcagugaggcaagucauugaggaagccggaaaagguacacauuaacaaauuuagcuuuggaagaaguuggcagcauuucuacugcaagcauaacggaguuuccauaguggucagauuggacacacuuuuuaaaaauaaaauuuuuaaggcaagauagaagauacagucauuauaagaaaacuuguacauagucuuauauauuguuaugguaguaguaagaaucagcauauuagugaggaauaaaauaaaauagcagaaauaaauggaaacauuucuaucuaaaauacaaaacuaguuuaaaugacauuuaaaaaauuuuagauauaguuuacuuaauuggaaucuguugaauucuuaaagaaaauaaaaccuauaaacuacuuugaaaauauagaaaaaaaaauuuuuugagaaagggucucacucuguugcccaagcuggaguacaguggcgugaucucagcucacugcaacguccaccucccaggcucgagcuauccuccucccucagccucccgaguaguugggaccacagaugugcaccgccauacccagcuaauuuuuuguaguuuugguggagaugggauuucaccauguugcccaggcugaucucaaacuccugggcucaagugauucguccaccucagccucccgaagugcugggauuacaggcgugaaccacugcacccugccagaaaauauuuucuuaacauuaauuucccaaauguuuauguugcuuuauuaagagcuuauaaaagcucugccuuguuuuaauuaauguguauauuaauacuucucagaauuuuagcuauagucuaaauguuaauuuuaguaugaauaauuaauguucaaaaaccccuuuauagauuguaacuuguaauuguauuucauucucuaaaauucuuauacuuuacuuguuuauucugauaaaaauauaauuuuagcaacuuuaguuuuugaucuuuaguucuucggacaucaaccccaaguucauugcuaaauaguguuuauuugugaaucuggaauuuuguuuggcauauguuucaauuugccuuuccugagcauaucuuaauauuaaugggcuuuauuuucacuuauccaaacuauuugucuucuuacuaccugaaguuauggaugacccgacaguucaccccugugaaccagcuaaucaguccucugauuaugacagcacagaaacagaugaaucuaaggaggaagcuaaagaugauggugccaaagaaucaauaacuggugaggaaacugggaaaaaauuauuuuggaauuaaauaaaaugucauuuugcuuuuaguuuucaaaaggcugaucaguuugaaaaaaacuauuuguauuuuuauuuuugaaaaggcuuuuuggaaguuaaagcuuagauaaauauucaugaauaauaaaacaauaaagauaacaccuagacuauuguccaguacucucacaucccucucuuaucauguaaucuagagauuauaacaauaaacuaaggauuauaggacuaaggaugauuaaauauguugguuuuccugaggaaagaggaaacaccuaaaucaucugauuugaaccuauuauagcucacagauuucuuugagaauuguaagaaagcugcagcucuccuaacgcuccaaaugcagaaaauuuggcauuuaagugauucagcagucccuuaaguuccaucgaucaaccuucuggguugauaguccuuauuaagcuucaaaaucauaggacuuuaaagcaagcguuaaaaucacuggacuucuaauuacagcccuugcuuugucaaaacuauuuugguaaggaaaugaauauguaauugcuugaagaauguuaaauaucuuucuaccuuuuagauuuuaauugaaaaugaauuuauacuuuuaauauuguauauugccuaagggaaaaguuucuaacguacuggaauaaaacaaagcagaaauuaaacuauuaaugaagaugagacaauaugaaaauaaauacauggcacuuaugaaaagucagcacaauuauaucagaauuguuugcagucauugggggcaauagacaauagacauuggggacuacuagaagugggaggguaggaaugguagaaaagcuaacuauuggguccuaugcucuguaccuuguugaugauaucaaucauaccccaaaccuccgcaucacucaauauacucagauaauaaaccugcacaugucccccugaaucuaaaauaaaaguugaaauuauaaaaaaagaaauugucuucauacaaugaaaaaaaaccaaauuuuuggagagcugaccauaucagauuaacauuuucugcuugagcuguggcaugaugaagaccuuucauuccccauguuuauggccgauuuuuccacaggacuaguaguagugaguacauuuuaaauuuuacauguuugaaacaucucuuguuaacuaugaaaaaaauuagauaguagguuuauuaauauguuguugcuaaauuuauuccagcuuucauaugaagcuaaauaaguaaaacguaaacuuaauaaguaaaagaaaggguaguugauaaaguuacuuuaaauuuaaaaaccuguuuuuaucuuauucucaaaaaauuuuaaaaaauguuugcaaucauuaaauuuuugcuuuuacuuucacuacauauaaacuugggcaaauuucuuaaccucuuuuugguuuucucaucucuaauaugaggauaauaaucuaccuacuucauuggguugcugcgaagguugaaaaguuacuauaaguaaagugccuagaauagugucugguagauagugcugccugaguguucacugucaucuuuauuguuguuauuuuuauugcuacuacugcugcugcugcugucacuaauuacauuaacggugagagaauauuucauuguacuugagacucuuaaaaacuuugaaaucagaccucauggaccucacauguucagcauaccacccaaugcaggcauguucuaggacccuugaagcagauggccacaagccuuaggaccacucacuuucaauacaucccacucuuauggucagcucuaauuguuagaaagucauucuuuauauugggcuuucuauuuucuccccuaaauuucuacccaugauuacaguaauuauuagguuuuaugaaugauaguuugacaguaacaacuacuggccuuuauguaguguuuaugguuaguuuaaggagcaauuucauauacauuugacuguaucaaagaggacucugacucuggagcuauuucuccucuuccuucuccuccuccuccucccuuccuccuccuccuccuucuucuucuuuuuccucuuccucuucuucuucuucuucuuuucuuucuucuuucuucuucuucuuccuucuuucuucuuucuucuucuuguucuucauguggcagcccuuuaaugauaccaaaaacagcuuuggugggaucagaucuucucucaccuuacaucuucuuuuccagaugaucugcccuaagguuucucuaccaguuuuuaaacugaugauuuuaaaccuuuuguuuuccuuguugcacccauuuggucaauguuuaucuuaaaaugugaugcaccauuuuaaacaaaauucuucagauauuuucugugguguauuagcacauugguacccauacacuacucauuaaggacauuuuugauguuacaaagacuacucaagacuucucuuuuaaaaaccuaauuauaguaguuuacacucaucccaaugaacuuuuaucuuuuuuauuuagaucuauuauuucauccugugaagcucuuuggaagcuugauucuaucaucuuaaguuuauuucaucugugaauuugauaagcaggccuuugauguuuucaucuauuagaaaguguugauuacagcagagaugacaauggcauccuuacuauacacugauaauuccuccuaagaugauggcuguuaggaggauugguuugucaaagcuuauuuaaugguuuuccaaccggcuaucaucccaccuugccauacucuuaaacuugacacuuccguuguggccuauaaaggaaacuaaaaaauacaaauauagugcuguaaauguugauauugaaauagacagagauuuagaaaagucuuuaaugguacaguauuuggucuuuauuuuggcuaguaaucuaacuuguuggaaaugaauagcaauaguggaaguagaaguauaugaaauacuacuuuuugaggcacauuuauuguaucaucauguaauaauucauaugucugagaugugagaaauaccguauauuaauaugauugaugagaugcuuuauuuaagaagaaccagaaaacauuaauuuaguuacuuguaauggaacaucagucuuagucauuaguacgcucucugcuuuuugucagaguugaacaucaaaaaguuguuuuuaugagaaauuagcccaggaguccuaucuauuuaaaaaagggguggcuguucuguuacuuuagugcaaugggacuguuuuugaaugagacaauagaguguaaaauuaauauaguuagcuuguaauuaguuuuagggagagugaagauaauuaaguuuuagaguauuuuaaaauugaguuugagaauuacuguuucuuaaaaauaccuaccaguaacuccuaaauugguuaaagguaccauuugcucugcauuaacuugccucaguuuagaguuaaaucuuucuucuucuuguguacuuugagaauaauuauguuuuagaauaauuuuuuaaauguauugagcuuuuacaagaauaugauagaacuguuugggcaaaucaucauuuugaauaaauaauugagaaguacaggaaaaauacguucauuucacuugaagauggaugcuauuuuucuuccauuuauuuguuuauguaugagacagagucuuacugugucacccaggcuagaguacagugaugugaucauagcucacugcaaccucaaacuccugggcucacgugauccuccagccucagccucccaaguagcagggacuacaggugcaugccaccaugccuggcuaacauuuuuauagaggcagggucucgcuguguugcccagucuggucuucaauuccugaccucaagugauccuccugccuuagccucccaaagcucugggauuacaggcaugagccaccacaccuggccucuuccauuuauugaagacaauguuaaaucauguuucacguguuugcucugggaauuacauuaauuaaauuugaucauucacuugauauuuaugagacaaggauuacauggguagugugcauuauaauacauauguuucauuuucaaaaauggacuucaaaagcuucauuuaucuuuaagugugcauugaucauauucaaauuuugaguauuagugaccuuuaauuaugguagacaucuauuuucuacugauauucauugauuugagaugaggaaucaagacuucuuauucccuccauguaagucucaagaaaauguaaacgauagcuaugcauaauauuuucauuucuacugauugauuuaaacauuauuuuauguuuuaaauuuauaggaacgugcuuauuuuuauagcuuuaucauuaucucuuuuuaaucuggacuuuuugccaacaguuaaaacugcaccucggucuccagaugcccgggcaaguuauggccauucccaaacugauucugucccugguccagcuguggcagccagcaaagaaaaccucccugugcucaauaccagaauaaucugcccagguaguacagauucugaaacaucguguauuuuucaguauuucugugaaaagguguaaguauuuauuucuauuacuguggaaacauguucuuaaagauaaauauucuuuaguagaauguucuuguuauacuuucagucagaauccaggcccuuagauucuucccuguguaacaguugccuagaaaguauuaaaacacuuguuucggccaggugcaguggcucacaccuguaaucgcagcacuuugggaagccaagaugggcagaucacaaggucaggaguucgagacaagccuggccaacacagugacaagccugucucuacuaaaaauacaaaaaaauuagcuaaguguagugguacaccccuguaaucuuagcuacucaggaggcugaggcccgagaauugcuugaacucgggaggcggagggugcgguaagcugagaucacaccacugcacuccagccugggagacagagugagacucugucucagaaaacaaacaaacaaacacauguuucugggcccugcccugggaaauuaugagucgguaguucuggaguggaguccaggaaucugcauuuacuaaguucccaaaguaagucugaacuuacuaaguucuacuacuucuuaagcuuuccuuugguguuuuuuuagucagcauucugcugaauccuuuugguuuuaagccaugagucucucuguagucauuuuuagacaacauugauguaaauuauucaugauuuuggauuaggcaaugauuucucagauaugacaagcacacgccacaaaagacaaauaaauuggacuucaccgaaaugaauaguuuugugauucaaaggacacuaucgagaaagugaaaugacaauuuaagaauuuacaaauaauauaucugauaaaggacuaguauccagaacauauaaagaacccuuaaaauucaacaauaaaaagguaaguaucucacuuuuaaaaugagaaaggaaucuaaauagacauuuucccaaagaaaauacacaaauagccaguaaauacaugaaaggaugcucaacaucguuagucaccaggggaaugcaaauuaaaaccauaaugaggugccccuuuaugccacuagguugacugugaucaaaauagacagaugauaacaaauauuggcacagaugugaagaaauuagaacuuucaugcauuggugguaggaauguaaaauggugcagccauuuuaagaauaguuucacaguuccccaaaaaguuaaacauagaguuuacaugugacccagcaauuuuacuacuagguauacacccaagagaauugaaaauacaugucuacacaaaaacuuguucaugacuauuuauagcagcauucacaauagccccaaaguggaagcaacccaaacauccaucaguugaauggaagaaacaaaagugauauauucauacaauggaauauuaucuacccauuaaaaagaaugaagcacugauacaugcuauauagaaacacuauggaaaaugaacauaaaagccaaauguaauaugacugcauuuauaugaaaugcgcagaauagucauaacgcauagagacagaaaguagacggugguucccaaggaccuggaggugaggugaucgacggaauggaaaaugacagcuaguggguacaccguuacuuugcaggguaacgaaaagguuuuagaauuaacagugaugguugcacaacuuuguguauauauuacaaacaacugaauuaucuaaaaacuuuaaaaggguuaauuuuauaauauaucaguuguaucagaauagaaauauuaaaagaaaaaaagaaagaucaaucugaaacaaacugguucuggaaaggccuucagguuuagaugcuguguuucuauuccaacuaggaaccuugggauaaccccucuggaauaaagcugaaaggaauauggcuaacccuaaaacaucuuagaaaauauuaacauggcugggcgugguggcucacgccuguaaucccagcauuuugggaggcugaggcaggcggaucaccugaggucaggaguuugagaccuggcuaacauggugaaaccccgucucuacuaaaaauacaaaaauuagccaggcaugcuggcucaccccuuuaaucccagcuacuugagagacugaggcaggauuaucccuugaagccgggaggcggagguugcagugaucugagaucaugcuacuauacuccagccugggcaacagagugagacucuaucucaacaaaaaaaaaaaaaaaaaagaaagaaaauauuaacacuucccucuagggcagcuggaguguggcucucaccucuccaaacuguucuuuaugcuuacuaaauuuauuguuuucuucauucauuuacuuguuuagacauaagggaaauuggcauaaagaaguaugccacaguauauucaaaacuaugacauuaaacgaaagaacaaaauucauuguauuugauaauugccuaaacauuaaaauaaugaauaauaauaauucccuaagaagagcauagugcugaggaaaggaauguuugcuaaagaaaggaauugcugggcaugguggcacaugcccuguagucccagcuacuugggagacugaggugggaggaucgcuugaacccugggagauggaggcugcagugagcugugaucacaccauugcacuccagccuaggugagagagugagacucaucucuaaaaaaaaauaaaauaaaaagaaagaacuuguuuuucuaauuuccucguguuucccuuguucuuguagguuccuauuaguuugucuccucuccagucuuuagugcuucuagcuuucauauuggguugaguagaucauaaaauucauuagcuuugaauacuguaacaguuagaaaacuaguuggaaagcauguugaaauaaauuugaaguaagaggcuucauuuuuuauauuuaauacuauauucuucuaaaauucacagauaccuacauuuaauacuuuacugcuuauucuuaaaauuaacacugaguuuucaccuuaauacaucucuuaauauuuuaaauuaaguaucauuaucuaugauuugagaauauggaacugauaacuccaugacauuuuggguaauuccgccuuuauuguaaauuccuuauagacuuaauaccaucuuugcuauaacaaaggaaguaaaauguauuuguuauagaauuauugggaugguaaaugagaaagugucacaaagccauuccuauuuagguccuccucuccuuaauucuuuaugauaacauauagauccuuggaagugucaaaagccuuguacucacaaaugucauuguuuuuaauuuucauuaaugagaagaguaggcacugaaauaaggcacugaaaaccuugcuuuuaaaaguaagauauuugauaucaggccuggauggacugguucuuucuguguuuuuucuuaacaugcgaucccauauguguuugcuuuucuuuccagguuuaagagcaggacuggcugccucaauugcugggaguucgauuaucaacaaaauguuacuggcaaacauugauccuuuuggugccacgccguuuauugacccggaucuagauuccguguaagaaaaugcuuuugcaaauauuuuguuuggguuuuucuuguuuuuuuuuuuuuucaacaugaacuguaacauuuuaaauguauuacaauaaauauggucccauguaaaaaaaggaugaucagaaaauuacaaaaguugauaaugccaagcacauugagucuuuuaaaauucaguggucuccgugaucugucccugagauagguccuuuuccagcccguucucucugagagcaacccucuggcaaaggaaggcaccaauaaauagaacugaugcuauucccuuuaccuccuuucuucucagucuugccagaucugucaucuuuccacgucagcuucuagguuuacuuauuuugggaaucuuuuggcccacacugaucucuucccuucuuaagacuccuacaauuuuuuggcauuucaagauauacuuucuuuuacuuccuuuuuaaauuuugcuuuuguuauaucauuucuguaaugacauuccucaaggagaguaccauauuuuaaacguuccaaaacaccuggaagaauggauuggaucuaguacuuuuuugcucaauaaauauuuguccauuguuaaguguagaaauggaggggacuuucuaaugauaaaaaagagagagagagaauuggcaccugacuguaaagccuucccauaaucaccugcauuuuuucuguguagugaggaacuuaaguagaaauagaacuaagauuuuguuacaguuagagaaaaucacaccauaacugugugucuuacucaccaucccuuuaugucacauguaccagaaauuguacacauguccugugguuguacacauggcauaggaauaggaagugauuagugcuaaguuuuacaaucugcuauaaaaugaaagcuuaaaugguuuuaaguacuaucuuguguacaaauuguaauuguuauaaugaaucucaaauugacuuugauguacuuuucccugugaucauagagauggauauucagaaaaaugugucaugaacaauuacuuugggauuggauuagaugcaaaaauuucauuagaauuuaauaauaaaagagaggagcacccugaaaaaugcagguaauuuuaguaaaaguaauaaugcuauuacauaaaggcaauuuuuucuucauuuauuaugucuuuuugcuugcucugccuuuaaggaguaaauaaauaaaauuuccugaaauugccugccaauauuuauuuucaggagccgaacuaaaaacuugaugugguauggaguccuuggaacccgggaguuauuacagagaucguacaagaauuuagaacaaaggguucaacuugagguaaguucaucuuaaaguaaagauauuucauauuaucuuacuuaaaaaaaauaucguuuuggagcuaauuugaccuaaaugcguuuugauuagcaauuaaauaaauauucaaggggaaaaaugaaugugauuaucaacuuuguacuaaaggaaguauauacacaggauaugaaugacacacuuaauuaucaucaucauuaucuccugaaauuggggcuacucuggaguuguggugccccacguaaaaguggagccaagggagcacauuuauaggagaggguuuuuaauggauuuucucauuuaagcuuccaaauucugacccaauucuguaauaacaaaaguuuuucaaaucccugaaaauagcauuugaaguaaauagaaucuuuuaauuuaaauauacguuuauuuuuugcuccaauuauuucuaacaacaaguaaaauuaaaagagauuuugagcauuuaaauguuuuacuguuuuuuacuaauuuaaauaggaaauuaaggacagaaaaaguuauuuuauuucuuccaacaacagaaacaacaaggcugaggauauagcucuaaaaagacuauuaauuucugugaauuuuauuuuauuuuaccuuugauccaggacucacuguuuaugccgauggggcaugucuuuccuaucuuguaucuuuuuguaacuauauauuuuuaauuaaagcauaucauacauauagaaaauuaugaaaucuuaagucuacagcucaacaaaauaaauagaacauuauuauuugggguguuauccaaacacuggaauguggacuaaagaggugucucgcucauucuuuaaaaacuauauuuccuagugaagaugagccuauuauacuuuccacucuaaacauacaacuguaugaucagcugguuugauuuauuauugcuuauaaaauuaagauagacuuacuggauaaaaagguacaaaaucaggaagguucacauuuuguaaaugcuauccuugacaccccauacccaggucagcuuaggugcucuccuaaucauguaaucauuccuuuuuuucuucauguaccccgguuggccacauucuuuuuauuuauuuauuuauuuauuuuuuugagauggagucucgcucugucaaccacgcugcaguguaguggugcgaucucggcucacugcaaccucuaccugcuggguucaagcgauucuucugccucagccuuccaaguagcuggaacuacaggugcacgccaccacgcccagcuaauuuuuguauuuucaguauacaugggguuucaccauguuggccaggaugguuuccaucucuugaccucauggucugcccgccucggccuuccaaagugcugggauuacuggugugugccaccgugcccaguuuggccacacccaaggacacauaggaaguuguuuuuaucuuuguuauccccaguguuuagcucagcacugguccuauuuugagggugaaauagauggguaagugaucacuuuagcacaauuuauuaagugcugugaucaagcauagccagcuaucuuuaaggguugaaaaacuggcuggaucugaauggcuggauggucuuaguuccuggaagagccucagcucuucagaaauaggauuaguaaccucuuguacugguguuccaaauuuugaacaagauaucuuauuuacacagcugcuuuguacucuccuuuuuaaaagguucuuaaucuuuuuugaguuguaggcaccuuuggcauucuggugaaaauaaagaccccuucucagaauauuguuuucaaaugcauuauaugaaauacagacuuacaaaagaagacuuaccaauaagauuaaaauaaauuaacaacauauuuuuauguugcuaaagaauaauauauguguuucaucguuaccguaucaaauaaaaaucuaauggcaugucuaauaaauaccauaacuucaaagugaugaugaacuuauauacaagauaucugaaacaucuauaacguaauauaaaaaugucucauuucgauugaugaugaaaucacggguguuacuaaugccuuuuuuccccuacauuuauaauugagggcgaugcuaaacuucagagguuagugaacauaaagauacagauuuuuaccaugaaguuaacaagucaccugaaucuauccauggacuccugguuucugaaccuuaaguuaagaacacuugauauagauguauauguuaaaugauaagggaaaauaaaaugaguaaaacaagauaaaugaaaacauguuaauauacauaaaaauaaaguagaaaaaguagagcacucuuugccaucauuaacaaaaaauaguaacaauaaaguaaaccaaaaagauacauucuacuucuaaagacgauggaaggccguugucuaaaaauucauuuuucugaugaugguucacucgggauaaagguggaaaagagagacccacaccuugggaggcucuuuccagagagacgccuucaccaauggccuuccuuuuuagcuuuuuacucuuaccuuuuuccucagauaaguuuucccuccccguuauguuguugguauggaacgaggcugacuucaugucuuaacuuuaaauuugugcagaacaaagacuuugaccuugguuucccuauauacgaaauugauaaaauaaugauuuuaugcaaaucauaaauaaaugagcccaagguacuguaaaucacagugugaaugggaaagaacuguacaaaugcaaacuuuguuucccaagccacauuaucagugauucugauauauacucaacuuucagaaacuuggagugagauuuagaauccuuuuuacaaugaugggaauuccagaaauguaaauaacgucacaguaucauauuuugcuacuuuuagaguagaaacaccuuucacauguaaauggaagaauuguauuaaaauuccaaacauuuuuuguaagaaggaugacuuuuuugcccauaauauacguaauuuacauggguuaaggagacuguucuauuuauuaacugaaauaauaauuauauauuguuucaaguucuguaaguacuaagauacaugaagaaaaacaaauaacuuuaaaaaacagucuucaucuguaggcuauaaugaaauaugugauugagaacaaguaguuguuuaauucacauuuuuaguuauuucaaaucuucccauaaucuguaucuuuuuaaaaaacaaaauaaauuuaguuuauuauauuaauaguaauuucuguauuuguuuaauucauuucaguaauaacuaguuguaacuacuuuuuaaaucauuuugaaugaaguuuacugugugccuucuacauaccaccuuuaauucuuaacaacucaugagguagguauuauuauucaguucggaagaguaaaggcauugcuuaaguucaaacagcugauaaguggaagagccaacauuucaaauccaguguuuuuuccauaagacaauuuguaauuauaacugaagaaggaaauuuacugacuucccacauguguucuaggugcuuuucuuuaccuuaucucauuggccucacugugugcuaagaauuguuagcccauuuuacagaugagcaaagugaagcucuaaaagcuuaagggacuuacccaaauacuaagugacagaauucaauccagcuccaccaucuucccuccauaucagauugucuggugaaaggagcagagaaaacaaacacuaaugagaaauauauauauagcugcaguuuuguagcauuuugcaacaucaugaaccacaaauagaaacaugggauggcuagggagccagcucugguggugugcaccuauaaucccagcuacuuggaagccugaggcaggaggauugcuugagcccaggaguucaagacugcaguaagcugugauggcaccacuacauucuauccugagcgacagagcaagaccacaucucucaaaaagaauaaauaaauaaaaauaaaggauauauggggcuacuggaaauauuuuuuaaaaauuuaacacuccugaaguuuuuccuggauaugagaaacuuuuaaaucaugugaauuuguuaauuuguugaaucuguauuccucguauuuuuccuaugagacucuaugaaauggacauuaagcauuuagauuuagauguguugcuuaauauauauauauucacuucagcaccgcacauaggacuucuuucugaaaaucuucaucguuuuccauaccauguuugcaaauaaagugcauccauuuggaaaauauuuuuaaaauauuucuuuuauauuuacagagauaguauuuuuccccauuuccuuuguuagucauaugauuuaaagcagcuuuuucuaaagcacauaaagauaucuguuuaauguauuggguugagaaaaaguuuauuauucuguuaaguauuucauauuuauucauucaacaaauauacauugagcaccaauuaugugccagacaaacccccaggugcauggaccuuugaaugugaaaagcuaaaccugcuaaugguuaacacuguguuuucaugaaaaagaagaaaaggaauugugaaacauucccgugaagguaaaucaaccaauccuggccuucauccauuacaccauuccaaucagccaauaacccugaggucuucccaagaacugacuuuggcugaauuagcgaacacaagcuucugugugauucugauggugaacauuuuuugcaguacuuggggaugagauuaaucuccuaugcauccucacuaagcucuuauucuuccccauucucagauucacagagcagagaagucccuuacggguuggucuuggaccagcuguaacaauuuccaaguguuugcuggucucugcccuggauuuucaccaguuuagcgagcuaacuuggagaaucagaaccucacuacugaauagacauuaaagaaaauauugguacucuugacauugagaccuuuuccuuccaucuuugcuaaacccaaaccauccuagaccaguaggacuuaauacucuuuuuaaugagaugucccauuacagaaacucuuucccucaccuugguuucuccccuagaacaaauuauucucucacagucucagaaauacaguuuauuucuuucuguuggaaaucauuuuuauugggcauuaaaauguaauuuuuaagaagcuauguuaauuauuuuuaauauaagaauuauuuaaugaaaauauagcauccauuuuaggugugacaucuguaagcuguucucuuuuaaaaugaaggcuuaaacauuuccauuggauuuaaauguucacuuagaaaaauguuaagugguuugguuuaaauguuaauuaaaauaauaaguaugaucauaaaauguauguaacauaauuaugcucauuuuucuugaguaauuuuuaaaaaauuaguuucauaacuaauuguuuccuuaauagccaacuagacuuuauuuaaaaguuaauagaauaaacagcauuaauugaaauuaagaaacaacauuuaugagagaagguaacaguucugcuucuacucaguaagaauuuauucacauccauucaccagccauauccuuuuuuuccauuuacaugguaauuuacuuuucauuuaagugcuuaaugagaaaguaaggacugcaaggagcuuucugagaugcauauauuuuugcuugacuuugguucugacuuguacuugaaguauucagcuuugaguuucaccaguccccaggugguuguagagccccagcaauguaccagggacugugagaggggcuaagugagaugguuaggaucaacuuucucuuacccagucugcuuucaaaaagaugcuuaaaauaaguacauagaggaccacaaugcaggugaaaguacauaaaaggccugaaaaugauucaagaaaaggacucccugguuuuggaggaaagagguaaagcauuucuuuaaaaaucaguuuuuuguaauaacuucugcuauaguuauuuauacuucaaacuuuuuuuaauuaaaaaaaauaagauaaaugauuugguaacguguagagagcagacauuacgaacacacugugcuccauuguccuucaucuuuaguguuuuaguaucuuccauacuagugguucugcucuuuuuaucuaaucucuacuuuuuuuuuuuuuuuuuaccuuacagugugaugggcaguauauuccucuucccagcuugcaaggcauagccguguugaacauucccagcuaugcuggaggcacuaacuuuugggguggaacuaaagaggaugauguaaguaaugggaguaaauaguuuguuuccucaaaaauaauuauaucacuggaauaauuugcuuuuguaaaugggcuguugaauaguaguuuaauuucauguuaaauauuuugcauuggguaagugaggcauggaauagauuuauuuaagauuuuauuguaacagucucuuguggauguacuccaacuuuucucauguugaagauacagauauucguaucuugggauguaugucacaauuuucuggaugaacauuaaauagugggucugcuuuuggaaaguagauuuaugaaauaaggaagggaagauuuuacuuuuuaauuuuauaccugcaucuguuuucuaucgcugcuauaacaaguuaacacaaauuuagccaccucaaacacauuuaucaucuuacuguuguauaugaugggagacuggcacagucuuacugggcuaaaaucaaggugucagcugggcuguugccuuccggaggcucuaagggagacucuuauuucccugucuuuggagcgucucgaggcugcccacauuccccuccaucuucaaagccagcaaaggcagguugaauccuucucacauggcaucucucugaugucugcugcuuccucuuccacuuuugaugaccacugugauuacauugggcccaccuagaucacccaggaucauccccaucucaaggcccuuuauuuaaucacaucugcaaaguuccuuuugcuguguaagguaacagauucacggguuugggggauuaggacauggacauuuuagggggcagagagggggcauuauucugccuaccacaauaccuuuugguacuuuuacuuuuucuuucuuucuuucuuucuuucuuucuuucuuucuuucuuucuuucuuuuucuuucuuucuuuccuucuuuccuucuuuccuuccuucuuucuuucuuucuuucuuucuuucuuucuuucuuucuuucuuucuuucucuuucucucuccuuccuuccuuccuuccuuccuuccuuccuuccuuccuuccuuccuuccuuccuuccuuccuuccuuccuucuuucuuuuuugagacagaaucuuacucugucgcucagacuggagugcaauggcguaaucucagcucgcuacaaccucugccucucagguucaagcaguuccccugccucagccuccuggguagcugggacuacaggcacacaccaccacaccuggcuaauuuuugcauuuuuaguagagacggggguuucaccauguuggccaggguggucucgaacuucugaccucaggugauccacccaccucggccucccaaaguccuaggauuacagggaugagccacugcauccagccucaguacuuuuaauuuucuaaacuuguguguguauauauuuuuuauuuucagaaauaucaagagggcucauuuggccggucgaguuuagggcuauuuuuguuuuucuuuucauacuuuucuauauuagaaaaagaagaaaacacaaccuuacaaauguaauuguugugaaaagaaugaaagagagggcacaauuauuaaaguguguauauauauauauauauauaucaguaaaaaugagaaguguuaucacagucuuuauuugaagagucacauccauugauuugaguuuaugauauaaugauauaaugguuccuacugaucuguuauucucaaagaucuuaaauggacagauagggauacaguauaagaucaauuggaaaguauuuguaauuuucaugacauaaauauauuccaguccuauucgaguauaaaagcaucuuuugucugcuugucacuauuaaguauuuugaaggggagaaaucagugagauuaagguaaauaaagccaacauuccuugaacaccugcuagguaguccgacaauguucuaagagcuucacauucauuauuuaauguccacguuguuuauuugauuuuuacugcugaagaaucuaagacaaaguuuccaguuaguaauagcagagacaggguuuaaauucaggcaguauaauaaaaaaauuacaaauuacaauguuagcaacuuuguguccugauauuuucagugaaaguuuuaauuagcuuauuacuuuauacugaaaauuguuucagaugcauauuauuuaugauauaguaaaagagagaguaagguaauacagccuacauauaaaauuuuagaguaaauuaauuuugugaaaaugcaucuaauguaaagacaaaauaagucugcauaauuuuuaucuucugagguuucuauuugcauacucucaaguucccucaaaaguuuuguauuaaaauauaaagcacauauguauauugcuuguaaaaccuugaaagauuucccuuagaauauaucaaguaaacuggaucauaauuugcaucuucauuagcuuuaacuuuaugaaacuauaucaccuuucuaugacacuauaucgccuuuguaguuuuuuuuagauuuccaaaacuuacauguaucaucuuauuaacauguuugaauuagguaugaacauguauuuaacauguuuuauuccaaggugaauuauuuagaaauauauuaguuaacugguccaaagaguaguuuaaugagagguaugaguaguauauccguguauauuugaaaacccuuuuuaaaguuagguuuauuggaagucaucuucagagauuuuuuucuuggauuauuauuuccuaauaauauuuacuuaaauauauuauuaaauauauuaaauauauguagauauauauugcaguuuacauugcuuaacgugcucuucaccuaaacauucaguagaaguguaauguaguuuuucuuucagauauuugcugcaccauccuuugaugacaagauccuggaaguuguagcaauauuugauagcaugcaaauggcaguuucaagggucauuaaacugcagcaucaucgaauagcccagguugguuucucucgucaaaccugacugcacuucuugggcuaaggaggguugaaggaaucuauucuaaacaacucguacacuggauauucaucuauaauauucugacuuuguugucauaucaguuuuuaccaugucauuuauaagugauaaagcauaauagucuauucuguagaauagucuaauacucaagccuucauaaagauugagugucauuuucucuggaugauuuguacucuaaaaugauuuguuuuauuucagugccguacagugaaaaucacuauauuuggugacgaaggagucccagugcaaguggauggugaagcguggguucagccuccagggauuaucaaaauugugcacaaaaacagagcacaaaugcuaacaagggacagaguauguaacaaaaacauucuucuagaauauugucagguuuuuaaagaaucugaaauuguuauaaaaaaauagaaaaugaaaacauuuaaauugucucuuaaaucugacauuuaggucauggugguuugaaauaugaacaaauauuuauuuauuucaguaggaguuuauuuuuuagagccauuuuagguuuacagaaaaacugggcagaaaguaaagagaauucgaauuacguuccuauauacuuccuccucccccuucuucccuacacauguaaauuccccuguuaacaucuugcauuaguguggcacauuuguuacaacuguugagucaauacugauugauuauuauuaacuaaaguccauaguuuccauuacucuuugaguuguacaucugugaguuuggacaaagauauaaucacuuguauccaccacugcaguaucauacaaaauuauuucacgacccuaaaaauuccuuauggucuaccuguucaucccuccuucccuuacccuuacuccuggcaaucauugauuuuuuuuuuuuuuuuuuuacugucucuauuauuuuuccuuuugcagaauauguuuuuaauuaaggucugucuuuaucaaagaagacugcuaauauuugcccaucuaguauauauaaaauaguaaagauuaaagaauaaauugaagcaauaguaaagauugaagcaugaaauauuuuuuuguuuuuguuuuuguuuugaaacaguccugcuucauugcacaugcuggaguacaguggugugaucauagcucacugcaaccuuaaacuccugggcucaagcaauccuccuaccucagcccagcuaauuaaaaaaaaaaucuuuuuuguagagaugaggucucacuauguugccuagacuggccucaggugauugucccgccuugaccuaaaucucuuuuuuaacuuuuaaaugauguauucaugaucauugacugcacuacuuuucauguguugcaguacauuggaaaacuuugaaaugucuuuuuuauacuugugauuuauuugaggagucauuagagaaaaagcaauuguaguuuuauuaaagcacacauuuacauggaccucugaguucuaaacuaacaauucguuacaauauugacuuuaaauaggccuuugagagcacucugaaaucuugggaagauaagcagaagugugauucugguaaaccaguucuccgaacccauuuguacauccaucacgccauugacuuggcaacagaagaggugucgcagaugcagcuaugcucccaggcugcagaggagcucauuacuagguagggggcucugcugacuuuucaggcugugggaacuguggucucagccaauuuuuguuuuuuuaaucuuaauacauuguuucaguagugguaucaaaaagagaugcaauuacucuucuucacacagcacucuuuccauuauuguuuauuucuccauuuuauauacaucuuuacacuauacuaccuacuuauauguugccuucuaauuacuaauuaaauguuuauggaauggagagggaagucuaaacauucauccuguuccagagaagagucaggagcaaaaagaauaaaaagacuucaaaaaccaauuucugacaaguuauuagagagauuuugagaccacacauaacauuaauuccaauagacaaaaagaaaagagauaaaaagcaagccuaugaguguuaaacaaauaaaaaucacuaugaccagggaaaacuucagaggggaggagggaccaugggccagugucuuaccuccucaccugagucuuaucuaccgaauggggcuaauaagagcuguuucaauagggugugugaagauuaaaugagacucuagggaugaguccuauaagcacauuguauuaguccauuuucauauggcuaugaagaaauaccugagaccggguaauuuauaaagaaaaacagguuucaggccaggcacaguggcucaugccuguaaucccaacacuuugggaggcugaggcagguggaucaguugaggucaggaguucgagaccagccuggccaacauggugaaaccccgucucuacuaaaaauacaaaaauuugccgugugugguggugggcaccugcagucccaguuccucaggaggcugaggcaggagaaucacuugaaccugagugguggaaguugcagugagccaagaucacgccacugcacugcagccuggacgacagagugagacuccgucuucaaaaaaagaagaaaaaaaagagguuuaauagacucacagcuccacaugucuggggaggccucacaaucauggcagcaggcaaaggaggagcaaaggcacgucuuacauggcaguaggcaagagagcaugugcaagggaacugcccuuuauaaagccaucacaucuugugagacuuagucacuaucacgagaacaguacaggaaaaacucacccccaugauucaguuaccucccacuggucucucucaugauucauagggauuaugggagcuacaauucaagaugagauuuggguggggacacagccaaacgauaugacacaucaugucuggcauauugagugcucuguguauaguaacuuaagauucuucccacaccuucaucuggucacugauaaaaauguugaaaaagaaaagaaggaaagcaaagcucagugguuucagcggcuaacucacaucuuuccuccucucuacuauuugccaucugcuccccucccauuccuuacucucuuuaaauauuuauuagauaacuagacugugugagauguuagagacagaagagaaaaggcauacacccccuacugcuggaccaacauucagaauuagaaucaagucuuacaacugcaaaauacugggcagcucagaagaaagggaagagaaaaugaauauuuacucagcuauacccacacagcugcauuauuguacaucucggcuucuuauccauaggguuguuaguuucagacuaaauacaucucuuuuagauacuacagacaacuucuguggccucuaauuuacaguguuuuuuugaaaccaaaauauacuucccauguucucauccugugaaccaaccaaauaaucuuauuguaaaaaggaagcgaagauugacuaggcuugcuucuggucaacguaguuuggcuucccaucuguuuuuaaauuuugcagaugaaaucaggcucacuugucuauuuucagaauuuauucauugacuaugcaaacauauucaauuuuugaaccucuucuuaggcuggggauacaagaugauuauuugacagcccuacuuaauuggcucacagauuaguaggagggagaaauguggccaaaggauugacaugaggcacacaguggacucuguagauacacucuagaggaagucagaggcagugaaggagggcugccuggaagaagugaccuuucauccgagucuugagggaagagugagaaaaggagcaauuuaagcaugggaaccagcuuaggaagaggcccagaggagugugaaugcaugcuacuuucaggaaaucucagagaguuuggggugacugaaagguuggcauaguauaugcaagauuguguggaauguagaugaagaggugaggaggagccagaucuuuacugggcuguucuagaaguaguguggagggguuuuucuggacgacagcaaagcuggggcaaggugaacacugaggaugcuguagaaguugucccuauaaaaaaugauagacuaaagcaguaaagauagaaaggacaagcaagauuaaagacaguuuaggauuuaaaauugguaaauggguaugaauuaggaaacagguugaccuuaauguucuaaugaauggcuggaugauuguggggugccuuugauggagccauaggguucaggaagaggaguagguauuagaaggaaaaugauggguuccauguugggcuuuagaauuuaaauuacauuaaaaauaccuagcagauuucaguaggcaauuagaaauguugaucugaaguugauuuaugucuuucccuuucucugaaaauuagaauaaccuuuauccaucucuguucuucugaaaaauagcccauucuucaugguuucucaggguugcugauaauagugcugaggugacauuugcaagcuucuuugugccuuagauauccauuguauaauccuuaagaauuaaauucuuuuucuuuacucuugguucagcuauauagggccucagucccuuuucuuguucuguccuuuccagauagaaaauauuucuccaugaagcugucagaagcaaaaaaaacacuugaacagcccugccuucuugcucaucugcaggucuuacaucauuuucuagcaaucggagggacuuuuucuccuuucuuguccuuggccuuagugccuuccagaauuuggucuuuucaggacuauucuuagagguuuggauaccaguggaguauggcacaacaggcuuuggaguuaaauagacauggauuccgauccuggcucuacgauuuacuggcucuguaugccuaccacgucucucugagccucaaugucaucaucaauaauauggagauaguaaaucauagcuacauuuaaaggcugugaauguuaacuuauauacugcuuaugaucacuuuguguauugaugacaaauaugguaaugcucuucccuaaucuguugcauuugcaguuucaaugaaugaaagagaaguuucuagucuuuauacuugugaucccucucacuuuccaaggauacugaaaaaugaaguauuacuauauuucauucuucaaaauagcacuucaauaugucucccucugauuuuuaagccuaauuuuuuauacaaagauuuuuuauuucauauuuuuuguugcaguggggucuggauuuauagaucuaccugugccauucauaauugagcagccauuaaaaguguucuuccauacugaucuucauauauuuuuuacuuguuuuauccuaacauuucuauacuucaaaaaaaaugagcaauacucaaaaaaguuuuuuauucauuuguuucauuuuugcuuuuaggauaugugacgcagccacaauucacugucuuuuggagcaagaacuggcccaugcugugaaugccugcucccaugcccugaauaaagccaacccaaggugcccggaggugaggaucuaaugguaaauucucauuccacagauucuuuuggguguuacacauguauuuuaauacuguaaaauaugccacgcccugugacagaaaguuauguugucuauaugagucucuacaaaccugcaguaaaaucguggacaacuuuuuauuuuccuuuuccuguuauuuuuucauuccugcucuuaaauucucucauuuuuuauguuucacuuucaaucacuugucaccuuccaucugucuucacuucuuucuuuuuugaacuuuaaucguccuuucuuacuccuucuuuuaccuuaccuucugcccuguaccuuguuaaagggcaauccuagauaucaucagcgugcauuuuguuagagauguccacucguuuuugaaguuaugcacugaaauuauuccuacuucauuuuguuuugcuaaaucggaaauugaugcuucuguaaaauuuuuaauguauaaguuaauaauagaauggauagaauauaacucuuaaaaugugccacaugguacaaugcuauaguauggagaaaacugauagcguuuuuuuuuuuaauuauuugauugaaguuacuuaaauuaauauacaguuaagugcuuguucucaagauaauagucuaaaaagcaauaugguuaguguuacugagaguaaaaguuuuuuuugacuuaacuuuuuaaugggaauauguauaugcuggugcuagcauauacauauucauuagguaggagaugugauccugaguguauucacuguaaucggugcauucuuuuuguucuguaauauaauaauaaugagauagucauacaaacaaauguaugaaacuuugcgauuauagaauuuugguagauuaaaaaugugugcugugaauuuaaauuauaagaauaaaauuuaaaguguuuaugguaaugaaauccuauuuuaauacagaucacaugucuuugauauucuucuuuucuagagucuuacaagagacacugccacugaaauagccaucaaugugaaggcgcuguauaaugaaacagaaucuuugcuaguuggcaggguuccuuugguaaggaaaagaaugacugguaacauaagaaugaugaauuaaaugucugggucuuaccuucauuggggaacaggcauuuggcagauucuaaggcagaagcagccuucuggcuuccauccugagagcugccucuucaccugguuuuugucuucaagaaaauauauggcugaaguugggagucaugauucaggcuaacaggaguggagauuuccccucauauaugccauccuguuuuuaggcagcccugcucugccccauucagcuucgagagacgugagcuuuauaaaguguaguagacauuccuuagguacuuauuauugcacacaaguagaggaacucauggaguuuguucccugaauuagcauuugaauaugacugguaugguccuccagguuugcuuaaaagaggacauuuucuagacacaguguuucaagaaguaaauuucaagaacucugccuuguuuaauccagauugguccuggaaaucaaguuuaggccaagucugaaucagaccacaguccauggaucucaagcauaaaugcuggaagcuuguggauguccuauuuuguuagcagcacgaguuagccuuucuuuauaaauaccucaccauuuucaaguauucuagcaucuuggcucuugccgccaccuagaguucgguuguggcuuauucccacaugcuguuaucacuguguggaaggccuaauucauuugcuguuuuuuuauuccuuuuuauaauucugguuaauugguaguugaugaucuuaaaacauuucuuuugaaaguaauuuucucacuugguugggcaaaucuacaccuaaauaaaagugauacuaagagucauaguaucuggcacagugggugaaugaaugggaggugcaucccacagccuugcuauuaagugccugagcuuaggguuucuguuuucgccuaugguccagaaaagugccaccuuuggggcauccuuugcucugagaagagaagcugaaaggcugcaugaaagccaucacucuuaccuaccuccaaaggaaacugaaacacagcuuccuugggacaagaggugacuggcucuacuauggccaugaagaaaaccuuuuacgaagaaacauugguuaucucuuuugauaaaaccaguggagccccuucuuggcuuuuuuuggcacuacuguuuuuaaccagaaucuucugcugguccuauaggaaauccagugaccuaugacgaucauuucuuacaacuaaaagcauaauuuauucuguacuuauuuucucuacacgaaaaguaccugcugagugcuaccuugcuaauauuuauuauuuguauuauguuaauauggauggacuuuccuucuccacuuuuaauuuucucucauuguuaaauaugaauuuugguuuaaaauguguacuggugaauuuuaccaaaacuuuugacaauagugauauuacaauaaggaauugauuguauuugagagcaacuaagguuuacucuauauuuuagugccagaaugaauuuguaauaaccauuuuauacguuuuauaacacauauucuuagacuaaacgaaaauuaauaaauuuuaaacacaacaggguagagaaucuccuuuuuuuuugagacagggacgcacucugucgcaguagcgugaucucugcucacugcaaccucagccucucugguuccaagugauucuccugccucagcugccaaguagcugggacuacaaucgcgcaccaccaugccuggcaauuuuuuuuuuucuuuucaauagagacagaauuucacuauguuggccaggcuggucucgaacuccugacuucaagugauccacccgucucggccucccagagugcugggauuacaggcaugagccacugcgcccagccaagaaucuccguauuuuuaaucacuacuagaagugguagauacugugaauaacaaggggaaacaaaaaaaaaaguucauaauaacaguaauauuaucucugaacuuuuaguucuaaaauucuauaaacauauuuaugagaacucuauaauuuuaaaguaauuuauaaauauauugauuagcuagaagagaccucaaaaauaaucuagucggccaggcucaguggcucacgccuguaauuccggcacuuugggaggcugaggcaggcagcucauuguagaccaggaguuugagaccagccuggacaacauggugaaaccccaucucuacuaaaaauacaaaaauuagccaggccugguggcaugcgccuguaaacccagcuacuuugguggcugaggcacgagaauugcuugaacccagaaggccaagguuacagugagcugagauugcgccauugcacuuccagccugggcaacagaacaagacucugucucaaaucaucaucaucaucaucaucaucaccuugugcuauuuccagaggaagaaauaaagucuccugaagucaauuaaccuuccuuugguuacuuaguuaauuacaaggccaggaguagaauccaaucgacugccuuccaguucugugcagaggaauguuuauuuaaucuuuauucauuuauugaacuuguaagugcauuuuaauaccugcuuucaaugaguuaaugcagauaauaggugagcaguuaaauucuccuuaaaauauccaaacccaguuucagaugauaagccauugagcuuuuugcuuugcccuaauuuuuacaacaguuuuucaucacagauuuuucuaagauucaugauuuuuuacccuuaagccuauucuuuaaauuuucaaggagauuuuucugcaguucuuuuuauaugacaaguuuuuaaccaguuuaaaaaguauuauuuguucauguggugacuuuuuuuuuuuuuuuuuuuuuugagucagaguuucuggcucuggcacccaggcuggagugcaguggcgcuaucucugcucacugcaaucuccacuucccaggcucaagcaauucucuugccucagccucccaaggagcugggauuacaggcgcccaacaccaugccuaacuaauuuuuguauuuuuaguagaggcgggguuucaucauguuggccagucugguuuccaacuccugaccucaaaugauccgcccacauuggccucccaaagugcugggauuaugggcaugagcuaucaugcccagccuggugaccuauuuaaaucagaaggauuuuuggcacaaauaaguagaauaguaagacugcacacuuauacaaccaggaagaauugguagauaaaugcuuggaaagcaugaaggagggagacaggaaagaagacauuuacacagaaaaaaacaccaaaauaauacuuuuucuaugaaguuauuaaaguuacacuagcuacucauaugaucuuugggaaguaaugauuagauuaaaucuauucagauuuuuuaaaaaugaaaucaauauaaaagaauuuauucuucucuuaauauuccuuaauuuaaaaaauacuaccuuaauaaggagugaggcuguucacugucaaaguacaaugauuuauucuacgugaggcuggccacugagucuuguuuuguuuugucuuuuaaucugcugguaaauagcagcuggaaucgccacaugaagagcgaguauccaaugccuuacacucuguggagguggaauuacagaaacugacagagauuccuuggcuuuauuauaucuuacacccaaaugaggaugagguauguaaaauucagccuguuucucuagaaauguagaccauauugcuauagaauuugaacucaucuuugaaaaagagauauuuagggaaaaaugaauuuugaauacuacuuucaaauguucuguucuugaacaaaugagaaaaggcauuuaugugaacgcauuuuaggggaauugggacauuuuuaguaguacauugugaacuuuuuuugaagaaguuaucacuguucuauaauguuuaguguuuauaacuuauuccuguguuaucccuauuaucagaguagguuuuucuccuuuucauauccugaaaaaauuauuuucuugcucgauuugaacaggaaccuccuauggauugcaccaaaaggaacaacagaagcaccguauuucgaauagugccaaaguuuaaaaaggaaaagguucagaagcagaagacaaguucacagccugguaggugguccauauggaaggggaaauauaacauuaugaaaaaagagcugauuaaagugacaucauggaggucgugaaaauguucuggagcuagauggugguugagcauugugcaguaugaugaacauacugucauugaauucuaugcuuuaaaaugguuaaaauggggaauuucaugcuuuaugaauuuuaccauaaaagaauccucucauaccuaaaacacaucugaguaucagugggaaucucuaguaaggaagcacacaaaaaaaugaagugguugcuaauuugcuucuacuuuguuuaguggaugucagcauuucuguucagaugguucuuucucaacagcaagucaaagcaucaguguauaauuuguuuuucuucuuuuaaguacaauuuuuagauuacuuugauaaauggaacauagaaacuuucauuuacucauuuaacuugccgauuacauuuuccaccuaaaguuauauauucccuuucuccuguuuugaggacacuguuucaaccccucgacaaugacaauaugcugugauacuugcauucucaagcaaagauuaagcccccucuucgcugcuauuucucucguuccuuuuucaccuuuccuuagaguuuaaauguacagguaugcuaguacuaaagcaccuucaaauucuguuuauacaaugguagcugccuuucauaaccaaauaauuuuauaaauuccucugagugugcuaucuuuaaaaaagugauguaaagccuuauuugugauauucauaaagcagcuaaugaaagccauuuaaaaaccaaauacagcaaauaaguaggcuuuuauuaagcuaaucaauguugaauaaaauguauaagcaaaugauacacacugaaaauaacguaauccaacuaaugucagagagcagugcuauggacuuuuuaaaugauauuaaauugugauuuaauagcacauugauugccguuauuaucaguaguaggagaaucaaucaacacuacacuugaagucagcaagaccuuaagcagaaaagucuguguaaaauugaauaccccauaucagauuuuaaauuguaauuagcauuuguagcucauuucagucuauagccguuuucauacagggucugaaggaaaucaucagagcuuauuuagagcuugcaccauugauccuaaugaugugaaauacauuuuguaugcauauuguguagguuggguggcuuuaaugaggaaacuggacuaaagcuaagcaugggugcacggcagcaaaugguuuuguauagucggauccuuguguugauaguguguaacuugcaugggaaaaaguggaacuaugguuuuguugaaacaacaccuuuaaccuuuucuuuugcuagcacugccgcugcacucuguuuugcaucuucuuuggccaaccuuugcuuuguaaugcauugagcauguagaaauuaaggggguuuugcucuuaacuuugguaguucagaaauggggcacagaggaaguugcugcuuggcuggaucugcucaauuugggagaguacaaagauaucuucauccgucaugacaucagaggggcugaacuuuugcaucuggaaaggcgagaucuuaagguauuuccuuugugcucuucuguucuugaaaauuuuauugcaaaacagaauccuuucuccugugccucuucugauacuugcuuuuagcuucgcuuaugucaugcaaauguguaguaaccuaacauucacuguccuguggucugaguuucuuguaugcuuuuuaacaagaaugucagcaguauuuuccugucagaaucacucuauuauagcuaaagcuuagcaugaacuuaguaauuuuucucugcaucuagugauaugacuguugcugugcuaguauuuccaaauggaucauguuuccaucagcucauuuuauugcaucagcauggaaggugauaauuuggcugaaaaugacuaaaaucuaauauaugguuaacaacuaaaaauuaaugcaaaauaccaauaacaaagccuuucuaacauauggaaugagaagagagacuuacagcaauggcuacuuagaaucuuacaauuuguuguauuucuaagucagccuuuuuuaggucacaugaauaacuagacugagaaauucaaauuuccuuucuaugacauauuauuaaaauucuauuauucucaaaaagaauuuuuuuucuuuaguaaacgagguaaaaauuuugccuagcuuuugcuagaaaacagcucagagccuauuugugaauugacgauagagaaaaccauuccuucaucaccugaggcauuucccuuuuauucugugggugaagucucaguaguaguagaaacagcugaaguaggcucucuggccaagguuuaggaguaggauuuugucacguuguauuuucuuaccacauauugccauuuuaaauuuccaauaaguaguaacguuuguuggagugaucccuuucauguagaccaaguucuaaaaugcauuaaauuuuaucauaauacagagaauuccuaacaaauuaaugaacuguuguugcaccuuuaucuacaaauacauuagcaaagaucuuugaauagauaauugguaguauaaagaucuuuauuaaacagauucacaaagaguuuuagcacaucaaaagaugacaccacuuauaccuaaacaacuuuagccauaauaaaauaaaauaauuaauuaauuaccuuaguugagaguccuaaaucuggaacauagcaaaauauguaguauuagaguucauaaagcaaaaguuggcuuccaagcuugaaaugaguccacaaaaaaguaaauguaggggggaucaugauauccaacauguuuuuguaacuucugauauccuuggcagauaccaauauuuauuaaugacugauuaauauauuaugcuagcuucucugcaugauaccuguccucuagaagcaugcaccgcauuugcugugaauaagcauacauucagggaaaagacuguguguguauguauaaaaaauauacauacauaaaugcauauauguguacguguuauauauauacauacaaacauagauauauacagguacacacacaaugaauguagcagaaugaauguguagaauggaaaaacauacacuaaggcaaaguuagaaaagaauagaaagaagaugguuaagaauuaucuuagaaaacguucuuuuugcuuuucaugggacuuuuuuguucuguuuuguuuuuauuuuuaaugcaaauuacauucucucucuuaaaacuuuuagacauuuguauugacauggauuuuaaaaauuguauuaggucugaaacaagaugugggggguggaugagaaaaggaacauuucacagaaagagucuucuguagcacaaaaucauaaagcuagagaagagcucccauuguucucugcgguuguagcugucagcagcggcaaguccuucagaccgaugccucuaaaugcuggugagggaucacucacuccuuagguacuccauugcuuccgguacuacuugugaauaugucaguggcacacagguucucucucagcccugccugaccugauuugugaacuuuuggauuauagcaccaaccggcuacuugguacucagguauuauacagggauaucaaucucuguuuuugcuuuuuaaaaauuaauuuauuuuuauuuauacaaaaauauauggguacagcugggcacgguggcucacuccuauaaucccagcacuuugggaguccgaggcgggcggaucacgaggucaggagaucgagaccaucuggcuaacacaaugaaaccccaucucuacuaaaacuacaaaaaaacuagcuaggugugguggcacgcuccuauaguuucagcuacucaggaggcugaggcaggcgaauuucuugaauacagaaggcagagguugcagugagccgagaucacaccacugcacuccagcuugggcgacagagcaagacucugucuccaaaaaugaauauauauauauauggauacaagugcaauuuuauuaccuucauagugguuaagucagggcuuuuacggaauccauugccugaauaacauauauuguacccaauaagcaauuucuuauccacucccucccacucccuuaccccuccaagucuccauugucuaucauuccacuagguccuuguauauaccuuauuuaacacccacuuaugagugagaacaugcaauguuugucuucccgugucuucuuguuucauuuaagauaaugaccucaaguuccauccaaguugcugcaaaagacauguuuucauucuuuuuuaaaauuuauuuucuauggcugaauaauauuccaauguauauaugugccacauuuucuuuaugcagucauccauugauggaaaccuagguuagagaauuucaaucuuaacauguccaaaagcaacucuugagcuccuauugcacuccuguucugccccuucuccagugcucugcauuuuauaaaucagaucucuggcccuccaggcacucuaggcagagaaaugaggcucauacuuagcaccuuccucuuuuuuguccaucuuccccuaacccaucaagcccaucaccaagucauauugauucuaauguccauucacuucucuuuauauccuguccacaauccugcuccaugcuacuguccaguuuugcuuguauaagaucaauagcuuccuaacuggucuuuccgcugccacucugucuucacaguccauuauccacguugcaaccagaguguuauuuuagcaucaucaaucagguguacacuuuucugcuuaaaacuuuucaguagcuucccauuucuagggaauaaaaacucacaucuuuaugcaggccuacaagguucugccuauguauucaaccuccugugaagucucuggcuccucccugggcuaugcuccauucauccuggccuuauuucaguugcuuaaaaauucuauacuuuuucucaccuuggggauguacucucuuuugcugugcuucuuccccuacccuucaccugguuaacuccugcucagagauuagcucaaguguuacucccauaucaccaaaacaacuagacauaguaacaugacagucuaaaguugggaaaaggaaaaaaaaaauauauauauauauacauauauuuguuguuguuguugagauagacucucauucugucacccaggauggagugcaguaaugcaaucauggcucacugcagccucaaccuccugagcucaggugacccucccgccucagccuccugaauagcuaggacuacaugugcaugccgucacacccaacuaauaucuuuuauuuuuuguagagacagggucuugcuguguuguccaggcuggucuugaacuccuggccucaagagaucggccugccuuggccuccuacaaugcugggauuacuggugugagccaccaugcccagccaggaaaguauuuccaaugugcuuuagcagauaaggaaacaaacugauugcaucauuuucuuugcuagaacacaguaggagaaaaaagagacaccaaagaaaaugguaaacauauggugagaguuuuuuguuuaguuuauuuuuuguuuuuucuauuuggaaaguuguguauguauggcuggaaggauaacugaauaucuacaaagcaugcuuugucaaaauuuggacuguuuauccagggaaagagaaagcuacucauaugauaaaaacuggccaggcgagguggcuuaucccuguaaucccagcacuuugggaggccaaggcagguggaucaugaggucaagaguucaagaccagccugaccaacauggugaaaccacaucucuacuaaaaauacaaaaauuagcugggcaugguggugcaugccuguagucccagcuacucgggaggcugaggcaggaggaucgcuugaacccaggagguggagguugcagugagcugagaucaugccacugcacuccagccugagugacagauugagacucugucucaaaaaaaaaaaaaagaauaugauaaaaauuaauauauaaugauaugugauaaaaauaaagauagaacaaaugucacagcauagcuuuauuacagccuauacccucaaaggcauaaaaauauugaacucaaacuaaaacgucaaaagcaauugcaacaaaagccaaaauugacaaaugggaucuaauuacacuaaagagcuucugcacagcaaaagaaacuauaaucagagcgaacagacaaccuacagaaugggagaaaauuuuugcaaucuguccaucugaacaaaggucuaauauccagaaucuacaaggaacuuaaacaaauuuacaagaaaaaaaacaacccccauuaaaaagugagcaaaggacaugaacagacauuuuucaaaagaagacauguggccaacaaacauaugaaaaaaaaguucaacaucagugaucauuagagaagugcaaaucaaaaccucaaugagauacuaucucacacuagucagaacggcaauuguuaaaaagucaagaagcaacaggugcuggugaggcuguggagaaauaggaaagcuuuuacacuguuggugggaauguaaauuaguucaaucauuguggaaaacaguguggcaaucccucaaagaccuagaacccgaaauaccauuugacccaguaaucccauuacuggguauauacccacaggaauauaaaucauuguauuauaaagauacaugcacacauauguucauugcagcacuguuaacaauagcaaagacauggaaucaacccaauugcccaucaguuguagacuggauaggccgggugugguggcucaggccuguaaucccagcacuuugggaggcugaggcagguggaucacgaggucaggcauucgauaucagccugggcaacauagugaaacccugucucuacuaaaaauagaaaaaaaauuagcugagcaugguggcaggugccuguaaucccagcuacuugagaggcugaggcaggagaaucguuugaaccugggaagcagagguugcagugagccgagaucacgccauugcacuccagcccaagcgacaguaugagacucugucucaaaaaaaaaaaaaaauaguagacuggauaaagaaaaugugguguauauauacaccauggaauacuaugcagccauaaaaaggaacuggaucauguccuuugcagggacauggauggagcuggaagucauuguccucaguaaacuaacacaggaacagaaaaucaaacaccacacguucuuguaagugggagcuaaacaaugagaacacauagacacagggaggggaacaacauacacuggguccuguugugggggcagaaggaggggagaauaucaggauaaauagcuaaugccuguggggcuuacuaccuaggugaugaguugauaggugcagcaaacuaccauggcacacuuuuaccuauguaacaaaccugcacauccugcacauguauccuggaacuuaaaauuaaauuaauuuaaaaaaaaguauagcuaagaaguuaauguaauucuauggaaaacauucuucucauuuuauaccaaaauaguaauucuaaauagauucuaccucccccaaagaagauuuagucuugagaauacaauguauuuauggccuaaaauaaaauauuuaauauuuaaauauauuuuguaguugcauaccuauguuuucacaaaguguaaagauauuuaaauauuccacucaaaaaaucuaaaugugacuguaaacgcauguacauuucaaauuuagguagcaagcaucgguauauuccucuaggauuuggccuugcuuuuaagcuugauacuuuugcacguauucaggaaauguauaguugccuuaggacuaauuuuggaugcccugugucauaggagaaaauauuuuucugagucaguuaaauauuuaugaaauaucuugaaauuaucucaaguuugacaauagcauuggcuauggaaagaguauuuuccagaaggauucauuacugcuaaagaacuccaagagcucuuaaaggguaaacgagagaaagagagagacaaugaccgaagacuuaaaccaguuugaucuauuucauucaaaaguugaaaaauaaauaaauuauaaaacaggguggauauuuggaaucuuuaacuucucagacagguuauuuuauaacccuguuuuuuaggccauuuuggaagucaucuuuuuaauaauuuucaaauauuucaauuuuuuuggaagaaguuguuugacuucacauauuagcaaacugacuaugccuuuuacuuaaagaaacuaggauuuggaggccuuaacuguuucuuuuaguuuuucagacagugaauaacuagcaguuauucacccuuggauagguuuaauuuauuccugcaacaaauauuugcaagguacuugcugugcacacucugcagucaucaucuauuucugaaaguuaaauauugaauucuuggcacuuauaagaagaaguuucuuuaagaagcaagaauaauaauuuugagagaaaagagccaauaguguuuugagggaaagcaucaaccaacagauaauuauguuuaaguaauuuuuuacacacauacauuacaaaguauaaagacuaauuaaauuaaauauuccucucaaauugaagccuuguaaugcaacugcaaaugcauuuacaguccaaauuuauguagcagauacugguaucuuucucuagaauuaggucucacuuuuaaauuuaauauuuuagcacaagaaauguugccuuaggacuaauugugggugcccugcugucccgcaucauuuuuuucucagagaucccaaaagagccuuugagagagagagagagagagggagagagagaagaaaaagaaagaaaagaaagaaagaagaaagggagagaaagaaagagaaaagaaagagagagagaugaaauaaagaaagaaagaaagaaaagaaagaaagagaaagaaagaaacuaaauugguuuugacuuuugaagucaaaagccacuguguauaauuaugagaaugucacaguuaagaguuuauguagaaugugauuuuuuuuuguaccaguugggaauucuuuggugucagguuauuuuuguuuuaugaacuuauuuuucuagcuuucacuuccugaaucacugaauauaaacuaaaaugaaugaacugaaugcuaauuauguuucuugcugguuaaauauuuaauccccaauuuucuauuuucaauaaacuuuuuuccuuuucuuucauuuuuaaaauuuucuuucuguguuuuuucuuucauuuuuaauuauuucuaccuuuuucuguucuuuuauuuuaggaucuggggauaccgaaagugggucaugugaagcgaauucuccagggaauuaaagagcuuggaaggagcacuccacagucggagguguaaucauauuggugcuauuucuuggaagagaaguuauugccacuuaauacaaaguccuuggaagcaaguggcuguucuuguaguuuucugcauagauaaguaagcaccacugaagcaccucuguggcuugauauuuugcugugggugaaauuuugauuugagguauuagaaaauauuuuugugccgaacaauacauuccacaaagccauuuucuuuuugugcaaaccugacauguucaaauauauucacaaugguaauaagguaggaggaaucugagacgauugcauugucuaaacaguggaauugcaaaauguuuacuuuccauagaucuggucugauggaauguuccuacugugcaacugcauaacaauaugugguuaaaacuuccuagguuucauuacgggggggcauuggccauuuucuuaaaaucauagguuaggagacuaaaauauaaauuaaguugugauuugaauguagauugguaucaccuccaacuccuagugcuuaguggucaaauauguugaaaaccuuuccaauacuaugaaugaaugcaaaucuuaaugcacgauguuccugccugaaaugucuuucuuuuucuugcaugucacaucuaauacuguaacacuuuaaauagcuuucaugucaguuuuaauguuaaugggauuuaauuuauuacuaaaguacauuuuuguugguuaagggcacugcacuuuucuguuuuuuaaugugggauuuugcguaaauauucuguaccuaagacuuugugaaagugugucugugccauaaucaacaaaugauauacaucacaugcaagucaauuuuauuucaaucuaucauaagcaguaggcgugcacguuaagaaaauucucuggauauuuucauaaaauuacaugcucccuuaccugacaaaacuuguuacagcuuuccaaaccaaaauuuccacauuuuguuucuaauuuuuaauuucaauuuaauaauuauuuaauauucuauuugaauuuauaauauaguaaaguguugauauccaggaauucccugaggugucaacugagauuuauauacugacagauaacccagacucacccgcucucuacagugacuucugacacgaucuuccaaacagaagggauuuaaauuuuuucuuaagggcuuuauguuguuauuauuauuaucucacuuaauucuuaauucuuaucagguggauauuauuuuccuuuuucuaaaccacuguacuucaguguagcuuauuauuagaagucaacauuacaaugaucaaaucuuugaaagccaaaggcauacguaucaaaaagucacaaaaauauccuuaaauaagcuuucuuuagccauuauauaccaaaacauuaauuauaauauuuuaaaauuuguauauaagagaaauaaacaggguacugacucaguggugacaauuuuuaugaaguagccugcuaggugcuuaauagauauauauacacacagauauauacauauacacauauauguguauauauacauacauacacauauacauuuauauguguauauauauaccuacauacauauaaccuugugauauggcaucauugauauuuucuagacaauuauuuccccaguguuuaaagagaaauacuaauaggcgagcauuuaaaaugaacuauugucaggcauauuauuuaauuacaucaaaggaguuuaacuguuugacacuuuacucuuguuuauaacuuggguauuuaacuacuaguaaaaaucacaaaauuuuaaugucuuuaaaauaaaugacccugagggauuccugaccaaguaugucugacuauauauuuuaccuaaguuguaaauaaauggaaauuuuccaaagacaguuauaucaaguaguuuaaaaagucaugaggcagggugcuguggcucacgccuguaaucccagcacuucgggagguuuagguggguagaucaccggaggucaggaguucgagaccagccugaccaguguaugaaaccccaucucuacuaaaaauacaaaaauuagccgggugugguggcacgcaccuguaaucccagcuacucgggaggcugaggcaggagaauugcuugaacccaggagauggagguugcagugacugagaucacaccacugcacucuacuagccugggugacagagcaagacucccaucucaaucucaaaaaaaaauagucaugaauuaug

SEQ ID NO: 17680 - RNA, 861 nt, Homo sapiens
gcguccccgacacccgacugggacacggccgcgggcuccuucgucccucaccgccagccagggaggcucugcaugcccacguccacuucacagccgaggaagcugcggcucgcggaggugccuggcacgcggcgggaagcagcagagcucgcgcccagcagucagcucuggugacgccgaggacaccgcgugggccggguugucagggcgcgggggcgagaggcggguaaauauuuggggcuguaaccggggcuucggcgacuccucgucaccgcgguuccagggcgggcgcguggcgagggcggugccugggggcaggggccuccucggagggcggcggggacagacccgucgccccggcuccgcagccccgccccggccccgccuccgcuccggccgccgaaggcuauaagaucuaggaacccgagccggugguagggcgggcgcggaccgugcugggagcggcgcggcuggagcgcagcgccgaagggacuggcagggcugaagugugcgggacagcaagcccccgaauagccccggcugccaccucgcaggacccaaggccacgcgcgccgggcccagcugagccgccucaugaagccgcccgcggcgcagggcagccccgcggccgccgcggccgcaggugagugcgggguccgggguccccuuaaagucucggcucugcagauggcgggugagaaaggaggggccccgugucgucccuucacaccccccacccuuccauccuccccggcgggaaccuguccccggucuucccgcgcgggcggcugcagccuccuuuccggcccgggcuggcccccaugucccaccuucccuccaccaccagcuccgcgcgcgccc

SEQ ID NO: 17681 - RNA, 715 nt, Homo sapiens
ugggaaaaaggccaaagugacugccacggugcagacaucaggcucaccugacuacgaugccugugguucuauacugcgucaggaugggaacaguggugccgauugcccccacaacugagggcugcugaggacugccucaggggugcauuugcggcucuuuuccuccugugguccauguggaaggagagugcuucagagaugacaaagaacaggaaaacaaaaauucacacaaaggaaaagaaaaguccccucacuaaggcacaucacacaaauaauccuaaaagcaagcaauaaaauaagccugcaaacuggccauagauuguuauacagaauacugaaugugagagcaaauauccugggaagacaaacuggagagaggcugacugcggaccagauccugauguuuuaaaggggaaagagguugccaucagcuguguguccucuuaggguggugaugaauaucaaaauaauggccuaauuagggaacauaaauuuugaauuuauguuaauagcaauaauuguuuacuaacaaucuuuuuccuucagacaaaaauauauagacaugucaaaagcauaaucacuugaggaucaguaaagcaauccauuguuuacaacuucugaauguaaagguuaaagaucaagaauuuuuuucacaaugaagcucccagagaaguuagaagaggcagaugauccuguguagaaaucuaccugcuuu

SEQ ID NO: 17682 - RNA, 4672 nt, Homo sapiens
cagcuucuguaagagacggagaggcgcagagugagggcggguccgcgcguccucagagcccgcuggaggcucggagcugcuacccgcagacuucucccgcacagggcucgcaaagagcgugauuccgagagccugagacugacgcccgaccuggaaaccagagaagacuuccuuagccuuucggaucgcacuugaggcuggaggcaugaguccugugaggcguuggggcagccccugccuuuuccccuugcagcucuucagccucugcugggugcucucaguggcccagagcaaaacaguccgauacagcaccuucgaggaggaugcccccggcacggucaucgggacccuggccgaggaccugcauaugaaaguaucgggugacacaagcuuccgccugaugaagcaauucaacagcucucugcuccgggugcgcgaaggcgacgggcagcugaccgucggggacgccggccuggaccgcgagcggcuguguggccaggccccgcagugcgugcuggccuucgauguggucagcuucucgcaggagcaguuccggcuggugcacguggagguagaggugagggacgucaacgaccacgcgccgcgcuuccccagggcccagaucccgguagagguguccgagggugcggcagugggcacgcgcauccccuuggaggugccgguggacgaggacgugggcgccaacgggcugcagaccgugcgccuggccgagccgcacagccccuuucgcguggagcugcagacgcgagcggacggcgcucagugcgcagaccuggugcugcugcaggagcuggaccgcgagagccaggccgccuacagccuggagcugguggcccaggacggcggccgcccgccgcgcuccgccacggcugcccucagcgugcgcguccuggaugcgaaugaccacagcccggccuucccgcagggcgccguggccgaaguggagcuggcggaagacgcgcccgugggcucccugcuucucgaccuggacgcagccgaccccgacgagggaccuaacggcgacgugguguucgcauuuggcgcccgcaccccgccggaggcgcgccgccucuuucggcuugacccgcgaucaggccgccucacccuggccgggcccguggacuacgagcgucaggacaccuacgagcuggacgugcgggcgcaggaccgcggacccgggccccgcgcugccaccugcaaggucaucgugcgcauccgagacgucaaugacaacgcacccgacaucgccaucaccccgcuggccgccccaggcgcgccggcaaccucacccuucgccgcugccgccgccgccgcugcacucgggggagcggacgcuagcucgccggcgggagccgggacgccggaggcuggugccacuucgcuggugccggagggggcggcgcgcgagagccugguggcccuggucagcaccucggacagggacucgggcgccaacgggcaagugcgcugcgcccucuaugggcacgagcacuuccggcugcagccggccuacgcgggcagcuaccugguggugaccgcggcgucgcuggaccgcgaacgcaucgccgaguacaacuugacgcugguggccgaggaucgcggcgcgcccccgcugcgcacagugcggcccuacacggugcgugugggcgacgagaacgacaacgcgccgcucuucacgcggccggucuaugaggugucggugcgcgagaacaacccgccaggcgccuaccuggccacgguggccgcccgcgaccgggaccugggccgcaacggccaggucaccuaccggcugcuggaggccgaggugggccgcgccgggggcgccguguccacuuaugucucgguggacccagcuaccggagccaucuacgcgcugcgcagcuucgacuaugagacgcugcgccaacucgacguucgcauccaagcuagcgacggcggcuccccucagcuuuccagcagcgcccuagugcaagugcgcgugcuggaccagaacgaccaugcgccaguccuggugcacccggcgccagccaauggcucccuagaaguggcggugccugggcgcaccgcaaaggacacgguuguggcccgugugcaggcccgggaugcagacgagggagccaacggggagcuggcguucgagcugcagcagcaggagccgcgcgaagccuucgccaucggccgccgcacgggggagauacugcucaccggcgaccucucgcaggagccacccggucgcguguucagggcgcuccuggucauauccgacggcggccgucccccgcucaccaccaccgcaacugucagcuucgugguaacagcagggggcgggcgugggccggcugcgccugccagugcaggaagcccggagcguucccgcccgccuggcucucggcucgggguguccgggucggugcugcaaugggacacgccgcugaucgucaucaucgugcuggccgggagcugcacgcugcugcuggccgccaucaucgccaucgccaccaccugcaaccgccgcaagaaggaggugcgcaaagggggggcccuccgggaagagcggcccggggcggcgggcggcggagccucggcucccggcuccccggaggaggccgcccggggagccgggcccaggcccaacauguucgacgugcucaccuucccuggcaccggcaaagcgcccuuuggcagccccgcggcggacgcgccuccgccugcggucgccgcggccgaagugccgggcucagagggcggcagcgccacuggggaaagcgccugucacuucgaggggcagcagcggcuccgcggcgcgcacgccgaggugaggccuuccuucggcugggcgccccccuccgagcuccgcggacaggcugggggaagggagacuggagggguagggugggugcauucagguagacaaccugucgcacuuguuuuuuguuuguuucuuauccaacccuccccccacucccauuccccuauucccugcugcagcccuacggugccuccccggguuuuggaaaggagccggcgcccccuguggcgguguggaaaggacacuccuucaacaccauuucuggcagagaagcagagaaguucagcggcaaagacagcgguaaaggggacagugauuucaacgacagcgauuccgacaucagcggggacgcucugaaaaaggaucucaucaaccacaugcagaguggugaggacucuucuuucccgccaaauucggcauuccucccuucccuccccuucaccacuguuugccuccucucaaucucgguucccagcccccuucccucuuccccacuuuuucucacuccuacagcugcggauacgggccugccucacacggugaauuucaaaaugccaagucgaggcaacuccagcucuugaauaaaacacacccucauccuguuaggcagcagcaugggugaugcuagccauuaaaaaguggguucugcuuaucaauuuuuuuuuucacuuccagcugaagaagcuggaccagcuuugcauuaagauggcuuuacaggaagcaaugugccuucgauucuugagacacgguguauaucuaugcgcacagccuuuccuuucagcugcccugacccaggcugacaugcugaagauggaagccugaauauguauaaucucaggaauaaucgucaugcuguuuccuuuucccuuucguauuaggacugugggcgugcaccgcugaguguaagauccugggccacucugaccgcugcuggagcccauccugcagcgggcccaacgcacauccaucgccucacccaccagcccagaugucaaccuucuguaagagcacgucacugccucgggauccucugcgcagggacaauuacuaccaggcccagcugcccaagacaguggggcugcagagcgucuaugagaaaguacugcacagagacuaugacaggacagucacucugcucuccccuccccguccagggaggcucccagaccugcaggagauuggaguaccccucuaccaguccccuccuggcagguaccuguccccgaagaagggagccaaugaaaauguguaaucccaugcugcaugucuucacacauauacaggucacuccgagaagccccuaaguuauugaccgguuucaguguuguauauauaaauaugcaagaugugccuuacaaugaaguuguuggaagcuauuuccaaucacauugguacuguuugguauuugcaaacaaaaauguaguuaauguaauuuuuaugaaaugugugcaguauuuaauuuuucuuaugcuauugacuuugauuucaauugcggcuugccauuuucuuaguguuuuuaaccuguacauuguguaauguaauguuuguauauaaugaaauuuuguuauauuuuuauauaauaaaagcuaaaguggaaguuauugccaaaggaacugucuguaagacaaaaaacaaaacauguuggaauuacuuaauugaaauuuaucuuucaccugaaacaaccuaguguuugagaaauuuugccuugccaaguauaacuuguauaucuugacucugugguagauuucaaguucaauguuauuuaauuacauuugguuuuccguaaaccgugucacuuauaagcacaguaauaaaagauuugucauguguuugaagaaucug

SEQ ID NO: 17683 - RNA, 869 nt, Homo sapiens
gugugugugaaugcgcuuccacgggcugagauguguauuucggugagugugugugaauucgagggcgcucgugagcccguuucugcccgcgcugguacgaacaugccgcgagcaacagcaaucaauauguaacuuucuucauccucugagaaaaaucagcuguccucaggcaccuaugcaaggaaagucacuuaauuaugaaaguguuucagaagaaaagcagacucccguugaaagagaggcuaugucucuuaagagaaauagagccucuccuuuaaggagaaaggcucacugucaauacaagcuuuguaaacucaaauccggcuaaauacuacuuaagguucuaccccuuuuggucauccuuccucaccaucucagcccagguucaagguaaaguggauacccaccccccaacccccgacacacacacacacacacacacacacacacacacuaguuucgguguuuuguucaccuccauucuuguuauuaaagugucacauugcaauuugauuuuuucuccuuaagaucaaauagccauugauaaccgcauuugcuaaagauccaugaaaacaaaaguauaaaacacgaaggccaaucauuaggagaucuaagauuucuguuuuguaagccauaacacacacacacauauauacacacacacacacaccaccaccacacaccacauacacaagcacacauacacaggccgacuucugauucaucuauuuauucuccaacuucauuuacuaaucucagagagguuuuuuucccuaaauauuaucacaaacaucugcaacuggagacugguuugcucgugauccagccguucugagaaagaguuaagaacaaaaaagaaaauugaagua

SEQ ID NO: 17684 - RNA, 899 nt, Homo sapiens
ccuaguauccccaggcauugcacagaaccugacauaaagaagguuuucaauaacuguguguugacagguagacagagauugacugauacaucacaauucuuaccagaaacugagcugaaaagaaaagaaauugagcuauagccagaggggaauguaauauucagaaauuuuauuuucuuguauuucuguauagaaauugaaaagcaguuuccaguauuaaaaauaaagacuaaaauauauaagacauugguaaagagcuacauuaugaaacaagguguuaagagaugagagccuauaguauugaaaguaaagguguggcagucuuauuuacuuagccuggagggaagaaauuauggcugggggugauacagauaaggcaauaggugggcuauuucucaguauauaauauagauauuguauuucuuaauauagaaagcaaaacaacuuucugaauguaaaaauaggggguggcuaagacuaugagaauaguuguaagaaagaauuauagauaacaggcaaaaaaaugauaugcagcacugaaguucaaucuaagguuagaaauaucaauuuagaauaucacccacucacaaagcugaguaauuucaaggauuagauauaccggagaagaagauugauuguagauaauucuaggauuagguauuuuggguaaaagaggaaugaaaacuaaugugcaagguaaugaagcaguucugaugaucuuugucuaugaugcugaaguaggggaauaaagccaggagaagaaaaccuuuggccuugugggaagggaauuaucaacaaacuggagauuuugaggagguuaaagaacaacuguuaaugaaccgaagguaugagauggaagggauaagcaauuacaucaggaagugauauucgcauuuuau

SEQ ID NO: 17685 - RNA, 487 nt, Homo sapiens
uuuauaaauucuugauugguuggugagaccaauagcgauacuuuuucuugucuaauuugguuuccgggaaagcuucguucaagucgucaauggucaucugaucaaaugguauuaaguuccucaucuucuccagcuguuucucauauucuccaaccuggccuuugagagagacacccacucagcacaaguuuucccaucuucuuuuucuucagcauccaccugggcaguauauuuauccucugguacaggaagcuucaggacauuaaacuucuucucaaagucauccaccaagccugccuuggccacauuggccuuguaguaaguccagucaauagcugguggauucucagguaaaguagccagccuggaggugagggucucauuccaggauuucagauaauuagcaauggccuuuugguuuugggguaucaucucugcaaaagcuacccagucaaugguuuuuagagcaaguuuucacccagccauc

SEQ ID NO: 17686 - RNA, 883 nt, Homo sapiens
uuuuuuuuuuuuuuuuuuuuacaaauagcacguuuuauuugccacuauuugaagucugaacuuuaaacagauucuuggacuggugguucauauccaucagcucguucaacuuuagcaccugucucguccccaguggcuuuuccagaacuacugccuucaccaugaagcuccaugagcuuucccaauucaaacuugggcuucuucagcauuuuuacuuuucuaacgaagacaucauggagaggauaaauagauuggcaagccuuuucuaugucuuuuccaaugcugucuggaaucaauuuauugaccacuucuuucaagucauuugucugcaccucucggaucaugauuuccaucaucuucuuccggauuuggcggaccuguuggugcugagcauaagaggucuuccguaucugauuuuugcguuuuuuaguaaaaccaacacagaacagacgaagcaaguaaccaucgguagucuugacaucaacgugagcuucaaucauugucugccauuuuuugaccauggaacacauuuugucacggguaagauccaugccauggaaguuagucaggcaguuuuuacccugaacaucuucaguaaucagcuugaauuuucuaaaugcaacuucaucauucugcaaaucagcaagacucacuucaaacacacgacccuugagaccaucagacgcaauuuugguuccuuggguccuggugacgagcgucuuuccaauauuucuuauauugaacauagcaggugcuuucacaucauaccaaucuuucuuagaaaauggaucaaccacuuucuucuuggcucccuuuuugccgccuuucguaaggcgcuuguucuugccaacagccauggugcuggugagagagccaaaaagcg

SEQ ID NO: 17687 - RNA, 15979 nt, Homo sapiens
uuuuauggagauuuuuuuucuuuauugggaaacguaagacuuggguacaucaaauaaaaccaauuucugggggaaaaaaucaaaacccacaauaaaaaaaaaguuaacacugucugggccacagcagaacccaaagaacauauucguauaauugaaaaauucuaggugcuucauaauugaccuuuugauacaaaaugaccuauuaaauuugcaauuuguaauccuugguguugagguccauaggacaagcuaggaagucuucaaaccuugaguugaauuccauaagggguuauuuggcuuuugaauccuguaaagaaaagcaccaacacaaauaaaugcauaaucaaauaauuuagauucauuaacauauaguggauaaaggaagguauucuagaagagaguuucucaaccucagugcuauugacacuuuggacauucuguugggucuguccuccuguguacuguacaacauuuagcagcaucucuggucuuuaccacuagaugacaaggcuccugaggcccuugacaagagggucaugacuaugccaagucaacccucccaacacaccagcucugguccuuaccaugugcuuuuuccuuagcuuauuuuacugucucuucuuucccuaucuggagacaccuacaaccaucaaccaguacuaguuuuauuauucacucaagcuccugcagacaaaguccacaguccucaugauaagaagucaccugcaacacacuccguguaacuaacuguacuuauuguauucccagagcuaagcagugagcauauauacaaccucaggucaaaccacaaagacaaugcucauaggaacaaugcucauaggaacaaaaaugaaaauagccacacauacgguuuuuccuugucuaagagguagcagcagcaacagcgcccaccuucugggcagcuucuuucuuggcaugaugagccuguagaacugcuacagcuucauccaccugcgagaaaucuucagguggucagugaaucuaggagagcuacuccaccccuccccagugcccagaccuagugguggaccaaagccaacuguacagaugaucccuaggcuucuggugcuaacuacuuucccaaauacccacugcagccuccagucacagucaaggcaugacgagagggguccugggggcagcagaucccacuuucugcugcaccugggcauccaaguuugcccccagucuucccaagcugagaacugaagcugcagggucugagccccagcucaccuuggagcggagagacucgggggacucuaacaugugcagcagcucagaguugucuaucuccagcagcauucccgugaucuucccagccagauuugaaugcauuguuuggaugagugggaacaagcguucuccuauggggaggauaguuaauaaaaaaacaaaucaaaucccaguaaacaauggacacugguguccuagcuggcaucaggcucugggacccucuucuucugcaagcaagugggucacucacccagcaucugcuucuguuccugggggggugcugcagccagcauggaggcagucaguggcuccugccccugcacauggaccgcaggcuggggugccugggaaccaggaaaggcaguggguuagcacugaggaaaggacaacaccugauggugguugagugccuguucaauaucugaacaucugacuaugugaaagaggagaggagguggcuguccuugcucuaaaggaacuaauuucaguccuugaaggauugagggguguguugaggaacagagugguauggacauaaacacaaccaauuacaaugaaaauggcaugcuaucagaaagcgaagugaaacguaaauaauaaaacaaaccuauagugcuaggcaagcauuuucugacauuuccuuaauacacccaaaguuacucaagaaugaaaagccuugauauaaauaaggguaaacacuuguauauaaccuuuuccugaaaauuaguuuuccuuuaggguaaaucucagugcagauuggaucaaagggaguaaauaucaacacauuuauaauuacauuccacaucaccuuaauucuaccaaauguuuuuguaucaaaugcuuaaaaacggucaacaugcaacgucaaugcuagucaaagccuugcaaagaaaagguauuuuacauagcaucaaguucuaggaaauccccaacuuagagaguaugagacaggacaguuaaagaguaaucuccuaagcagcuuaugggccugaaggcuuagggugacaccuccacagcaaauugcuauuaggcucugaaacaaacuaguugcaucuagagcacaggucuagagacagcaaguuacagcuuagaaaaucuaagcucuagguucaaccccuucaccuccuacacacacuuuacaucuuugaagcugaacauccgaucuguaaguugaaguuauuuccugcauuaauguaccaaucaucuugcagagcagccaaggauccaauaggucauuggaugcggaagugaccuggaggcucaaacagcugaaugagcacauuauuucguacaaacagaagaggaagcacuggcugcccgcucugaggcauuucugagugaacuggcaucaggcagagcacuuuuaagccccuucuuucccacuagugagccccugaagggcagggacagugaaucagaacauagcgucauaacacagagcaggcauuuaauaccuguugaaggaaucaaaagcacagcuucuuuuacaucaaguggaaaugggggaaauccuuuuaagcauucugucuggugaaccucaccugcagaggcuguauggcaggaugagggcugcggacacuggaggcguauuuguagggggcaacagcccggggagcagcagcagcaacagcagcgcguggcgcuaaguucugcacagcugugggaacgccuuagggaaagaacaaauacaauuaaagcccaucagucugggcaaagacccgucaaaucccaucuuucccccuucugugugcauccaauaccaccuccagacuggcagcugucagucagcccuugcugggcggcaccagccccaccaaaguccauagccaagcgguccgggcacucagacccuacaacagaccagcaaaugcacaucaguguuggcggcagauguccaacuggccacgucccacggaaggagaaauuucaaagcacguuuacgcaacacauugcacagggggccacuacuacuuucgaggaugagccaaaggauaacauacaacucuuuccacaucuuggaauacaagacauauucuguauacacuguuuccuuguauuccucaccccacccaaaagaacaagcugccucuguggucauccagcuagcaaacuucuacaacuaaccuuuuucacauaggucaccgaugagcaaagaauguuaaaagcaacugacacaccuagaacucauacuguuucucugcuccugaaguggccaccuaagcacacagcuaagauuacagaaccaggacucgauaaauucgagcccaacaaacugaccaacccaggacagagccuagucauccugacucccuccuccccaggccacacuucuaaaggccaguuugcucaccgacucucugagugguaguagggaggccacgagaggccggagcauuaccaguuggagccagauggcgaagaguuggacgaggcccagacuggcguauagcacuuggcauuccuuggaagccuggugaagagaaaaauugcacaucauugagaagugauguggaccagaaccuaggcugugccucagaguggggaagaaggaaaggcaggggagaccaggacagguauauccugggcugucaauuacuguuccccaccaccuaccuugaggucucccaccuugcugccagcguggauuaggccucaucugugcuaacugguuagguguauaauauggaggccuucccugagccuguaagacagaagaauacccaaacacccccuuaaggacugaacccauccuagagaaguaucucaucucaucucacuaaccaggaccuaagcuaauuauuuaaauguucuuucuauucaagagcugaggggucagcuaauggggacuguuuuaugcuaccacugccacuguggguguguguuugugaccauggguaaguccuucauuuuuacuugaaggguccuuauugugacauucuagaacucuaauaacgaaaaaucccucuccccaaccacugcagaauacugccagccggcagguucccaagagcugugaccaaacagcacacccaccugugggacugcuggcacaaaguagccacccgcugcaggcuggaacugauuuaagauggcauuggcaggaagugcucucauuccagccacucguugcauauacugguuggucaggugagccuuucucucuuccuuccucugggccagggcaacauauaguggcuuggagcccacaaugcguccauucaucucagugacugcuuugguugcuucuucaggagaugagaagcagacgaagccaaacccuuugcuucuuccauccuccagcauuaccuacaaaaugagaccagcuacuuaagaaauaaggugucccuggcugggugugauggcuugugccuguaaucccagcacuuuggaaggcugaggugggagggcugcuugagcucaggagguugagaccagcuugagcaauguagugagaccucaucucaaaaaaacaaagggccaggcgcaguggcucaugccuguaaucccagcacuuugggaggccgagguggguggaucacgaggucaggaauucaagaccauccugaccaacauggugcaaccccgucucuacuaaaaauacaaaaaucagcugggcgugguggcacacaccuguaauccuagcuacucaggaggcugaggcaggagaaccgcuucaacccgggagacagagauugcagugagccgagaucgcgccacugcacuccagccugggcgacagagcgagacuccaucuccaaaacaaaacaaaacaaaacaaaacaaaacaaaacaaaaacaccaaccaaccaaaccaacaaaaaaaacaaaacaaaccuacaaauaggaaaaaaaaggaugucccuggguggggagggaacuauucagaagaaccagaaagccuggguucugcugcagucacugagucuaggucaggguucuggcacaggauuuaccccagaccaacuaagucacaaccucuaagguaucuagguguuuucuuugaguccccaggugaugcuaaaguucugaaacacuaugauauggcuaauaauaaaaccaggaacucaaagauguuuccugauaccugguggauagcuacuccggguaaccacaaaacaucuugagaguaguacugagcaauuuauuuucauaucucauaugcuucaagaccucgguggacaaacucuaacaagcucuuaccaacgucaggauaacacuuuuggaauaccacguguggacaggaguccuaaaauguucagguaaccaaugacugccaccauuaauucaaugagaugaccagcucagagauaggcagccuagauucuagucucacuugccuuccugaggcucaauuuccaagaaauacuccaaacagcuacaaaaccacaggucuacugguucaggcagucuuuucccacauuaaguucaucauucacaaauggcauucuuccuaauagacaagguuauucacugucuucucuggugugacugucauuguuuuaugucuuaguuaauggcccagagagccuccugaaguggaggauagggaaguaaagaagugcaucacuccauaacucucuaccaaugagaugggccaguaagguaugugaauaaaaaugccacaccaucauaaugaaaauggggacaauucaagguauggcucuucugcucucuuaacaaaugccaacuugacuacuaggcagauaagcaaggauagaagaucacuccuuacacugaugagggccagucaaggggggggucauagcaaaaacgaaaggguaagaacugggcaaacccacaguuggccucuggccaacucccuacuacaacugauaacauugcuuuccacauucccagguugggagcaaaguccacuaagagccagggcagggccacuaagcccuuaccagcccacguggcuucccuucucaucaacuaaaggauuuuguggcaucugguacaccuguuuagcaagaccggcgucugcauccggccauaacucaaaauguucagauggcaccaguuuccauccugcucccaaagugccaaggacaagcaguacaccauccccauguagucagcauucucuuguucaaggacuaaaauuccuuaucuuuaaaaugagguuccuacuuacccugcuaacuuaguugauaugauuaucaaagaaaaucaagcaaaugaugcacacuacgaaacauagaaaaaccuuccacuccccuuuccucucuuuuuaagaccaggguagaaguucccaagcccaccuccaaaaucuucaaaauaccuucauucucaaggagaaaauguggcagagcuguagagacaggccccaagacaaauggaaaacaaccugucuggauuuccucugcucauucuguagcaccaucuguccccacaccggcacgaggcagcaaggaaugggaaagauucaggugcucugaguuggcaaggaggggcugggucaaauuccucuccagacuccagugcuugggaaacaguguaauguuaaccuaaugaaaugucauucuccagaaugcauccagaaauuuugcuagaaaaacguaguagcuacuuucagaaaugaacauaauuuaaaugcuauuccuucaaugggacaaaugccaauaagccuauaauggaauaccacugcuuucaauccccagaucgcaguauaauaccuuagcacugguaauugauccaaaaggagaaaauucuuuccuuaauuucucaucaucaauagugucauccaaguucuuaauguagagauucacccccugaaggaaaaagaucacuguuaacuacacuucuauaucacaaauauucccuaagaaagugguuccccaaggguggccccagaccaggagcaccagcaucuuugggaacuuguuagaaaugaaauucucggccggacgcgguggcucacgccuguaaucccagcacuuugggaggccgaggcgggcgaaucacaaggucaggagaucgagaccauccuggcuaacacagugaaaccccgucucuacuaaaaauacaaaaaauuagccaggcaugguggcgggugccuguagucccagcuacucaggaggcuaaggcaggagaauggugcgaacccgggaggcggaguuugcagugagccgagauugugccacugcacuccaaccugggcgacagagcgagacugucucaagaaaaaaaaaaaaaaaagaaagaaaugaaauucuuaggccagaccccaaacccaaugaauaagaaaaacucuggggcuggagcccagcuaucuguuuuaacaagcucugcugaugaaucugaugcaaguccaaaguugugaaacuacugcccugaaacugacaggaucaucagugcacucaccuuuugucaccucuccccacagcuguucuggugaccacucacccaccccagcaggggucuucuugaagccaugccaaacaaaggagucucauuuaaguaaaaggaaccuacauggcuaaaagcaacaggcugaggcuuccaaaauagagagcuucuugaugaauaaacccaucucuuguuucugguucuauaauaaucagucauauguaguagguauauauccuuuuaaaccucaucuuuuuagguaaaaugggaagaagaacacacuccaaguccucaaaaagaaagcccgcuaaacauagggguguucugcaaauauuucacagcaaaucccauugcuaggcugggccaagaccaccuuaccugauaucgacuaauucucuccuguuucaacuguucaaauuuccguuuuaacucugccugccguucuacuuucuuuugugcacggccuacaaauaugauuuuaccacuuauuucuuuuccauucaucucuuccacagccuagagaggaaaaauaugucuuuaaaauaaaguugcagcgauggggucuuauucuggaggucuaagucccaaaaaauauucuuucuacuauaggacuaaaaacuaaauucacuccaccucugaagucugucacacaaauccaaacuuccucaucuguaaagugagguuaauauuuaaauggguuauugauccagauaauauagaaauaguacagguguauaaacacaagugugcugacaugagccuagggcgauauaauauuccggcugccaguaaauucugcaggugcuuuuguggguauuuaagugauaaauauugagggucuggcacaaugcuuugcccacaaguagcugccgugcuguuaucaaaucagcacucacugggcuuuaguucucucaccuuugcagcauaacaaacgucuguccuauucuuucaacaacugauagcugaggugacagguaugugccaagugcuuuguaaacaccuacaugaaguuaacaugcggaacccaggaagaugaucccagaguauaguaaugguacaucuacuaccagauacucagaccgucccagcucuagguaggugcuagcaagacccuacccauacucuggggcaaccucuuaaaagcuuuucccaaucuuugugguauacucaccuuauuggcauccucguguuuuucguaacucacaaagccaaagccuuuggauuucccauugggaucucucaucaccuugacacuuagggucuuaccuauuaccaaaggacagaacuauuaguaacaccaucuugagcacagcucaggaacagaaggcuucccucuggaaacucacuugaagcaaaucucuggagcagugcccucaucucuuaagaaaaaacagaugggucugguagacugugaaaggagacaaggaaccccaacuuaccaaacugacugaauagcucuuucagacucucaucauccaccucuuccccaaaguuuuugauauaaacauuggugaauuccuuggcuuuggcuccaagcucagcuucccgcucuuugcgagacuugaaucugcccacaaaucuaaaaugaaaccaugaagaacaguaauuacccagaggaauaaaacaugauguccagggacccaaaggaauacagguuaaagacugacaggagagguuaaaacacgagauccccauccaccaccaaggaggcucagagauaccccaaguccccagcagaaagagaaaaaggcaggacuauccugugaggaccagccccagggcuccuggcuuagaccagggcuauuccuaccacaucacacugccuucaugaagaaaccugauggccauguuuuuaaaauguucauuucugugcaacuauguaaaugcauagaaaaggucuggaaggauacaaaccaaacuguuaacagugguuaauccuagauaugagauuguuggagugaaggggcacccuuugcuuuuuaaauuuauuuauuuuggucuguuauacuuaaaagaaaauuuauccaugcacugacauuuuuguauuucuuuuuagugauaucuguagaucaaccacugcacacacagacauuauaaagauaacccauccucuggcauacugaaugacacaaaggacaaaaauuauuuuggcuuguaauagccaagacuuauugucucuucuucuccccauauggcuuugguaaguucccccucucugcauucuacaguaacaaccacaucaaagcaacaaggucuguuaugaaguuuuucugcaaagggaugggauuuuuucauugucaccaaguauuacuguggagccagccuuguauuaggucacugagucauaaguuagaaaauggagaaccgcggggacaauuuggcaucaaccacuagcgagggacccauggacagaccugaaucacaggaaagccaaggucacacugcuaguauacagcuccuggucaguccagggcccucuccacucugccgcuggccaagaccccgacucagagugagcuuagagcugcuuuccagccagccccaguuguugaugcucacaaaacccacagacagaugccuuuaagggagaggcggcaggcaggccauggcuugggcaggaagcccaccuuggcgagucaaaagggcugccacggcucaggcagggagacucaccagcccuggaguggagagguaggagcaggccacacuugggccgagaaccaguagccgccuugugugugccaguuaauagcgagguggggccacggcuggcucaugcgaugguuguugcuccggacugggacacucacacuuugcggucauugaggagcaugccauucaucuucucgauggccuugucggcagccucuugggucucgaaguggacaaaggcauaacccuuagagccguucucaucacacaccaccugucaaagacaaggcggaccacuuuagcagaacuggccagcuccugagacaugagaaccucaggguaucuugugccugaggagacucuagcccauccauggccaaugguggucaaguacaccaguauaauuuuucuaacaccuagcacagcaccaggugccuaguaaguguuccauuuacaaagguagcccuacuaagaugcuucuauuccaaauguuuuauuuuuaucaaaaacaaacaaacaaaaaauacuuaaaauugggugcuguggcucaugccuguaaucccaaugcuuugggaggccaaagcaggaggaucguuggagccagaucguuggacaauggagacccugucucuacaaaaaagaaaaaaauuaaaugagugugguggcacgugccuguaguuccagcuacuugggaggcugaggugggaggauggcuugagcccaggaggucgaagcuacaaugagcuauuacuagaccacugcacuccacccugggugacagacagagcaagacucugucucuuuaaaacacaacaacacauuuuaagagaucugggugcaaaccacggugaugcagaaaacaaaacauuuuccaaggccacaacagauuuucaguguaguauggcauuaaacauauacaccaccaccguuuaaguuuuaaagugcucagcauagaacagauacguagaaggaauagagugaauuuaugcuucuaaagugauuaaguuuccucaagacuagagacacuucucugguccucuacuuucccccaucccaaaagaaaaacgugggcuuuccaaagcuaaagaauaggaaggauauuucaggcugaguaaagaacaaggguaugaaagcgugugcugguuacgcuggguauggcccugagauuaccuaugggaacuuuuaggauuccauguccagcauuuugaaaauucccauaucuuguuccccaauuccaagauaguucucuguuugguauuuaucuuguuuucaagaaucaauuaauuauucugcuaaaaucauuuaaucaauguuuaccuugcaggacaguauguuuccaaaagcagaaaaaguaucauaaagugccuuguuaucuauagauuuguccagguucuugaugaagacguuucccacaccagauuuucucaaagagggaucccucugagaccacaugaugcggauuggcuuucccuuaaucacaucaaaguucaugguguccaaagcccgcucagcuguaagagagaaacacauuucaauaaggagagaaaacgucagcucccacaggccaacagccuaagaacagauuacuccaggacuuuucaagguaaucacucuugauaaaaggcaacucuauuaaaauaaaagggcaucagauuccuccagccugcacuguuaguaagggaagcauaaguuccagcuaaugacucuacuucaugacagaagucuaaacacccuucugggucugugcccuuguuggauaaaggggccacaaguaaagauaaucuaaauggccuuaaugacaccaagauccagugauaauaccucacauuugacuaagcuuuaccacuuagaagagacuuugcagacuaccacccaccaugacucaggugggacagcugaaauuauacauuuuacaaaaugaacaaacuuauguuuaggguaacuaagcugugcagcuagcuaguaauuacgaaacuaauacuagauuaucugauuuauuuuucagugagguauugcaucaaaguuaucaagucauuuagucugcaauccaccuauggagacaagugacaaaaccuguaaagcaaaugaucuggaaaaaaaaaaaaaggugcuaucccugaauucagaauucaguccaguuuauuuucaauuucugagaacagaaauugacuuaaacaaaaaagcaucagucaucaaaauggacacaacugaucacacauggaaaaguucucuguacuaucacaaggauaaaaccaccauaccuucugccuaaguagacagugcgcagauggcaggcccugcacccaccuuuugaagccuuaauggaaguucuguagaauucuaggacuucagcuacccugggugcucaaccaacuuccccauccaacaccuuggaaugcuuccuuagcuucccaaccaaguccguguguacaccagagacaauuuaaagaaccaaaggcugggcuggguaugguggcucacuccuguaaucccagcacuuugggaggccaaggcggguggauuaccugaggucaggaguucgagaccagccugaccaacauggugaaaaccccaucucuacuaaaaauacacaauuagcugggcaugguggcgggugccuguaaucccagcuacucaggagacugaggcaggaaaauuguuuggacccaggagucagagguugcagugagcugagaucgcgccauugcacuccagccugggcagcaagagugaaacagugucucaaaacaaacaacaacaaaaagaaccaaaagcuaaaaaauaacaccaccugccagccaaaacacuucucaucacuaaucgcaacaaggaugcccagaucugguggccacuuuuccuuaaggcuaugauggcaucuccuaacggugacaucacccagaaccuccuccaugaggggauuuagacagggucagagcaguggaaccugcuccuugccucaggacaacaucucacuuaaaggggggacaaaauuccccaacucugccgcuccacaagcucaacuguuucauuagccgggagaauuuauuuucacucauuauuuccaacaacuuuccccacccccuucagaaggugggccucaucugugugggggguaguugggaaaaggggagaugacaagaccgauccaagucaggaacaguccagggaaagaggacuuugcuugugauggcuaucagagauagauagcugggaucgcaaacuauuucauuaauuagcaguaaaggagcccacuucaacaacagcuccucgucuauuuccagacagcacugcacaaggcaagccggcuuagucugacaaaucuggcugcacuuauuuauagcagggagaaguccugcagaaguauguguuggcagacacacugaccaauagcuucugcuaucucuaagugacacgacuuuuguucaaaagucaguaaggcagacaacagcuaaugugguacauuaucccuuaaaaagaccacacucagcuaccuuugcgcuccuauggccauggacagaacucagcuuggagcacacuggauugacaguagcaauaccuagucccucucaacauguccaauucucuggucucagccgcaaccugggcagguaguaacucugggccucagacagaaaacaaaggggggaccccaaaacuagggaccuggagaugcuuugccauagaauggcuuguuucucccaguaaugaucucugcaguuguucccuuuuaaucuggagucacgugcagccucugaucagguuuccucuggccucccuccugccacgccugcagcauaccucucuccaugcuccacgcuaaggccacaaucugagguggcagagcacugugcugggaguccuaacuuggcuuccaacuuuuugcauucguucuccuucucaggagucccauuuucuucagauuagaugaaauaaaagggcucugacuagugcaaagcacuguuacagcugaggugacaaaugacaccagauuuucaagugacgcuucccuaaacuaccuccacgacacucuacagcacagagccuggauaccauuuguccagaguaaagcacuucuccacuccaguggcaaacacacagaccaaggagguggccuggcacacgcagcuuuuguggcacuaaccuaagucucugcgaaaguuuaacgcacagaaaccuucccccugcuuccugccugcccugacugauccuuuaucagcacaacaucagguagucaagguuaguaaagguggcggagcgggcaggagcuuuacaauguaaaacuuucgcggggaauuguguuucaaacgucccgccuuuuuggccagccugugaggggcacaagcaaggaucucuaacagcccagccccacugacaaggaccacacgcaguggaaugccaguggcuucacucuaauccuguuuuacagucuccuugguuuccaaccccacuaccagcaacacuaauaaguagcccaaggucacccaguuagcaagugguagaaacaagauugaaacucgagucaucugaugccagguccgcguucucaaucuccgcacccugcucccagcuucgguggcaacaugcugucgugaugccgcccuccucggcaggagggcccugccagaagacgacucccgggguccuccgggcucccacgcacgugugggcacagcuucuacucaccgucggccggcugcuggaaguugacguaggcauagcccagggagcggcgggugaucauaucgcggcagacccggauggacagcacaggccccgcggggcugaacuuuucguacagcauggccucggugacguccgaaugcaggucgcccacguacagggaggccaugggguagcugcuggccgcagcguucaucuccccgccccccaccaccccgagccccgccaggaggacuucuuaucgggcccgccgcaggacaaaggggcgccuucggagcccgggcccgcgccgcggcucacagguggcaccggcgcggcgaggacgagcuggagucggcgggcuuggagacgggacggaaacgggaggcgggggccggcucccacggccgcagcaccgcagacaaaaggcucuccgcacaauacggcccuccccgcgacuuugcacuucuccgcgguccuggugcgaagcuccaaauuucaaaaaaucaaaguaggaaaaaaauuaaacggggaauccccuuccgaaggguaaaaauccuuuaagaggcgaccggacgcugcccacggcggccucggggacacgcguuucucuauaaauauaggccucgggcuccggcgguuuaagauuacaaccgccggggcagagggaaaccaaaucuuugugggcgccgacucggcgagccccgggcgggcggcgaagggcagcacggacacguggugcgccggggcaggcgcggggcgcggggcucggggcccgagcggggggagggcacggcgggccgggcgggcggcucacccccggaccgacggacggagaccgacggacgccaagcgcugcggcggcgggcgcggggcaggccggaagcguacgaaagugacuuccccgcggguucuccgaggauucguuuuuucuuuuccuuuuuuuuuuucaggauuuugaagcguuuucagauuuuuuuuaucuuuuucucuuuuuuuccucaggcugcgaagcccgaaagcggcggaggcggcagcgacccggggcggagagaggcgg

SEQ ID NO: 17688 - RNA, 1836 nt, Homo sapiens
caagccauuuagagacaagccuggaaaaugcguuggaaggugaaguuaguuguaauacucauuuuugucuacuagguacgaucacaaaauaacaggaaagcauugugucaguaggcuguucacugauucuuaaggaaguuacaagauauauuucauuggaaggaauuguaaaaugacuacaauaaucaguacuaugcaggacuaccuuuuauauuugugcauuacuuuugaauuuuguucaacaugaucaauauuacauguuaggaucauucagauguagugaaugagaguuuauagugguuuacuuauuuaaauauuugacuuuuaaguuccucacaauauauuuuuuucuuuuuucuccugucagauggauaguggcuauaauacgcagaauuguggaagcaauauuauggauacaguuggggcagaaaguuacugcaaagaaagugaugcacaaacaugugaaguugagaguaaaucucaagcauuuaauaugaagguacggagaaaauauagugaaagcuuaauauuguuuagauuagaaauauaaaauaauuuugauuauuagacaauaguacuauugagaaacuauaugaaauuuaaaacacuaaaagguaagccuguuuucuuaacauccaauaaccuuuaaauauuuugguuacucugaauacacaaguaucuuacauacuacaaagugugcaaagguagcguguauuugaugagggcauuuacugaaccuuccagguggugguuauauauucauacuugaagaaacucaucauaauuucaggcacuagucaggacagucuuuaauuuuaugugccaauuuuuuuugcauuuuauuuuuuuguagagacagggccugcuguguugcccaggcuggucucaaacuccuggugucaagcagucuuucugccucagccucgcaaagugcugcgcgauuacaggcaugagccaacaugcccagccuuguaugccguuucuuuuuuuucuuuuuuuuuuuuuuugagacagggucuuacucugucacccgggcuggagugcagucguagaaucagaucacuacagccuuuaacugcugggcucaagcaauccuccugccucacccuccugaguagcuagaacuacaggugugaaccaccuugcccugcuguuauaugccaguuucuuauaaaauacuauaaauaucagcaaaugugcaacaaauguuuaauagggaggccaccuuaguuuuccuuucuguuguauguaguaggagcaaacugccuuucuguuguauguaguaucagagcaggucucuucuaauauuaaccugaacaaaauccauccuauuucaggaugcaguugucuaucuaaacauaaguagagauaaaugaaggauuuuuuuaaauuuuauuauuuuauuuuuuuugagacaaggucucauucugucacccaggcuagaguguaguggcacgaccacagcucacuguagccuucaccucccagacucaagcagucuuaccaccucagccuccugaguagcuagggcuacaggcaugugccaccacacccagcuuuuuaaaauuuuugguagagacagggucucacuauguugccagggcuagucccaaacuccugggcucgugcgauccucccaccuuggccucucaaaguguugggaugcuuuuugaugcagaauauugauuuauaaaauacuguaucuuuacugucccuucagaguucagcuaaagaaacgugcuuuuagguuuuaaaaacagucccgauaauugcauccuccagugguccuacuuaaacugaaaacaagguauugucuucuuuuucacagcaagacca

SEQ ID NO: 17689 - RNA, 18566 nt, Homo sapiens
ugaaauagaggcgggcgucaagugucaguagucgcggggcagguacgugcgcucgcgguucucucgcggaggucggcgguggcgggagcgggcuccggagagccugagagcacgguggggcggggcgggagaaaguggccgcccggaggacguuggcguuuacguguggaagagcggaagaguuuugcuuuucgugcgcgccuucgaaaacugccugccgcugucugaggaguccacccgaaaccuccccuccuccgccggcagccccgcgcugagcucgccgacccaagccagcgugggcgaggugggaagugcgcccgacccgcgccuggagcugcgcccccgagugcccauggcuacaagggugcugagcaugagcgcccgccugggacccgugccccagccgccggcgccgcaggacgagccgguguucgcgcagcucaagccggugcugggcgccgcgaauccggcccgcgacgcggcgcucuuccccggcgaggagcugaagcacgcgcaccaccgcccgcaggcgcagcccgcgcccgcgcaggccccgcagccggcccagccgcccgccaccggcccgcggcugccuccagaggaccugguccagguaggaagagccgcuccccucccaccgcagcacucccgggcucgggcgugucccguugcugcgacucgcgggcgacaggggccgcuccaggcuggggcgugcgucggggcgcaccggagccggugcugggugggcagccccgcccugcacgccuggccggggccccgcguuucgcugagaguaaaugggggggggggccgggggugggaaggauggaggggaaucugccccggcgggucggccugggagagguaagagggagggaacugggugcucacgcgcaccuuaguuguuuuucuuacacuugagggacgaaaccuuguaccuuacgcucaguuuuacuuaaauuacgccuucgccuguaccgcucuccaaugccaaggcauuggagcccucccccccauccccaucgucucggguuaaguagaaacgcaaauuggggugcuggggagagguuccccaagguuucauacccgguggcucaaccugcuuuagaagcgauugcgggccgcguuuggaaaaugagaguuaggaaagcuaagguugugucggagcgcuuauuuuuccuuaaaaaaaaaaaaaaaaaaaaaagaccggggguguuguuuucuucgugugcacguaaauuuccucccggagccgcguugaaagcuggcaguuggcuuuuacacuugcccagcagccgaauuagagcaaccgccuguuucuuucgcccacgcagggagucauauagcccagaaaaaacuucccgggacuuuuagccugucccaaggaaaaaaaaauuggaaacauacccacaugcaaacagcuggaagagcuaaaaucagaaaccacuaaccgccgcgggagcgcagugcacgaaaggguuuaguucaguuuauuucaagacacuucauuuaguagcucuuuggcgugucguauauuugcuacccagcgccuacuccguggggucugccagggucuugcugugagagggcaguggcguuugucagagaugugacucacaugaugagagcguuaauuuuuauuuuuaaaucaugucuauccgggaaaccccguccgcauccacaccaagguccgagaugaaacgcauuugaaaugaaguaguagcagaaaaugacugucuuauuuaccuguuaaggugccacagcuaauauaugcgccauuccaucuaguugguuuucuuaucuuucgaaauuuccuuuucaguguuaaaaaauguaggcuuaaguuauacuaggagagaagauagcuggaaaaggcuugaggcgacuuguuacaagcugguuuauagccuagaaaagagaucaccguuugaaaaguauuugguuauuucaguuugucaauuuucugcucuggaggcacuaagaagauaagggaugacugagcuuuuuacagaguaggggggaauguagcauuggcccacugagaaggacaugauaaauguuuugcugaugacugugcuagggauacagcagccuccccacccacgggcuccuuagcagcacucuaccaagggagugauuuuccccuagguaauuaaagaucuguuuuagauagggauaugaauaggaacauuucauuaucauauuaaccaauuacaggaucugcugaugaaaaucaacauuuagaucaaauauugaaugugaaauuguuuuguuucaguggauacaagguuuugcuuagaacguuguguuuaauuucucauugaacuguaaacaagaaaagacacugaaauagccaaauaauauuuuuauauuacuuuugaaguaucuagucaagaaaagaaaccugugcaauauuuuaaagguuugcaucguuuuuucuauuaaaaaaaaccacgcuuuuuaauguuugugacuuaaacagaauugagguaguuuggcaacauuucaauacuguacucuaauugcaaacuuaacuguguaauggggcagggaauccugcuuguacaggggugaugguaccuuguuauugcaucagaauggaauguuuuaaguuugcuuucuuuuuuauucuugauuugcgucuuucacuuuugggggugauugggggagcaguuuuaccaguuacacagaguuucauaagguuuuggucaaccaguuauuacacaaucgacaaaauaagccugauauguuuauaagcaacacugaggaguuugcccuaguaccuuacacagggauugggggaauuuuuaguaggcgccgauuguucguucuucccgagauggugaaucagguggauuaugcauuuuauaucucuucuuuuuuagacaagaugugaaauggagaaguaucugacaccucagcuuccuccaguuccuauaauuccagagcauaaaaaguauagacgagacagugccucagucguagaccaguucuucacugacacugaaggguuaccuuacaguaucaacaugaacgucuuccucccugacaucacucaccugagaacuggccucuacaaaucccagagaccgugcguaacacacaucaagacagaaccuguugccauuuucagccaccagagugaaacgacugccccuccuccggccccgacccaggcccucccugaguucaccaguauauucagcucacaccagaccgcagcuccagaggugaacaauauuuucaucaaacaagaacuuccuacaccagaucuucaucuuucugucccuacccagcagggccaccuguaccagcuacugaauacaccggaucuagauaugcccaguucuacaaaucagacagcagcaauggacacucuuaauguuucuaugucagcugccauggcaggccuuaacacacacaccucugcuguuccgcagacugcagugaaacaauuccagggcaugcccccuugcacauacacaaugccaagucaguuucuuccacaacaggccacuuacuuucccccgucaccaccaagcucagagccuggaaguccagauagacaagcagagaugcuccagaauuuaaccccaccuccauccuaugcugcuacaauugcuucuaaacuggcaauucacaauccaaauuuacccaccacccugccaguuaacucacaaaacauccaaccugucagauacaauagaaggaguaaccccgauuuggagaaacgacgcauccacuacugcgauuacccugguaugugcucuuaccugguugaagcaucaauagauguagugugugugugugugugucugugugcgcgcgcgugugcgugugugcacgcgcgugcccuuuucaaccucauggcuuuaaauaggaaaguuguacuugacaguaaaaaaaaaaaaaauuaccuuuuuuuuuuucucuauccuaucucugugcuuuaacuuugguauguaaaccaguuaguugucuguugcuuauguuaugcaucaaaaacuuggcuagaauauucuggaaaaaguucccuuggauuuuuuuuucuuuaauauuaaaacagauuugaauuucuaauacauauuauuucgaguuaggccagaguuacuuuaaaauggcaauugaauaaauugcaguuuuuaauucuaaauuaagugccccagaaagagauuaaaguagggugggggaaaauaagguuugguggugaaguggagguugcaggcagcuagcuugauguuagguacaagacugucuacaagacagauuuaagaaugguuuugauggcacgugagcauaugcucaguuuugaaugacauacauggcccaaaguauaaguugaagacaauacauggaauauauuuacaaguuacugggaaagcuaguuuaugauuaauacauggcaaaauuuauugacucugauacaugauauggcaugacgugcuaaaugaaaaaagaagaaaugugggaguacagaaaauuacagucaucuuggauaauggcuuaguacugucagcucuagagccauuaaaauuuuuaaaaaaacauauagcagcucuuaauacggaaguacagcaccuacuggaauauaaacacaaauuuuccauuuguaguuuggcuugauuaucuguauucuuuccuguuaaagugauacauaaaacaaaucacuucaugccuuuaauaagguaaugggggagggcucuuuaaaacuuuuaaaacugaagcuucaaauaaucucaucuagcaugagagauuucuucuuuaaagccagauuuuaaacacugaaucaucaaauguaaagauuucaaaaggaucuccaaaaugacaugcuguucuccuuuauuuuagguugcacaaaaguuuauaccaagucuucucauuuaaaagcucaccugaggacucacacugguauguaauuuucuuguuaauucugugaguuguguaaauaguguaagugguauucauccuuuuaaaagcuaacacguguuugaucucuucuccugucaacuuuguuuuuuuuuuuuuuuuuaaauagccuaccuuuucagcacaggcuugguucagaauucaguuccaugagaaaucugguuccaggaaggccggugauguucccucacuaaggccuucuugcccugucaccgcucagaguugauuacccaaaaauguaaacagcgauguuuacuaauggauuuuaaaacuuauacuggcaguguuuugaaggaaaaaaaacaaaacaaaacucauuuucuuccauagcaaauaauuuugcucugagaaagccauuuuaaacucuuaaaaacuuucccauuuggaguguacugcauaauuggugaaaacguuaguuucaccucuagguuaaaauaucuguguuuaguauguuuucugugcuugaugaaagguagugcugaaauugcaguguuaaaaucagguggucagaaauggguuacaagccccagccuaaacuugguaugugugagagacuugaucuuuauucuagcuuacauucauucuuguuuacauaugcuuuuaaguuuagcuccucuacuuuuguauuugcuuuguucaaucuauagcagucacuuuuuuugagauggagucuugcucuguugccaggcuguagugcaguggugugaucucaguucacugcaaccucugccucccagguucaagcgauucuccugcuucagccucccgaguagcugggauuacaggcccccaccaccaugcccaguugauuuuuguaucucuaguagagaugggguuucaccauguuggccaggcuggucuccaacuccugacaucuuuauccaccugccucggccucccaaagugcugggauuacaggcgugagccaccgcgcccgaccagcacuuuuaagagcuuuuaaacuuuaaaauuauaucagaagccauuuuaagaugaaaccagguggcauacuuuaaaggccccccaaauacuccaaauauugucaaauauauagaugguuacuauuugcgauuuucuuaaaagagcagcccuaaagaaaagaacuuauauaaagugauuguguuuuuuucccucaauaaauacagccuuaccuaaaguucagagaauaaguuugcuaauaaaagcaaugaccuagcaaaauguauuauuccaucauugcuauggaaaccaaaguauucaacaguuccuuugaauggguuguuggauuagugugaggacuugaaucucccgaggcuagauguuacuauggaaauugaguuuugauaaaugaaguaguuaucucuaacugcugcauuaaaaaguaaaagccuuugaacaaaggucagugcugagguagagcccuaagaggaauaugguugcagacauuuuguaugcauguuaggaagcauugcuugauaucccagugauaaacacuacuuacuaaaauccgaugacaauguuguagauuccagggcuuuuugagaaacugcuuuuaaggagaaggcaucuuauguauuuaucuaugaaaugagcgggcuguuuuggccugagguuuuugcauggagacaaacugauuacauaagaggaaggauccuucauaggcagcccaagguagaaauuuuuauaguuaaacacaaaugaauuaagcauguuauaaaaacuccaacuuaaaguuuucaaaauacaaaugacaagugccaggaaaauauuccauguagaaauaccaaaauguccuuuuacagaauauaaauggaaauauaaagacauuugaacuauuguuuuuuucacuuuuggaaguccuugagagauaggagggaacacauuuuccuggguuuaaagucuccuaauaaaagagcacaauugcauauaacgauguaaucaacuacuuauugcagggauguagucaaacccauaucugaauagccuuucaccccgucaggguuuagugcccugaaugcuuauaccugcgauucaggaacuugaccugccggcaaauacauuuaaucguggguugucuuaacaaugcuuguacuaauaaaaacagacugaaaagaagaccgagaccugguuugggucccuugcaucagcuuuuucaccugaccauaaacauuguggccuucaacaucuaaugaaugagaacauguaauccaguuuaauaaaguuuuguuugauagucuuucaaaugccuuggggaggguuuguagcagacuuguucaucuggcuaaaccuguucuuggguaaucauagagcauugagguuguuuucuccucauuucucauuucuagacaaugccuuuuaaaauuaccuguucucucauugcauccuccccacccugcccgccuguuguuuuuaaaugaauguaucugaagccagcaaagguguuuuuuuuuuuucuuucccuuuaaggcccagguagaacaguuaggacaguuuuucuaaauuacuucucuuauguaauagcuuuuuuugguuuucuuucuguccuccuccucccucucggaccguugaucagaggacuuuaaaaaccacacaacaguugaugacauaaaauacucuuuaaaugauugucguuuuacaggcagaaugugaagcacccuagcauuucuuuggaaaauaauuguaauugcuuuaaaaugucaaguuaccuuauguuuuaaaaauaauuuaggcaaugaaaacagccuacaucugaguuuaauuacuucuucuggauuuuuagauuggaagugcuucuuuaacuuggguugcaaauugaaccuaagcaaauaauagucuuaacaaaauagaacuuuuuaaguaaucugagaugacagaguagaugauauaucaguuucuuaaaccagaaguauagcauucaagucuucuaaguucauauacuuugauuucuuuaucaggaaaucgcauauaaauaauacaaaguucugucuucuuugugugauuagacaauacuggaaacauuugcuucuauucuagggaauaauuauauuuuauuuauaucuguacauacauaguauagcauaaggccuguagaagcaccccuuauagauguggauguucgcauguauuauuuguaguauguguguguauacauuuaucaugccuuuggugagaaauaauuauggcugcuucuagguaacaaugucaaugagugguguauuuccaauucaaaauauuuguacuuuuaacagcauuuaaaugaacauuguacugaaauuuguaugccucaugaugucuacaaggggcggaacacauugcuauuacucuaaaguugcucccaaguauacuguuuugucuuuauaaaucaacaugacugauaaacugucuauugcaaccaguauuauaugcucacauaccuuacuuuuuucuuuaauauaaugaacauuuaaaauaaugucuaaguuugcaaagguuugaggcaaguugaaaucaguaggaaaauauauugacuguaucuucaaacaaaaauuuguagaaauuuaaaaaguucuuaccagagaaaaaguucugaaaaaguaaaccaugaacucaacacagauguuugaaguccuagcgguucccuucaugugcguggauauacacuuaaccuuagagaauauggaaaagcuguugggaaaucaggguacgguaacguuucuagauuuuuucuuucuuuuuuuucccccguuucagcuaucuggaacagggcaagaaauuagcauuuguacaaagaaagucuuugaacaacacacacuuggcucaaguauuccucagacccagacuccaugcauuggacucuguguguacuaagugaucccagaguggcuuacuggagauugacaauggaaaaggacaauuugaaacacgcccguaggagaaaauggaaacauuguacaaauaacauaggaacacaaaauucacucuucuuuuuuuuuuuuuuuugagaugaagucucgcuuucguccccaggcuggagugcaauggugcgaucucggcucacugcaaccuccaccucccagguucaagcgauucuccugccucagccucucaaguagcugggauuacaggcgccugccaccacgcccggcuaauuuuuguauuuuuaguggagacgggguuucaccauguuggccaggcuggucucgaacuccugaccucagaugauccacccgccccagccucccaaagugcugggauuacaggcgugagccaccacgccagacucacaaaauggacucuuaaagcacuguguucaagauucccuguuuaggaaagauuuccacauuaaguccuggaaagauuuuuaguggaagccuaguuuguaaagggguuacauucccauuuucugccuuacugucuuuugcagaagacuuuauugccuacugacauguguaguaagauguuauuaguuauacuucguauaaucuguacuugagauuugcugcugaauauauugacuuucaguuuggguacuaaaagauccuuagauaugaauuucuuuucuagggccuggcacaguggcccacaccuguaauucuggcacuugggaggccgaagcagguggaucaccugaguuuagggguucgagaccagccuggccaacaaggcaaaaccccaucuccacuaaaaauacaaaaauuagucaggcgugguggcacaugccuguagucccaguuacucaggaggcugaggcaagagacucguuugaacccacgaggcggagguugcagugagcugagaucgugccacugcacuccagccugggcaacagagugagacuccaucucaaaaaaaaaaaaaaaaaaaaaaauuccuuucuaggucuuugcuccaaagucauuuuucauggaauauauuaaacauagcuuuugguuuuaaaaucucgauaauauuuggcugggcgcgguggcggcucacgccuguaaucccagcucuuugggaggcggaggcagguggaucaccugaguucagggguucgagaccagccuggccaacauagugaaacccugucucuacuaaaaauacaaaaauuagcugggcaugguggcacaugccuauagucccagcuacuugggagccugaugcaggagaauugcuugaaccugggaggcagagguuguggugagccaagaucaugccaccacacuccagcccggacaacagagcaagacuccaucugaaaaaauaauaauaauaaaaaauaaaaaaucgauaauauugacaauaaagauauuuucauugcagguacuuacuaaaagcaacauucaguguucugaacauaaguuacucuucuuuuuguggaacugugggaaaaggguaaaaggcuuuuuaggaaaacuguauacaaagguuuucacucugggccuuaauggauggagaucuuacaaugugaaucgagaaauaauagugguuaaauguguaaccuguuuuauugguagagauaacacaggcaaaaucuuuuuugcaggaagagauuuaggacucagugguuuuuugagucucuauuugaaaacuauugcagaggaaguaucacauuuauuagccuuuaguauuagauuuuauuaaacauucuuuucauucuuuuccauuuuuuuuucauuugcagcuuugaaauuuauuuuguguauugauaauuucaaacaauuuuuuuuuaaaguaguagcuuaagagacuugcugguucagaccccaggaaagguauuuaugagcaugaaagcuuagaagcaauuucuuuuuaaugacucacugggaagauuaaacuuugcuucuaggacuuguucuuucuucugagaaacauuuacauaggaaauugauuaaacauuguuuagagaugauaaagcuuaucaaaaguuaaguauaauuugauucagcaaauauuuuuuacugguuuuguggagaauccaaagaugaauaaucucuucuugcccuuuuguucauagacuaaauagaauugcuggaguggagauagaaauaauuagucuugaaaguagagaguaauguuuuuaaaaaauaauaauacagucacccaagaauuuggcagauauuuuugguucuauagaauguaguagcuguuuacuugauggccuacaucguuucuagugaaagauuagaaauaauguccuacuuuaguaaaaguaucuccguagcagcauuccuagucuguuagccaguauuauuuauauucaaggaucucaaacaacaacucuuauuaaggauaaguuacaguuuuagaagugcacaguagguaacuuuuaccuaaaaauaucuauauagaagaauaaauuuauuuuuggcuacuuuaugaaaagguaaaccuuuacgaguugggaggagaccuacuggucagggucaccaugugaagugcaaauuaaagggaagguuaucuaguacucauuccauacugggaaaaaaugaaaauagaggauuuuucuguuuugcuuacaaaaagaaaaggugaaauuccucauugacacuuuaacgucagugcgaacucccauuauaagaaagugaauccgaguguugucucguuaucaggagacggaagaauugguauuugauuucauuaacucuauuaaugacaggggauagucuucauaauguuuacugggaacccagaggagaaguagcaguaguuuaggagcccagagauuccaaaucucugcuaggauguagacuguaaguguaaccccugacaucgugaucccacccauucccucucuggguuuggcagaucagugcuuucuggcccugggagaaguccccucgcugccuuugaccagugcuaggggcucuaguaugucuuggcuuuccugaaguccaguccaguucuaccuaagacaauuuguuuaaacagaguuuaucccuguauaacuucagaauggacaauaacucauucgauuauuuucucuggaaguggcucaaaacaugguucucaccuaaaugcguauuaccagauuacucucagugguccugggcagggcaaagccaggcaaaagcccugcugcaggaggguccacagaagaauaaaaagcugacagccucacaagaaccuuuuaugccuucccuccuuuucuuuaaucagaauaacugaguuguuuucaagaugcauuagggaaaguguggcauuacagcaggaauagaagauagucucugcccuugaggaacuuuaaaagcuaguuaaggaggcaaaauacaacuauuugaagccuuccuaaagcaguauaugugcaagugcaaauugauagcucaacagaaauuucagugauggggauacagagaagugaaaugaucucuccuggucuguucagaggcuuucuagaaggagugagguaucggauuuuaaagaaagugauaaauauaaauugaggagagaaaggaauuucucuuuuguugcuuuuguuuuuguuuuuggcaaucagcuuccuuagguugaaugggcacaauauugaugguguuaucugguaaauaauuagaugcauuuacaaaugcuaauaauacuaaucuuugauauggaccuucuguuccaaguauaggaaaugugugacaaugaguuuuaauagaaagguuuuugauggaaaauuacuggcauagacguaaaaauaugaauuagugagcuaaaaucauccuccuacuuuaucucuuuucuuagauaucuaaaucauuuuccuaugaauuucuuuaauaaguguuuccuauuuuucucccuuuugauuuuuagaagcaaaucuaauaugagccuauuucagagacuaaauuucguaagucucaaaugaugggaaaaaucuaauuauuauugaauugcaugaaaauauuuuccucuugaaauaagagcccauuuugagcuucaaggacucuuaaguucuaagaguuuagauuagguugaaauaauuuauucuacuuuaaaaguuuggauuguuuagguucgcagaacaagauacaagauuuuaaguucuuugaggccagaaaccaagucuuauuugaguuuugcaaggcauuuaguacagguuacaccuucacuaauaaacagugacuuuaauucucaugauauuuuagcuuuaucagauauugauugaguugucuuuuagucaccaggaaggaaaccgauguguaaauuugcugcaauaaacuuuuaaaacauuaucuaaaauaacuauuuuaagauaaauauuuuaucagugauuuuuauucuuuuguuagaagaaucuauguagaacauuuuagggaaaggccuugguaugucuauugaauguguucagcagagcagagaaacuucccauuccauugugauagguucagaagucauucagaggggggaaaaaaaaggacaauuuucaguuuguugcugaggauuuuuaaaauggcuuacaaacauguuccacuaacccacugaaauucacuuacccugggggaaaggagcuaucguuaggugauaccugggaauuggcaauaccugaacagugcucaggaccccacaggccccacagaggcuggcacugccagguugugcucucuguuucagaucgucugggguucaaggcuugcugugaguccauuaagccauuccuuagcugaccuucgcaaguggcuuuagaaucuggaaaugaauuugaacaauauguauguguuccuuaaaucguucaaagagaguguauuaguguuugcuaauggaagauuuaagugagacauuaaggaaaaguggcagaccaggauucuuaauguggagcucaucguuuugcuucuaacucuacgggguuauugugaggaagcgagauaaugagaaguaccucgcucuggaguaugugcuccauggcugcuggugccugcucccuuuuccuuuuaccgguaauguuucugcuuaacauuuuuguaaaguauguuaaugacuuuaucagcguggauaguaugcauguuuaacuugaacauaguuuucaaagauuagagauucuagcaaaauacuccuguaauuuaaaaacagaaugagaaaacacauacuuugagauaaagugggagcuuguuuucugugcuguacaaacuugucacuuuuuucuuuuugccuuuggaaaguuucacguuaacagcaugagaacuuaaaaauacaguugauguugaaagagcuuaacuaaauauuuuaaauuggugguauuggaaagagauucuguaaaaauccaauuaaacuuuugaaagcucuauccuguugaaauauaacuuaaaggaagucaguuugguuucccagaaguacugugcauaguguuucuggcugaggaagaaaggcccaagucugcuguuuggccagaaauuggguaccaguuuccucuacgauguuuuacuugaacgguguugacacuugaacaaaucccauagaaacugccccaaguggggggauaguuguccuuacuuuuaugguaagacuuggccccaguaacuaacauuccagacacugguaguauucuuggcugaauacucuauagaugugcauaaauugagagcaaaaccccaaauguuuuagaaacuuuaauggcuaccguauuucaagcaaucaguaaaguaaacuuuaaaaaauacuggugcaguuuauugcuucauagccaauaaaaauagugaacaaaaagagucuagugucccuuguuucuuacauaaacucugaaaauucaguucugcuauuuaauuauuaaauucaaaagacuagaaugauuucuuuuaaaauugggagcacuauaggaauuuuuuuccuugucucagacaucagaaauaacuuuuucuuuccauuaaaugacaguaaaguauuuaaccaauauguuuguuucugugguuuauuuuucacagggaacaaaaacuaauaguacugugcaaaaauuuuuuuugugaucaauuuacaucuacaaaugugauagcuauauuuacuacugguguuaaaauauuucuauauaucagacauuuuaugugauuguaagugacagaacgugauuuauacuuuguuuuguaaauggcuugagugucuuagguuaaauuucugguuagaaucuacuaugaggggagaaaaaacuucuagaauugagauguucauuuuuaaaguggauugauaggaaccagaaagggaauuaaaacaaaaacugucugggucagaggcagaggagagaagagaggaaguauggcacagcaauccauaccaugggaaauguaggugaacucucaagggaaaaaaaauugggaccacuuucaugucgucuguuuuggcacuuucuucuuugucugagagucagagugguuaucaugacaacaaaaauauauuaaccacaaauuguagaaaucucaguugaugaggacagggucuuuuaaaguuuagacugacuugguuaauccuacaacuuccugaacaugauacugcuaaauuaggcagaaagguugugcaguuucuguuucgucagaacuaaacaaguguucaaagcaacucugagguuccucccuuucagaaggaaacauuuuuuuaagggaauuuaagaggugaaaaaguaucuauauaaaacucagcaguaagccaguaauacuuuaauauacaaauuuaucucacgaauucuuauaaaaaauucauagaaaauuauaaaaucauaaauguaggaacugcuaguuaaugcucacugaaagaacguuuuggcauuuauuccuacuggaauauaugaucuccaguaggauucuucacaaacagagaauuaagacuacauuaugaauauuuagugguuuugaaaguuaaacagcuggcaagcuuuggggagcauuaggaauaauauacauuacaggaugggagggaggaacauaccaacucaauacucaagggaagagaacugugaaagaauggaauggguagguugaacaauuucagacuuuuagauguauauuacacauguaagcuccaugaggccaacuguuuuuauuuuguuagccauuguaucacaaguauuugggacaguuccuggccuauaauagaugcuuggcgaauuguuuauggaaugaauuuuggguguaacacaugacaaagaaaaacuaaauacaagucaacaaaugucaguuuuuacaguuguuucauggucuuuuuuuuuuaccaaugugaaguuaucaguaccagacuauuuugcuucaaucugcaaaaggaaggugugugaaggugugugugacucucaaagagugaaugcccuaauaguccauuuuggaggccauguuuucaagugaacugauugaugagcugcaagcuucugucuggcuaauuuagaaacaucuaggaccaguuucugguuaagcaguugugguacaugaaauucaauguauaggugauucgugcaacagcuucugaauuuuuuccucccucacccaccuuacagccauuaguccuauaauaauuuaauuuggguuuguugguauagaaacuguauuugcacaauaaugauaaagccacucaggcucaucuagucauuuccuggauuuauguguguaggaguacauaaaaauaagggcacugauucguuuuguacuugucuaaaauuguuauucuucaguuguucaaagguacacaaaaugcuuuuuucuuuaugagguaaaaaauacuuggagguuauaagaaauaacucuuaacuagcuuacuuugaguggcuuugauauguauuuacucauaauggaauucaugagcuuuccuucuuucgcuuggccaagauuuuuuuuuucuuugaaauuccuucuccgguguuaucuaggauguuugcauuacaagcaggccgcuuuaccuccuuuguucguugucacaggugaaaagccauacaaguguaccugggaaggcugcgacuggagguucgcgcgaucggaugagcugacccgccacuaccggaagcacacaggcgccaagcccuuccagugcggggugugcaaccgcagcuucucgcgcucugaccaccuggcccugcauaugaagaggcaccagaacugagcacugcccgugugacccguuccagguccccugggcucccucaaaugacagaccuaacuauuccuguguaaaaacaacaaaaacaaacaaaagcaagaaaaccacaacuaaaacuggaaauguauauuuuguauauuugagaaaacagggaauacauuguauuaauaccaaaguguuuggucauuuuaagaaucuggaaugcuugcuguaauguauauggcuuuacucaagcagaucucaucucaugacaggcagccacgucucaacauggguaagggguggggguggaggggagugugugcagcguuuuuaccuaggcaccaucauuuaaugugacaguguucaguaaacaaaucaguuggcaggcaccagaagaagaauggauuguaugucaagauuuuacuuggcauugaguaguuuuuuucaauaguagguaauuccuuagagauacaguauaccuggcaauucacaaauagccauugaacaaauguguggguuuuuaaaaauuauauacauauaugaguugccuauauuugcuauucaaaauuuuguaaauaugcaaaucagcuuuauagguuuauuacaaguuuuuuaggauucuuuuggggaagagucauaauucuuuugaaaauaaccaugaauacacuuacaguuaggauuugugguaagguaccucucaacauuaccaaaaucauuucuuuagagggaaggaauaaucauucaaaugaacuuuaaaaaagcaaauuucaugcacugauuaaaauaggauuauuuuaaauacaaaaggcauuuuauaugaauuauaaacugaagagcuuaaagauaguuacaaaauacaaaaguucaaccucuuacaauaagcuaaacgcaaugucauuuuuaaaaagaaggacuuagggugucguuuucacauaugacaauguugcauuuaugaugcaguuucaaguaccaaaacguugaauugaugaugcaguuuucauauaucgagauguucgcucgugcaguacuguugguuaaaugacaauuuauguggauuuugcauguaauacacagugagacacaguaauuuuaucuaaauuacagugcaguuuaguuaaucuauuaauacugacucagugucugccuuuaaauauaaaugauauguugaaaacuuaaggaagcaaaugcuacauauaugcaauauaaaauaguaaugugaugcugaugcuguuaaccaaagggcagaauaaauaagcaaaaugccaaaaggggucuuaauugaaaugaaaauuuaauuuuguuuuuaaaauauuguuuaucuuuauuuauuuugugguaauauaguaaguuuuuuuagaagacaauuuucauaacuugauaaauuauaguuuuguuuguuagaaaaguugcucuuaaaagauguaaauagaugacaaacgauguaaauaauuuuguaagaggcuucaaaauguuuauacguggaaacacaccuacaugaaaagcagaaaucgguugcuguuuugcuucuuuuucccucuuauuuuuguauuguggucauuuccuaugcaaauaauggagcaaacagcuguauaguuguagaauuuuuugagagaaugagauguuuauauauuaacgacaauuuuuuuuuuggaaaauaaaaagugccuaaaagaugu

SEQ ID NO: 17690 - RNA, 2125 nt, Homo sapiens
aauuaccuuuuuuuuuuucucuauccuaucucugugcuuuaacuuugguauguaaaccaguuaguugucuguugcuuauguuaugcaucaaaaacuuggcuagaauauucuggaaaaaguucccuuggauuuuuuuuucuuuaauauuaaaacagauuugaauuucuaauacauauuauuucgaguuaggccagaguuacuuuaaaauggcaauugaauaaauugcaguuuuuaauucuaaauuaagugccccagaaagagauuaaaguagggugggggaaaauaagguuugguggugaaguggagguugcaggcagcuagcuugauguuagguacaagacugucuacaagacagauuuaagaaugguuuugauggcacgugagcauaugcucaguuuugaaugacauacauggcccaaaguauaaguugaagacaauacauggaauauauuuacaaguuacugggaaagcuaguuuaugauuaauacauggcaaaauuuauugacucugauacaugauauggcaugacgugcuaaaugaaaaaagaagaaaugugggaguacagaaaauuacagucaucuuggauaauggcuuaguacugucagcucuagagccauuaaaauuuuuaaaaaaacauauagcagcucuuaauacggaaguacagcaccuacuggaauauaaacacaaauuuuccauuuguaguuuggcuugauuaucuguauucuuuccuguuaaagugauacauaaaacaaaucacuucaugccuuuaauaagguaaugggggagggcucuuuaaaacuuuuaaaacugaagcuucaaauaaucucaucuagcaugagagauuucuucuuuaaagccagauuuuaaacacugaaucaucaaauguaaagauuucaaaaggaucuccaaaaugacaugcuguucuccuuuauuuuagguugcacaaaaguuuauaccaagucuucucauuuaaaagcucaccugaggacucacacugguauguaauuuucuuguuaauucugugaguuguguaaauaguguaagugguauucauccuuuuaaaagcuaacacguguuugaucucuucuccugucaacuuuguuuuuuuuuuuuuuuuuaaauagccuaccuuuucagcacaggcuugguucagaauucaguuccaugagaaaucugguuccaggaaggccggugauguucccucacuaaggccuucuugcccugucaccgcucagaguugauuacccaaaaauguaaacagcgauguuuacuaauggauuuuaaaacuuauacuggcaguguuuugaaggaaaaaaaacaaaacaaaacucauuuucuuccauagcaaauaauuuugcucugagaaagccauuuuaaacucuuaaaaacuuucccauuuggaguguacugcauaauuggugaaaacguuaguuucaccucuagguuaaaauaucuguguuuaguauguuuucugugcuugaugaaagguagugcugaaauugcaguguuaaaaucagguggucagaaauggguuacaagccccagccuaaacuugguaugugugagagacuugaucuuuauucuagcuuacauucauucuuguuuacauaugcuuuuaaguuuagcuccucuacuuuuguauuugcuuuguucaaucuauagcagucacuuuuuuugagauggagucuugcucuguugccaggcuguagugcaguggugugaucucaguucacugcaaccucugccucccagguucaagcgauucuccugcuucagccucccgaguagcugggauuacaggcccccaccaccaugcccaguugauuuuuguaucucuaguagagaugggguuucaccauguuggccaggcuggucuccaacuccugacaucuuuauccaccugccucggccucccaaagugcugggauuacaggcgugagccaccgcgcccgaccagcacuuuuaagagcuuuuaaacuuuaaaauuauaucagaagccauuuuaagaugaaaccagguggcauacuuuaaaggccccccaaauacuccaaauauugucaaauauauagaugguuacuauuugcgauuuucuuaaaagagcagcccuaaagaaaagaacuuauau

SEQ ID NO: 17691 - RNA, 884 nt, Homo sapiens
aaucuucucaucaucuucuuauuccucuuagcacaguuggggcauaauauguuaucuucuaugccuggggaugggaaaaugcaggcagguaacaagaagagagaaaucauccuccugugagugguaggcacccaggccugaucugcaugaaacugcagguguacccagcucuuugugucugcugagagacgucugccauggaccacacaccaccugacaucagagguuugcauccaaaaggccucaacagaaacaggaauggaacaugaauuuacagccuuuggcugaacagcucuugcaccaauucuugcccaugaugccaacauggaugccugcacugaaguuaucacuucaacuauauuagucucucuguucuuucauucaucucauaacuuuucugaagccucuugcucucucggucacugccuuguguuuucucgagcaucgcuguaaucuggucuuaugugauguuucaggcguaucuugcuguuguucagggaaagcacgccuacggagccucagauaaacuucuauuuucuugccauuagcacucaaaccaaguuguugacaccagucccgcuaagugucccgacacaccuuauuaaugggaggcaaaguggucggcaagggaagggcugguauuuugcaccagcuuuuuguggagcuguaaauuguucauguguuugaagugaugaccuugauuauauuucuuaggcuucuccaguuugacaucagaaguugaagaaauacuugguuccauuuguuccauauuugggucaucuuuaacuggcaccagugucaaaaucacacuucccucaucaacuacuuccccccucaaagaaauucuucuugcugcuauccaaauuugagucugacauuuucag

SEQ ID NO: 17692 - RNA, 884 nt, Homo sapiens
cugaaaaugucagacucaaauuuggauagcagcaagaagaauuucuuugaggggggaaguaguugaugagggaagugugauuuugacacuggugccaguuaaagaugacccaaauauggaacaaauggaaccaaguauuucuucaacuucugaugucaaacuggagaagccuaagaaauauaaucaaggucaucacuucaaacacaugaacaauuuacagcuccacaaaaagcuggugcaaaauaccagcccuucccuugccgaccacuuugccucccauuaauaaggugugucgggacacuuagcgggacuggugucaacaacuugguuugagugcuaauggcaagaaaauagaaguuuaucugaggcuccguaggcgugcuuucccugaacaacagcaagauacgccugaaacaucacauaagaccagauuacagcgaugcucgagaaaacacaaggcagugaccgagagagcaagaggcuucagaaaaguuaugagaugaaugaaagaacagagagacuaauauaguugaagugauaacuucagugcaggcauccauguuggcaucaugggcaagaauuggugcaagagcuguucagccaaaggcuguaaauucauguuccauuccuguuucuguugaggccuuuuggaugcaaaccucugaugucagguggugugugguccauggcagacgucucucagcagacacaaagagcuggguacaccugcaguuucaugcagaucaggccugggugccuaccacucacaggaggaugauuucucucuucuuguuaccugccugcauuuucccauccccaggcauagaagauaacauauuaugccccaacugugcuaagaggaauaagaagaugaugagaagauu

SEQ ID NO: 17693 - RNA, 6238 nt, Homo sapiens
aauaauuaaaggagugaauguuuuauucuuuaguguuuaauugaauacauaacaagucacauaaucaaugauucauuacuucacacacaggaaggaaaacaguagcuaguauuucuguuauacaacugguugugaacaggaagaacaaaaaucuuuauagcauuagaugguugaagaaauucucaaaguuugggcaugucugaaaagacuuugacugcaucuuuuuucaauauaaagggauuuuuuucuuacauuucugugucauuagaaaaaucugauaaucuuauaagauuuuuucugcucuucuuacauuuagagaaaaugguuuaaugauauguacuauuuaaaaaaucagaaucccagauaacucugugugaaucuuacauugucuagcagauaagguuuucagaugccuggaaaaauuuaaacaacauauaauuuacaucuucaaaauuaacauccagauggauguuuuaauccuuugucacuaaaugguuacuaacgcuguuugaguggucauaaaugaauugucauuuguauucaauaguaauagcaaaauuuaccugccuauaaagucgcaaaaacaguuguauaauaguuuacauuacaauuaauguacccauaccucaaaacacauuuagaauuuaaaaaaacuggcuuggaaaaaaaucacaaaaaauuuaagugacaacaaaucuugauuaacuaguccaucuuccuaccacacaugauuauacucuaauguagauauucugguugaauuucuuccaaccaaguuugaagggccccaguagaaaaucaaguguuaauacuuucagauuuuuauuguccaaaacuguugacaaagaaaagcuaacuucaacauaacuuguuucuggcuauacaaagaccuauuucaggugcuacagauacugaaaauaggaguauuuuacuuauuucucaagagacagacuuaugccaucuaagaaaaugaauucaguuuuuaaaugauuuauaguaaggaaaaacaggaaaacaauuccaaacgaaggauugacucugauaggcuuacaacaaaaauauucaguuuacuauuuuaaaaacuaaauugaguaaaguauuugugauuuagacuauaaaauaaauucucaaggaauucaaccccuccagucaauacuuuuucuuaaugucugcauuguaauuuagcauuuugcaugugggaguacacaaaugaauugaauauuggaucagaauuuacccuaacuugaagaguaaaaaguuaucaaaguuucaccuuacauggcuuuauugaaauaacauuccaucgaaaauuccaauaaaaauuggaauauauuaugagcacugccaauugcucauuuugucugauauuaacagauuaugcauuuccucagagaagcaguaggucccauauauacagacauauauauggcucugguuugaaagagaagacaauuuugucuaguauuaugauuuaucacugugcuaucaaucaaaaaccaguagaauacauaacaacauugaaagggaaaaauuuuuaaaucucacaucuucaaggaauauuuucuacagcauaucauuugaaaaaguagaaugaauacuguucaugguccacauguauuaaaaaacaugucaauuacuuggugcaaacacacagaaccugguaccuguuuuuuuuuuuuuuuuaaccaccauugucuacaccuuuuuaaaaauuaaguuuguuacuaaaaguccaaugucauucacuuguauuuaugaucaucaaaugguaauuagggcaacauauguaaaugcaugccucugaaucagauucaugcaguguuaauuaucugaauaauuuaugacauucucccagguuauuugaaugguaucuuuggagggcuuacucaaaugaacccacaauaccuccacuauuacagcuuauaggaaauuacaauccacuuuacaggccucaaagguucauucuguggcccaaagcccauggaggggaagggaucuaaaggugcucaugucaaguuauuuuacuuguuuuuuacugucuacccaauguaaaaugaauuuucuucacagccuuuacuuuaggcuaaaaauagacaguuuucuuguauugacuuuaacuuuagaggggacagucgucccuggaaaaagaaguagauuuacugucccuaaccauuaaauucccagucuuucaaauaaugugcggggcggggggugcugggugugacagggugcagugaauaagaugccuauguacaagacaguggaauaguucaccucaaagguuuacaagauaacauuuguaagacuugagugacagaggcaaaauuuuagcaguuucucaagacucuuggaguugagcagauuugagaagggaaaucagaaucgccgagccuugccaucugucagugguuuuggucugucccaagauguucucaaucaugugcuuccuguugaacaaucuaacaaaauaccauacgggguagagaaaucucugcaacacugacuuuuggucagugaaucagaguccuaaauuauuucaggcuucaaacagaugaauucugaugcauuacuuagucugagaccaaacucaacauacaagcaagcacaacuuccuagauuucugcuuccauuucgccuaaaauuacaggcuuuguauaugaagucaauuuuacuucucaaaaaauguuagucuaauaaaagaccugaaaucuauuucccaacuaaaaaaaaauuaguggauuaaaaauacagguaccuugacuuuaaguagacaguuaaucaacauaugauuaguaauacaacuaauacucaagaaaaaaaguauaauacagcaaacucaguuuuacaauuauguauuuuuuccuaacccaauuccucgauaaggauguaagaaacucaucaaaacauguugcuuuaguauauaaaccagcugaugcaaauuacugggguaauauaggaaauuuuauagcauuaguaaaugaauuaaaaaacuaaaugauucauguaaaauguuuauauaugguauauacagcuuggaucacaugagucuaagaauaaaacugucgauuuguaacaucuguauggacauaguaagauacaguacgagauucauuuuuaaaaacaaggaaaaauagcacuaauuuaaacacugaaaacagcucuuacaaaauccuuaaaaacguacaucagagaaagaugcugaaaacaaaacaaaauaggcuucucugucaucacagaauauccaaaggacaccucacagcauggagcaugacgagguuuauuucccuucacuuaugguuuacauaggauaugcauugggaauuuauuccauguaagaguaaaggcauaaggcaaccaggucuccuucuguuucuguugcauuuaccuauuauuggaccauuuuauugcucagcucacuuuuaaguacuuauuugccuucauuuaaaaauauuccauuuuacagcuaucuacagauaggcagcccuuggugcugaguucucugcagcucgucauuugaaaggauuccacuuaacuucaaacaaacugcaugaaaguggcauuuucagguuuucagguuugcccagaagucaacguuugcugggcuuggagaaaauaaggauuuuuaauaagugaucuuaggucuaaguaaccaaaaugaaacuucuuuugcgcaauagauuccaaaaucaggauuuauaaucaacaagaaaauaaaaguucaaaaacuaaaacccuacuggguaacucuuugguuagauuauauauaagcauuaacaacucuaaguuuaggacucaaaacaguaaguuaaguaaacugccagguaagaguaggucuguuauuaaucuuuauaaaauacuuggcauguuugcauuuacuauaugauauuuuuuaaaugugcauauacucaaacagaugguacaaacuuccaacuuucaaaucauaaaugacuaugucugcuucucccuucccacccuuccuacccuuuccucccuccccaccccaccccgcccaccaagucuuacagcuaaaggaagguccuacugacauucauugaaagaauacaggcuuuccuaauacccacgacgugcacuaugacccagcucccuacagucacugccaggugaccuccuacggcgcuuggagaccugagcagccuugcacucuuaggcggcagcguccuuucucccucuugccaguaacugcugccaugucaaccaguggaaucaagggcuucuggcgagcagcagcugaaaagggcgccucugcaggcaggcggaucacuuucuauaaguuuaagcuacaggcugagaccuuuuauucuguacgagaaaggauccuuuacugucccacgcacuagauucuucuacuuuacguguaacuuuucaaaacuuuauuaguuuaguuacugaacugccuccaugggguccuaauuccaggcucagaaucuuccauccagccuucuaaaacucuaccuucaaaagaggucaaaaagacuguguaaugaccuuguaaaacacuaaccccagacaguggaaccaauccugaucucuuaaacccccagugagucauaagagcuugagaagauuucaaggaaaucuuccgcacauuggacacgguccaaucagguucugaacaauucaaucaucccccggucuguggccacacucccccaauagauccaaacugaaguaccaucugggggaggggugguuugaggcagggaguagagaaagcauggagugguaggugggggugggguggggguuccucuggguucucucgguucaggagguccaaagaagacgaagcagcccagaggauuugcggcugcagguucuguaguggagggaaggugggcggacaggucucacccagcuacuacuggagggggagaaugggagggcagcagccaggggacaaaggugggacaagaggcucuguaaucaucucucgggcaggagaaggacugggcgcuggaguggcgagggggucuggggagcucacucccugcagaagacguacucgguguagcugguccagaucuuguccucgcucuggucggugcugcuggcaaaggcgcaggugcccguggagcugcacgccaccauguggaagcccgacucggacagcuugucgaaggccugcuccaggaaguugaacuugagguaauagcgcgagguguagcgcuccgggggacggucggggucccggcuuucguucaggguguccccaaacaccuccuuggccagcgacgucuuuccgcaaacggugaugcgcgccacucgccggaacuuggcguccgccugcgcgucccgcccgaugguguaggagccgcgguagccgauggugauguagcccgagcgccggcugccguccagcgacugggacggcgugagcagcgggcccgccgcgcccccggacggacugcggcuagccagcuccagcgugggcgacggcgccccggcagaggcgcccuccugcuguucgggcuccgaguagccaagcggcagcagcucgucacccagcgagcccuccuugugcaccccgcgccgcgagggcggcggccccgggccgggcugcuggggcgccccgaggcggcgcacgagcucuggcagcucgaaguacucggccucgcgcugcagccggcugcgcucggggaaguagucgggcagcacgagcugcaagucccgcagguaauccaggauguagcggaagaggaagccgucccgguccagaaagaagcggccuuugcugucccgggccagcuccugcggcugcugcugcgugaacaugcgccagagcagcgagucgggcaccgacaccaccgugcagcgccgggucacguacaccuggccccccacguucagcuccacgaugucggggaagagcgguggcuccgcggaggacgacgaggagccacugccgcccccgccgccgcccccguuggguaauccacgugugcuguccgccagagccaugacagagagguggccgggccgggacaguggcaggaagccgcgcugcacucaggagcugcaaccgccuuccccggagccccggaacccggacgcucgcucagcccugcgccccgccgccgccgccgccgccaccgccgccaccgccaccgccgccaccuccuagagccgcgcggagccgagcggugcgagcgcgccgcugugcgcccccuugaguuccagugcgcuccgcccgccuugcccgcgcgcuccaggcgagugc

SEQ ID NO: 17694 - RNA, 617 nt, Homo sapiens
aagcagccugagguaaucugugaaaaugguucgcuauucacuugacccggagaaccccacgaaaucaggcaaaucaagagguuccaaucuucguguucacuuuaagaacacucgugaaacugcucaggccaucaaggguaugcauauacgaaaagccacgaaguaucugaaagaugucacuuuacagaaacaguguguaccauuccgacauuacaacgguggaguuggcaggugugcgcaggccaagcaguggggcuggacacaaggucgguggcccaaaaagagugcugaauucuugcugcacaugcuuaaaaacgcagagaguaaugcugaacuuaaggguuuagauguagauucucuggucauugagcauauccaagugaacaaagcaccuaagaugcaccgccggaccuacagagcucauggucggauuaacccauacaugagcucucccugccacauugagaugauccuuacggaaaaggaacagauuguuccuaaaccagaagaggagguugcccagaagaaaaagauaucccagaagaaacugaagaaacaaaaacuuauggcacgggaguaaauucagcauuaaaauaaauguaauuaaaaggaaaaaa

SEQ ID NO: 17695 - RNA, 617 nt, Homo sapiens
uuuuuuccuuuuaauuacauuuauuuuaaugcugaauuuacucccgugccauaaguuuuuguuucuucaguuucuucugggauaucuuuuucuucugggcaaccuccucuucugguuuaggaacaaucuguuccuuuuccguaaggaucaucucaauguggcagggagagcucauguauggguuaauccgaccaugagcucuguagguccggcggugcaucuuaggugcuuuguucacuuggauaugcucaaugaccagagaaucuacaucuaaacccuuaaguucagcauuacucucugcguuuuuaagcaugugcagcaagaauucagcacucuuuuugggccaccgaccuuguguccagccccacugcuuggccugcgcacaccugccaacuccaccguuguaaugucggaaugguacacacuguuucuguaaagugacaucuuucagauacuucguggcuuuucguauaugcauacccuugauggccugagcaguuucacgaguguucuuaaagugaacacgaagauuggaaccucuugauuugccugauuucgugggguucuccgggucaagugaauagcgaaccauuuucacagauuaccucaggcugcuu

SEQ ID NO: 17696 - RNA, 10573 nt, Homo sapiens
gcggggaggugucaugcgccggaaccugcgcuuggggccaagcucuggagcugacgcgcaggggcaaggcgccccgcgucccggacuggcggcuccgcgcaugcuccucccaccggcgucgcaggccucgagaggcuccggaaguacugggugcagccugauggcgcaggagguagacacggcacagggcgccgagaugcggcggggcgcgggcgcggcucggggacgcgcuuccuggugcugggcccuggcgcugcuuuggcucgcggugguuccgggcuggucccgggucucgggcauccccucccggcgccacuggccggugcccuacaagugagugcggcggcgcgcgcacugucgggguuggggucggcguugacgaugggggauggggugcuggggcggggaccccugcucaccgugguuugugucgggucacgagauggugcggggacagcgccgggugacgcucggagcgcacuugagagcaaaguugaggacuggggagucgcagccgcucguuacgugcagcccugggaccuuucguccccucuggucacuugcggcagacucaggacaguccugaaucguggaagaagaaaaggagaguaauguuauuuaauggagggacuucuggguacaaguagcugauuucuugaguaguuuaaaaacacugucuaucgcauuuauuuauaucaugcacugucguuaguuauuaccgcggaacauuugguacaauuuacugggcgaccaacucgcucugguuugaaccugaucagaaccugauccgaaguccuuauugggacuucccaguuuugcccucaaaagucgcgcaucccgggaauccccgucuccugcaguccugguuagaccgggaagauugucaccgcuuuuguccagucuucagccuggagguaggacgccgguccuaagucggggacagagcccgcacaccugggaggucgauuccagccuuugacagagaagacacagccuccggcggucagagauagcuaaacacagagaaagaaaacauggugucaacaucaggcaggagaaagaccagcaguuuuugaaaacagcuauuuuucuuuaaaccaaaagcaucauuggacauaauuuuaacuuacuagcauaaguaaucaacagcuaaaacugcacacaacaaaccugaaaaaaacagcuauuuuguaugacaguaugagugggaaggaguucugccugcugcgggucaaaucuggcucugucaucaccagggaucuugggaaaguuacucagaaucucugugcccacaugcccugagucaaaaaauaggaauagugguagcacguaccucauagguuugcuggaaggauuaaaucuaguaaaaugccagcuguugucaaaccuagauaguguauucugcucacugaaauguuuacaacacuuuuuuguuuugugugauauacuacguggaaagagaaguuugugguugaagcuaguuuucuggaaaauguuaauaauaaaauguuuguaagaagucaaaauuacucaauagaacaagaauuguaaauccaaacgauuugauuuaacauuagggcaagguguugacuauggcuuuuuaguggauuuuuuuuuuaagucucagauauuaaguacgugcucccaucuaauucccucaauugaauauaauauuuaaguuuauuaaguucacacuuaaauuaccuuugaacuaaaauagauuuugcugugucagugaaaucuccaugugauuauguauuuguuuaaaccagguaagugccuauaaaacacuguacccaaguagcagaaacuuuugggagcgucguuaauaguuucgauuagcauaaagauuuuaacuucuuaaguuaaaauagaaauuuuuguugauuuguuaagauuuguuagaucuggcuacaaccuuggggaucuaggauucuuagauagaagcuguugucgccaccacuucuuucuuucccagugccagauuauaggugaccagugugucuguugagcugaauucagcugcagugccccucgaguccuauugcuguggccuucuccggucuucuuuucuugccugcauuguugaggucaccuucuaacugaucucucauguuuuauuuggccucucuccauacccucuuuuaauucgugaaauaagguuuacuuuauagcaaauucaguccugucagaucugcuacuuaacauccuuuaaguuuagcccuccccaauuauaaggcagggaauuccaugcacauucuccuagugacaaaaugacagccccugccagucucuuccgucuccauuccugcgucgaggccugaaauccagucuuccguaccuaccggagaccaaaugugccaggcuugucuuacaauacuuaacauuuccucugccuuucugucuuaaccuucuaaucaacuacauuaaaaaccuaggcccggccuucaucucuuucuuugcccuccccaccccauucaucccauaccugguuaacaaugauuuguccuuccugugugcccauaggacucauuccuuuagucuagcacauaccacacucauuacuuguucagugucuuuccagcucccacccacaguuccaugagaaagggaacaguguuuuaauuuuuguuucccuccuucuuacuauaguucacuauauauguaguggagccucaauaaauauugguugaaugaauguuaauucguaaguaaauauaaaauguauucuguuacucauaauuaucugaauaaucuuaauguauggacuguuuguaaaauugaacacauuggaaaaauguucauuuauucuguaaacauuugcaaaugucuacuaugaucuggagcuauaaaaauuuuaagacaaaauuccugucuucaaaauuuucacagugggaucagggaacagggaagcccguauuuaucagagugcuuuuaguuuaucauuugcuauuaaaaacauuauuggaaguuuguucacaagauaacaaaauguguguuuauauuuauuaacuaugguccgaccuuugaaugguccccuaaaaauguuacuggauucuaaaagacgugagaagaaucagauucauuuuagaaucuaaguagaugguuucuuuuucuuuauuaggcgcuuugacuuccguccaaaaccugauccuuauugucaagcuaaguauacuuucuguccaacuggcucaccuaucccaguuauggagggugaugaugacauugaaguuuuucgauuacaagccccaguaugggaauuuaaauauggagaccuccugggacacuugguaaggaugcaucuuggucuuauaacuuugguuaauucaaugauuugguuauuaaguugauuuuuaaggaguaaucacuauuuagauggcugacuuuagaucauguugguguuugucuuaguacauuuaaaaugaguagucaaaaauaguuacuaucagauuuuguaaucuugacaacaacaaauguaaucaccauuauccauuguaauauuaugaaucugaaaccagcuccuguaccuagcuccuggaaggugagaagaggcccagaaguggcagggcaggcagguaacaccucuugauuuccauacucuguuguagucacuuuuccagguuaacccaucaccaugugaggucuguagagcugcuuccagagacuggcaugggggcuccucacacuuauucuaagcucuaaggaaauuaucagcuuguccacauaacaugcaggccuccuauuugagaugagccaaauagggguguaguggccaaagcugggguggaugagggccuggaguuuggggccacagaguggauaugacaguagcagcauggaagaacagcugaacaguuguucuacuugauaugcauuugugaugugccacauuuucuccuaucagguuaccuggacccaugguugugucacaguugcuuuuauacauguacugucuuuacacagaaaauuaugcaugaugccauuggauucagaaguacauuaacuggcaagaacuacacaauggaaugguaugaacuuuuccaacuuggcaacuguacauuuccccaucuccgaccugaaauggaugccccuuucugguguaaucaaggcgcugccugcuuuuuugagggaauugaugauguucacuggaaggaaaaugggacauuaguucaaguagcaacuauaucagguaaguugugaaaauauagcaauauuugaucauugcaucaaaaaccaaaugaaagaaauuguuauacuuccauugaaacauuucaguaauguuuuacuuagaggucauuuguaaaauguacuuuuggaaccauuaaacuuugggaauuuuuuucaucucuuauuuguauuuuuuauuuauuuuauuugaauagguuuguggggaacugguuauguuaaguuacaugaauaaguucuuuaguggugauuucugagauuuuugcgcacccaucacccgagcaguguacacuguacccaauguauagucuuuuaucccucaccccucuccgacccuuuuccccgacuucccaaaguuaaucauucuuaugccuuugcauccucauagcuuagcucccacuuacaagugagaauacacaauguuugguuuucuauuccugaagaguuacuucacuuggauggaauuggagaccauuauuccagguugcugcaaaugccauuauuucauuccuuuuuauggcugaguaguauuauuccuugguauauauacaccacauuuucuuuauccacucauugauugaugggcauuugagcugguuccauauuuuugcaguugcaaauugugcugcuauaaacaugcaugggaaaguauuuuuugcguauaaugaguucucuuccuuuggguagauacccaguacugggauugcuggaucaaauggcaguucuacuuuuaguucuuuaaggaaucuccacacuguuuuccauagugguuguacuaauuuacauuccuagcagcagagaagaaguguucccuuucccccacaucccgccaauaucuauuuuuuuuuauuuuuugauuauggccauucuugcaggagugaggcgguauuacauugugguuuugauuugcauuucccugaucauugcauuucccugagcauuuucauguuucuuggccauuuguauaucuucugagaauugucuauuuguguccuuagccacccccaccccgccuuuuuguuguuguuguuuguuuguuugagguggaguuuuauucuugucgcucaggcuggagugcaaugacacaaucucagcuugcugcaaccuccaccucuuggguucaagcgauucuccagccuuagcgucccaaguagcugggauuacaggcgcccgccaccaugccaagcuaauuuuuguauuuuuaguagagaugggguuucgccauguuggccagcuggucucaaacuccugaccucaggucaucugcccaccuuggccucccaaagugcugggauuaaaggugugagccaccacucccggccguuaacccacuuuuugaugggauuguuuuuuucuugcugauuugaguuccuuguagauucuggauauuaguccuuugucagauguauagauugcaaagauuuucucccacucuguggguugucuauuuacucugcugauuguuccuuuggcugugcagaagcuuuuuaguuuaauuaagucucaucuauuuauauuuguuuuuguugcauuugcuuuugguggaaccacuaaacucugacccaaacuauuacucaugcagaacuucaccuguuggugaugaguagcuuaucucugaucuuugaauguuucccuaaaaaugcucuuuucccaucauaaaaaugaauaaaaugauaaaacauuuuguacaauuaaauuggucuuucuaaacgaaauaguaagagaaauccauaaaaugccugauuaaaggauauguuaacuauaucugaaaaaaauuuuagugaugauauuuuuauguugaaaaauaauagcuacuaauauagacugguucuggcacuguucugaguacuguacauacaucacaucauucaucaucacaacuucuggagguaguaacuauuauuuugccuauuuuacagauggagaaacugaggcacagagagguuaaaguuacacagcuuaguaagugggacuccaacccuggcaguuacgccccauugcccauucuccuaacuacuuugauacauugccucccaaaauguauaugaucuuauauuugagacccucuugagcaguuuaaauauuuuaucuuugagauuuuuuucuucuuuuggauguauuggaaaguugcugaaaguuggaauuguguugcaagugcugcauuguugguuaguaaugaaaagaguucagcaauccuuucauugguaacuccuuaugugacuugggucacauuuuauaucuuauuggcccguugccucaugugcaaaauggagacaauauaccauagcauuugagaaguaaggagcuuguccauaugauuuaugaagcauuacauuauaaauugcuguuccccagaacaguagaaacaucugaaaugaaagcacuguugugacaauaauuauucagugaaccccaggacuugaggaaguaaucaugcuuccuauuuguauagcucuuuacaaaugauuuggagguauguuaacucacgguucaguggagaggauaagauacucauucucugcaaauaaggaauugaggcucagccagguaacaugacuuacuugccucucaaggucaaagagcuggauguagcagaaucaggaauaaaacugaggucuuuuaaauguaacaaggaucuguuagccgaaugcaccauguuguuuucuaauauuuccugcuacuuucuaaucaaugugccuuaaaccauaccaacaauacaaaaguccaucauuagcgguucuuucuuucauuccaggccaguucacaccuuuccccauuuccaccuacaucguuaucugaaaauccuuccuucugacauaaagucaaugaucauaugaauaagugaucacuauuuuuuguaaaauaguucaaaauaugccaguacuuaaaucuuuuaagucauuuauuugccuugugaauaauccugugauugacaaaauaguguuuugaagcauucuugucucauaaggauagugguggcauuugaaaguugaagaaugcuaagaacaguauccccaguucuaauacaacaggcuuuauucuguucuacaauuuuaauuccauaaaauugauaaaggcagucacucuauucauuuuacagaacaugaaguauuuauuuuauggacucaaguuggaguaaccaaagagguuugcacacagugacaggaugcaguguuuggggcccaguucuauuaggcauuauaaaugcccaagaugagaguuguaaccaugcagaguaguguuuucugaauauuuggaaagauucuucuggucuaguacaagaugguagaagagaggguuagccauccuggaguaugaacucggccuaaaacauuuccaguuuaguugauuuguuggaaggacuuaacguggcagguggagaggucaucagcagcaucccagcaacuccaaguacagggaagaaagaaacguaccaaacacacaagguggaugggguauggugcuuguucucauaacaguaauagccagccuucuagagcaguggcuccucaggcagccauucauacuuuauguguagcaugcuuugcaacagugaagcuccacauuucccacaccuccauuuuccuuacacugucuuugcccauucugcuuuuccucuuucgcaauucuuuuugugcuuuccuuuucucuuuugccucugaauccaagauuuggugaguuggguagagaaagagagcuucugcauuuguauaauuucgcuuugacuauagcuuaaaugauuauagaauuaguauguaagaugacuucuccuuauacaccuauuauaucuaauguuuauaauucagaaauaucuugugccuugaagaauggaauaaaauuggcugagcuuggauuccuguugugaaaugcagguguggaaauucaaaaccauuguuuacucaggcauccagucuuaaucaaguuagaacauuuuacuuaaaauuaauaugauuaggccagccaugguagcucaaaccuauaaucccagugcuuuagaaugcugaagcaggaggaucacuugagguugggaauuugagaccagccugggcaauacagcaagaccccguguugcccaggcuggucucaaauuaaaaaaaagaaaaauuaaaaaauuaguuggguuugguggccagcgccuguagucccagcuacucaggaggccgaggugggaggaucacuuaagcccaggaggucaaggcugcagugagcugugauguuaccaccgcacucuagccucggcaacagagggagaccugucuuaaaaaaaaaaaaaaaaaaaauuaacaugauuagcuuuguucacuaggugacuuuguuuuguuuuuuuaaacuaggaaacauguucaaccaaauggcaaagugggugaaacaggacaaugaaacaggaauuuauuaugagacauggaauguaaaagccagcccagaaaagggggcagagacaugguuugauuccuacgacuguuccaaauuuguguuaaggaccuuuaacaaguuggcugaauuuggagcagaguucaagaacauagaaaccaacuauacaagaauauuucuuuacaguggagaaccuacuuaucugggaaaugaaacaucuguuuuugggccaacaggaaacaagacucuugguuuagccauaaaaagauuuuauuaccccuucaaaccacauuugccaacuaaagaauuucuguugagucucuugcaaauuuuugaugcagugauugugcacaaacaguucuauuuguuuuauaauuuugaauauugguuuuuaccuaugaaauucccuuuuauuaaaauaacauaugaagaaaucccuuuaccuaucagaaacaaaacacucucugguuuauaaaacaccuuaauucuacugcucuuuuuucuccaaucaccagcaucuguuuuucagggggugauuuuacuuuugugaauuccuuagccuuucuuccuuggugcauaaaguuaaaaugcacaucagcagaauugcugcauauuaacaucucaggacucuucucuuguaaagaagcugaaauucguacuauauuggccaaagugagcgaguuaggugaucuugguuucaauuuccgagccuuuguuaauauggagaauuaugguucauaucaguuauguaggaccuuuggacccaggguccuacagauagauauggugugcccagauuuuaaaaauaccuucaaaaauaaaaaauacauucagugacauuuucauggugggagcucuucuuucugauauggcaguuacacuuuuucacuuaagugcuuuaguuuagacuaacuuuacaacuucuauaacuuuuggaaccaaguuuaguauagucugauuacauuccauucaccuaacuuuagacauucguuuagacaccauaacuggagugauugugcuucuagauguggcaaauccaguguuaacacauauuucuggcugagauuuuggaacuagcuaguaacuggcuuguguucuuuaagcauacuaacaucacuaaaucuuaggauuuaggauugcuguaaagauguaaguuguguauguuuggcaggucacauugaauggcagugauaaugauuaaucaaagaacaaaugucauccuugaucuugccuaauguaguuuaugugccaaacuuuccaggguuuuguagucaccuagauuuuaagcugauagcauagugcuucagcgguucuucuaaccgggguaugcaggaacauggcugcagacacguuuggguaaacaggcaccuucugacuucuucauuguuuccuguaguucucccucuucccacaaagcugucagcgcaguggaagagguugcacuucuccgagagaggacagguuucuguuaagaucaccaaguagcugugcuuuaauuagagccagacaagcuuucaagguccuuuaaguauuugaugaucaacugaacacguuucuauucaaggagaaaacaccauucaguaagaagauggaguagauaucagauaaaacaauucacguuuaauauguaaauguaccaauuaugugauucaguuucaacuuucaaguacuuccugagagguuaguacauuauuauugagcucucacagaaagcuuaaucauagauauaauuaaccugauccaaaugaguaaaguggaccuuagaaaggcuaagugaucuuucucuggcuauccagcuaguaguaaugaagucaggucuugaaccccgguucugcugacugaauuggaugcacuauaguacaggcuuuuagcaccgaagugugguccucagaccagugccugccaaccagauguuacuggucugugaggaaauaaguacagauacugacaggaagcuuuuauaaacaauuuauuggaguguuuuuguuucuguugggucuaauuaaaaaaauuggag

SEQ ID NO: 17697 - RNA, 282437 nt, Homo sapiens
uucccauugcggguagccccggcggugguggcggugguagcggugguggcggcggcaguggcggcaccgccuccuccucacauucccgggguggcgggguuagaugagcggccccaguagcggcgagggcggcgcgggggggaggaggagaagaaggaggaggagaaggaggucgcugucuuuguagucucccugcugcgggagccagaggccgccgccggagccgucgucguuggaaaagggcugugugugcgcgcgcgugucugcccgcccggcccgcggggacgaggcggcggcggcggcggcggcggcgaggaugaugaugugcgcagcgacugccucccccgccgccgccuccucggggcucggcggggacggauucuacccagccgccaccuucucuuccuccccggcgccgggggcgcuguucaugccgguucccgacggcuccguggcugcugcggggcuggggcuggggcuacccgccgcggacucccggggucacuaccagcugcugcugucaggccgggcccuggccgaccgcuaccggaggauuuauaccgcugcgcucaaugacagggaccaggggggcggcagcgcuggacacccagccuccaggugcguccccagggugcccuuccuugcgccccaugccgcccuuccuugcgccccaugccgcgcgugcacccgcgugugugugugcuugcguguguguaccugcgcauuuauugagcuuucaguccgcucuggaugucuguuggcaggagcacuuaucgagauaggagggugcgguggcugcaguuucucgugugugugugugugugugugugugugugugugugugugugugucugccugccuauguggggggauagugaggggugguaggggaaccugugaugcuggaaaaggcgauggugcuggucggcugugacacguguguguaucguugagguaggagguggcauggguagagaggguaagaggaugauacacgaagagaauugcaacaguggcaagggaaguggcguuuucagugucucugccgcaauguuauuugcacgugccgccucucccaugacauuccuuccagcccuuuccaccucccuucaaucugccuuucaccaagaggagucaugguauagauugguugaguuuuggauaagcaggcccgagggauaggcgugagguuugcuuuaaaaagauuuaugaauaagggacgcagauggagaucuguguggaugcgaaaggugucugauagagauuuuuagagcuguacuuugauaaccgggccuuuuggucuucuagaaaugagguugcaguuacucuugugaucugaugucccaucggccauuucucuucauccucuguucgauuuccucuguuacuuacaggcuuuagaguagagaggguuuuguagggaaaaggggaaaacugcagaacuucagaauaugacagcugguacagcguucaacugccacuagcuagaaaaucugaauagcgcguagauuugucucuuuuacuuggguuggcuacaccuucagcuuccuugauguagauguucaguugguuucauuuucuuuuucuuaaaaugugggugcuuuuuuuugcugagggcucuccuauuguuuucuuuuccaugcccuuacaugccgcauacccugaagguuggugacugacuuguuucaccagcuuugacagugguaauugggaguuggcuucaucuuuuuuuucccacagcuucuugcaguacauggggaaaacauaguaggaaacugucaaaaugaguuaaagaguuuacuguuauuuauugaaugugcaauuuauuaggcaauuguuaggugucuuuuucucccauuaugaaagggacgaggcuguaagucagguauuuguagcuuaucacuagguaucauggcuuaucuguuggagacaguuguaaagcuggagcuuuguucacacuuuuucuagguuaaccaguuuucucaugucugugauuguuuacaggauugggcacagcaguaguuuuaccauauggauguaaacguguguaacuauuuuuugcuaucugaacugaaggccagaauggcacaagucuguuucuugcuaaugcuuuugaaaauagcacaaaacuacgugagacaguuugcccugauaauuagguauaauuuugaucuguaaaucucuaaauuauggcaccgcaggaacaucuuuacaaacuccucucaaagaauuuaaauuuauuuuguguaugguuuccagacuuaugcaauaauuuuugacuuguauauuccuguuuugacuuccuacuacuaguguaauaugauuucuguguaucuagaacuauauuaacgguuuuagacaaaauuaacauagauuaaucauauaacauuugugaaugauuuuuuagcccuugguccauuuuuguacaagccgucaaugaaaaguaaugaagaauuaguucaaguauuucaagaacuacucauggaaaucagcauuauguuaugauauugccugcuaaugcuuguucaacgcaacauuauuguuuauuuaaguucacauuauuuuauuacaaaaaguagccugcaacuacucuauugaugauuugauuaagaauuaaaucacauuucuuauuaaagauguugaggaaaguagacuugggguuucggcucugaaugaaugauagaauuauuuguauagggacacaaguuaaaggagaagaugauaucuuuuagagagacugaauggagcaauaauagagaaugaagcucuagugagcaucagguuuaaaggugugagagaaaggagacagugaaggaaacggaaucaaaauuaagaagaaaaucaugaaacaguagccucuguggcucuaggagaguggauugaaaauucucagaagugguaaauguugaagaaagugagaaccguuuucaggucauugauaacuuuugaggaaguggucagaauagagggauguggugaggagugaauggaauguguuuuugguaacucaaggggauuucaaaguugagggaaggauauucaaguauaggagguugggugggauaugcaaauaugggaggcuaaauggagagacagagugaagaagugagagaggggauaauugauaggaaaaggucaaagggaucucagggacaggaagaggucaaagggaucucagggauagaguuaaggugacagguggagagguuagccauugaaaaaaggagcaguuaauauagaagggguggaggugaguacuuguaaauauaaagacugggaguuuauugaggauaggcaucauauccuauucguuuugauaaucccaaugucuagcacauuuuuuggcaugaauucuguaaacaucaagugccugcucugugccaggcaguauugcagaugcugaagauguagcggugagcaagauagacaaagucucugccgucuuggaaaauccacuccaaugggagaaauagacaacucauaauuucacuuaguaauaaguaacugugaaggcaauaaaaccuauuucaugugauagggcaauuuguaguggggcuauuuuagguaacauggucaggaaaugucucuuugagaguuggcauuuaaauugaauugccaugaugaggaggcagauguagaggaagaauguucugggaauuuauaaaggccuugaaaugggaacaggcuuguguucaagaaacaaaaacaugaugagugaguuaucagucaaugucaaaugaauuaauuacucuuugcuuuagguguacaguugagaaguugagaguuucaaaccuaauggacucagugacuuugaugacagucuaacaaagugguuaagagcuugggcacagaagcuagacugguuuugcauccugguuuugucauuugcuagcuguguaacuuugaguauauuacauaacuucuaugccucaguuuuuuaaauauguagaauggggaucauaauacuaacaugaauuguuuuguagauuaaaugaaucaauguaugugcuuggcauguugacugcuaugaaauauuaguuacuguuuuuugucuguuuguuuuugcugagaaugagggguguggggacuugaagagaaggcaaggaucaugucuuacucuuuuauuuuuggucucagugacuguguagaaugugggaauaacucuuucauuuauccagugacugaauagauauauuuuuggaugaaugaggccaaucaaaaucggaacauucuguuggggaaagggguuggacaggaaauguaugaaggaauguaugaucuguucugaaugugaauggugguauaaccaugcacuugggaggcaccauagcacaguggcuaaauguuagagcacuggagguagacucccuuaguucacgucuaccuuuuucuacuuguguuaaauugggcaaguuaauuagacuuugucuguuucuuuacuuguaacuuuguaguguuaucaaaaggacauuauguccgcaccugguaagugcccaugaaauguuaccuguuguuauuauuaaaaucacauuuaaaauuccaaccagcauggcacuguauguuuuuccacacaaaauagaaauggagaaaaccuaguugaguugauuuaggguuaaagaaaaaagaaauggaagguuuuggggacaguguuugacuauaugguaaaaaggaaagugaugccaagagggaacugauagacuggaagauaaagaggagucagaguaucuggguccugaaguccuagaagaacaauguuagugaaaacaauagaggggauugugaccaaaauggggaaucuaaacuuaacccccuuaguuuuuucagcugcuuuaucucuuucuuguuagaaaugguauuugaguccauccuucagaugcaugggauuuugguuguaagagguuaaguagucauuuuagcaaaaguucagggauuauuuuauuuuacuuauuuugaggcaggcuggagugcaauggugugaacauagcucacugcagccucaaccucuugggcucaagugaucuuccugccucagucuccuccaguagcugggacuacaggcaugcaccaccaugccuggcuuguuuuuuauuuuuuguagacacagggucucaccauguuguccaggcuggucuugaacuccugagcuuaagugauccucccaccuccaccucccaaagugcugggauuaugggugugagccaccaugcucagcuugcucagggauuauuacuuggcacuaaccauuggcccuauaaaaauuuauaagacacaaauucuagacuugaguuuacugucuaucuggaagugcaagauacaaaggcagauacuuauagaaguguuaaaugaaaugaccaagaaaguauaaccuacuaugacaaaggcauggcauucuaggcuggcuuaaaagcaucagcagagacaggaaagcacaguuuguauguagguaacaguaggaauucuguuagagcuagaaugcaggugucaugaaggacaguaguggaauucauucuggaaauggaggcuuuggcuaggauggggcaucuugaagaccaagguaagaauuagauuuuauucaguagacacugaucacccuugaugguuuuaagcuaugaagagacguuauuuauuguaggaauaugucaggaaguaaugcgggauugaaucuguauguguacaucuguauuugugcauagguaguaauuuucuucauguagcuguuauaucaguggaauccuguauaguguauaaacacaaguuaaggcaaaaacugcucuauugguauacugguagguagaaaugugaaaugaauuaguuuccuaacucaagagaagaaaaaaaucuugccucugggcuuaaaaggaaaauaaaaaugucaaucuaaaaauacuuuuguccuuuaauauauuuguuuaaaaaaucaacagaauagucucacuuuuuucucaaaaaccagauuaaacauuuagguuuucugaggagggguuagguuaauugagguuuaauuuauauacaauaaaauucauccucuuuaaauguucauuugaagaguccugaaacuaucaccacagucaaguauagacuguuuccaucacuucauauaaaaaguucugucaggcccuccuaccccugguuacugaccgcugcaaaucaguuuucugucacuaauauuuuaccuuuucuagaaugucauauaaaucuagcuccuuaagggcagggcccccagguauuguucaucuuucugucuuguaucuguauuuccuguaaguggaagcuagaccuuaaggguuuauuagguguucauuagaaaauuuuuuagcaagaauauuguauauggcgcuggguacugcauguugcaucccauccagagguugugagguugucucacuauuuaauauguuaaaucugauuacuuggguaagacgguaccuacuagauuucaucucuguaaauguaugcuuuuuccauuuguaaagaacaaguaaucacaggguaaaaauuugagcacauugugaaugccuuuuaccuaaugcuuuuagcauucuuugauaauccuugucugagucaauaauuucauuagggguugcaaaaugaugaauuaaaaaauaauucuguuauuucuucuauguuuauuagcugguacucuucugcaaagaagaguuggccuucacugacugucagugaaauguaguuucuccuaauccagcagcauaaaugcuuaauucucuucccucauuagccaaauugguguaauaguccaguggugguguggcaggugcugugguuaggcuuucagaucccgcuuucaggcacauguuccccuagcucuuggcaauauuggcagcuaaaacugauugcagcugagucccacuccacgcauugcccugagccaagaguugccucccccagagucaugccuccucuucaggggcaguuuacaucuaauaucuauacaguguagggauauaaaugccuagcgcuuuugcuauaagacaagccaaccuugaagucuaucccaacaccagagagcucucccaugggucuggcugagggcuuccugggacugcauugcagaucaacuccuuccucuguucagucuuacgucuuucacugccccacaguuguugguucggagggcacuccgcaauaaacuuccggugugcacaucugcauuugagagucuguuuccugggaacccuccuacccaaagcaguuggugccaggaguggucucagaaaguagacuuuacagugagguuuugaagcuggauuauuggcuggcuggcuggcaaugagaaucgauucuggugcuagauggagcacuaauacugauaacgcuuggcaugcacuguagcuaugcaacuuaaaacuuucacugguggugaguuggaaugcuauuccuguugaagggaaugcacuggugagugcacuaggcuuuugagaaguucagagaaauuaauuaugaggacaaucaucagauggcuuuugguaaauaacauugauagauuggagaaagaugaugcaagguggaagauaauugggggcaaaauguaaaaggaaauuuauuuagcaucauguaaagaaacacauauacaguaagaggaaaaaucuaaggcuucaacccaaaacuuaauuuuaaggguagcagagcaccaagguagguagaauucucucucagcuaugcuaaggucaguguucugguugggcaggaauccugacccuuaggauggggcaucugagugcacuugaaaacccugaaaccccaaauuccucuuaacccucugggccugcagaaguggccuucuucuacuagcuagagggguugcuugcagacugugcugucccucuuacccccagcuccuccucucucgccuacugacuaucaccaaaccaacaacuaggguuaagucacaagaacaccuaguucggggugcuggaucugcgaagggaggaagggacuguacacacaaacacacacacacacacguucccaaacugcaccaaggcaccccaaagcaccaccacagacacaaaagaauaccaugggauauuucagaauuuuaaaggaaacacagcaauaucugucacaaauuacuagcuugagguaguucacgguuuugacauuagcucaugccacauuucuuuugaugaugucauauuuuugcaggguuggauuuuuacuaguugugauacagaucaagcacugugcaaaaaucaguguggaacaggaaaggaggguggcauguucagucugauuccaaguuugagaaguuguucugugucuaacaggcacacaugucauauuaucaaguaauugaaguuuuuguuuguuuguuuguuuugaggcagagucucgcucugucacccaggccagagugcaguggugcgaucucggcucacugcaaccuccgccugccagguucaagugauucuucugccucagccuccugaguaguugggauuacaggcgugucccaccacacucggcugauuuuuguauuuuuacuagaggugggguuucaccauauuggucaggcuggucucgaacuccucaccucgugauccgccugccucguucucccaaagugcugggauuacaggcgugagccacugcgccuggcccaguauuuguaguuuuuaagaaggaaauaaaaauauuuuucuuccaauuuauguguuauuuuuucaaaugucuacucauuuguuaggacaugaauucuuguuauuuggaucuaacuacuuaauaaacacuacuguuugguauuucuuuuggccuaugagugcauggaaaaauuaccgaugauggcugugcaugggcccaauaaaaggguuuucauucaccagugcugaucuagcaacugcugcugcugaauauccagccugacagcagcagagaucaaucauccuucaagcaggccaaccaguccuuauacaguggaaaggaccaugauucauuuugauuggauuugagacauauucugggucugaauuugucuuuccagcagggucucacccaggacuacuguuugagggcuugcaggauguuugauccucuacuacagggaucauuucagaauaagggacccacuguuauguuauguuauguuauguuauguuauguuauguuauguuauguuauguuauguuauguuauguuuugagacggagucuugcucuguugcccaagcuggagugcaauggcgugaucucagcugacugcaaccuccgccucccggguucaagcaguucuccuaccucagccuccugaguugcugggacuacaggugcacaucaccacgcccagcuaauuuuuguguuuuuaguagagacgggguuucaccauguggaccaggauggucucgaacuccugaccucgugauccggccacgucagccucccaaagugcugggauuacaggcgugagccaccgcgcccggccgggacccacuuuuauagaauaggagaaucauuugucccaucuugcaccacaccguccagaagcugaugacuugauagagcaguaaaacaguccuuugauggcacagcugaugaugagauccugcagcuugggcaugaugcccugcaagggugaggcgcccauucuccaguguucccaguaggaagaucacaugaaauuaggaguggcuccgcauagcaucacucugugaaucaccugggcaguuucugcuucccaucuccauagcucugauggcaagggguuaaaagauccugguucucagaagagaaacauuuccaacagagggcgcuaugagaauccuguuauacuuuaaaguacagcugccacuaggauuuggggcuccuuuucuaaauaaagaagucaccaggcugggcacgauggcucacgccuguaaucccagcacuuugggaggccgagaugaguggaucacgugaagucaggaguucgaaaccagcucagccaacauggugagacccuguuuguacuacaaauacaaaacaauuagccgggcauguuggcgcgugcuuguaaucccagcuaauugggaggcugagucaggagaacugcuugaaccugggauguggagguugcagugagccgagauugcgccacugcacuccagccugggcaauagagcaagacuccaucucaaaacaaaaaaaaaacaacaaaaaaagaagucaccauuuggacaggguuaauguccuuguucauguggaggagguagggcuguguuccacaguggagcauggagguuuggcacacaggugaucuauaaggugucucuugguacuuccuuguccaguguuugugguaaauggacacgagaaaggcccagugaccaccccaugaagucagccaccuggaccaacagaaauacuagccauagauuaaaggaaucuagaauggcuaguagagaagaguuguugauaucaauuuuaccgucuguaguggcuggggcugugguuugacccacuuuccuuccucuggaaaguuucuccaggaaaugacacucaccagaauucuggaggaacuuuuuccaugccuuauuugaagcaagugaauccuaauuguauaauaggcgaaauauagugaauccuguauuguggaacccagagccccugcccagcacugaugugcucaaaauucccccacgacugcugggaacauugguuggcuacagacucuucccuaguuccaauaugggcauugccuuuggcaauaggugauggcccuaggugauggaucauucuugggggcagccugaaugaacugguugaucggggcauuuuaugguuuuuagugcuacuguaacuaguuuaguuuuuccuauuuuucaguuguuugauaugaauauauaacaauacaguugcuuuugaauguuaaccuuguaucucugaucuuguuaagcucauuuauuaacuuuaauaguuuuguaaauucccugggauguucuguguaaauaaucauauugucuuucuuucugaucucuagauucuccuaccccucagccccuacuuuauuccaauuacuuaauucucccuuguuuuuaaucugagagaaaaacaacuacaaauuaaucuuacaguuuuuuaaaucauuaaguaugauauuagcuguagguguuucaauggccucuaucaauuugaagauauucccuaguauuccuacuuugcugauaguuuuuauuuuuuauauuuuaauuuuuuuuuuuuuuuuuuuugagacagagccuugcucuguugcccaggcuggagugcaguggcauaaucucggcucacugaagccucugccucccgggauccagcaagucuccugccucagcuuccugaguagcugggauuacaggcacacgccacuaugccugacuaauuuuuguauuuuuaguagagaugagauuucaccacguuggccacucuggucuugaacugcugaccucaggugauccaccugccucagacucugaaagugcugggauuacaggcgugagccaucgcacccggcuugcugauaguuuuuaauuauaaauguguauugaguuuugucaaaugcuuuuccucuaccuguuaaaaugaucauauaguaagagaacaaaaggaaaauugaauuacauuaauuaauuuuugaauguuaaauuaacuuugcauuccugggauaaaaccaucauauuuggaauguauugcugaauuugauuugcugguauuaugcuaagaauuuucagguuuauauucaugagggauauuggucuguaaucgguuuuuuuucuuuucuuuucuugcuaauccugucaggcuuuagaauuaguuauccucgucucauaaagugaguuacauaguaauccuacccuacccaguccuacccaauuuuuaaaauguuugcguaagauuguuguuauuucuucuugaauguuugacagaauucaccaguggcaccaucugguccuggaauuuuauuuuggggaagcuuuugacaaauucacguucuuuaauaguuagagcguuauucagauuuucuguuauuauucaugucaauuuugguaacuuguauuuuuuuggagaaguucauucauuucauacuucuaaguuguugaaguuuuuagcaugaaguuauccauagcauucuuucauuauccuuuaaggucuaugggaucucugauaauaacucccuccuuuuuuaaaaaaaauauuuuuuuaagagcaguuuuaaguucauagcaaaauugagaagaggguacagagauuuuccaucuaucccuuucccccacucacgcauagccucauccauaucaacaucccccaccagaguggcauuuuuguggccauuguuuaaccuccacugacacaucauaaucacucucaaguccagaguuuacauuaggguucacucuugggguuauacauuuuuugguucagaaaaauguauaaugacauguauuuaucacuguaguaucauacagaauauuuucacugcccucaauaucaucugugcuccaccuauuccuguuucucugccacucaaccccagguaaucacuuacugucuccauaguuuugccuuuuccagaaugugcuauaguugaaaucauacaguauguggccuuuucagauugguuuccuucacuuaguaaugugcauuuagguucauucuuuuuuuguguaugagacuugauagcucauuucuuaccacugaauaauccaccauguagauguaccagaauuugucuguucaccuacaauuuggugaguuuggaggacaauuggguugcuuccaaguuuuggcaauuauggauaaagcugcucuaaacaucugugugcagguuuuuguguggacauacauuuucuuuuuuagaaauugacaaaugacauuguauguuuuuauaauguacagcaugauguuuugaaguacauauacauuggggaaugguuaaaucuaguggacauguuuucagcuccuuuggguuaauaccagaaacagugauugugggaucacgugcuaagaguagguuuaguuuuuguaggaaaucaccaaacugucuuacaaaguggcuguuucauuuuucauuuccaccagcaauaaaugagaguuccucuugcauuaaagccucgccaacauuugauguugucuauguucuggauuuuggccauucugauagguguguaguagaaucucguuuuuuuuuuucauuucucugaugacauaugauguagaacaucuuuucauaacgcuuauuugccaucuauauaucuuguucggugaggugucuguuaaggucuuugccccaucuuuaauugaguuguuuguuuucuuauuguuagaguuuugagaguucuugguauucugugaggguguaacugaggagauggggaaaaaaguucuugguauuuuggauaacaguccuuuaucagaugugucuuuugcaaauauuuucuuucaaucugugccuugucuucucguucucuuggcauugucuuuugcagagcagagguuuuuaauuuuaguauucagcuuauuaauuauuucuuuaauggauuguaccuugguguuguagcuaaaaaguuaucuagguuuucuccuguguuauuuucuaagaguuuuauaguuuugcauuuuacauauaaaguccguuuuccauuuugaguuaauuuuugugaaggguguaagguuuguuucuagauucauuucuuuguaugugauccaaagaaccaacuuuuggcuuucuuaauuuucucuauuauugaucuguuuucuauuucauuggcuuuuccaucaucauuguaauuuauuucuuucuacuuucuuuaaguuuacuuugcuguucuaauuucuuaagguggaauccuaggccauugauuuuaaauuuuucuuccaauauaaguauuuaaagcuaugaauuuuuaucugggcugugcuuuaguuacaucccacaaauuuugacugcuauauauuugucauuuaguucaaauuauuuuccaauuuauuguuuaaaauuauuacaacuuucagauaugguguuuucuuacauauuaauauauuauuguuauuacuuucuaauauaaaccuuguaugauuuugaucuuuaacauuuauugagauuuguuuuauugcccaggauauguucugucuuggugauuguauuauacacacuugagaagaauguguucggucaucuuuggacaugaaguucuauaaaugucaguuaaaguuggaugauaaguguuguuuggauguuuauguuuuuauauuuaaaguuucuccucuuaggcaacuaguauagaaccuugcccuuaaaaaaagaaauccacugucaaucuuugccuuucaauuggaguguuuagauuauuaauauuuaauaugauuaauuauugacauauuuaccauaucaacagugauaggucugccacuuuauugucuucuguuucucuuuuuuuguuccuuucuuccuccuuuucugcuucuuugggauuauauuuugggauuauugggaguauuucauuuuaguugcucuauuggucuuuucagcaauaucucuuuguauuuacuuuuuuuaugcccuagggauuacaguaugcauaccuaacuuuuuacaggcuacuuaggguuauuauuauacuaauucacuuaaaacacagaaaccuugcaacccuacagauccuuuuauucuccccucccccagagaccuuuauguuauaguugucaugcauacuauacuuggcaaacaucaccaaacaauguuauaguuuuuguugucgacagucauguguacuuuauagaacuuagaggaaaaaucuaguauuuuguguuuuccuauauauuuauuguuucuauugcucuuucuucauuccugaagaugcagcauuuccuuucagccuaauguugaccuuagcuuuucuagcagaucagucugcuggggauacauucucuuuguuuuucuuugagaauguauuuauuuuacuuucauuccuaaaggauauuuuagguggauauauaauuccgaguagaugcuugcuuccuugagcaccucaaugaugccauuuagcugucuuuucacuucucugauuucuggugaaaaaucuuuguaauguaaaccuuauuccccucugugugguguguaauuuuuuucuagcugcuuucaaaaauuuuuucuuuguuuuugguuuucagcagcuuaauuugauguguaucuagucauuuucuuuaaguuuauccucuuugaagaguacugagcuucucaaaucgguaaauuuuuggcuuucacuaaguuuagaauguuuucuaccauugugucuuucuucugaccuuacaaaauucuaguggcaauuaugauaaaacuuuugagauuguuucacaggccucuaacuguucagucuccuaucaauuuuuuuucucuguuuuucagaugagguuauuuuuauugauacacguucagguucacagacucuuuucucccaucuccauuuucuuauugaguccaaccagugaacuuuuuauguauuguuuauuucacuuuuaacauuuacauuugguucuuuaaaaaaaaaacaaaaaaaaaaaaacaaaaaaaaacuucucuuucccugccgagaaccucuuuccauuccauucaguuguccuugucuuuccucaauguagcauauuuauagugguugccuuccagucauuguuggauaauuacaacaugugcaucgucuuaggguuggcaucuuuugauugucucuucccuugaaguuguucacauuuuucuuguguuuugcauugugagaauuugggauuguaucuuggacaugguuaauguuauguuuuguaaacucuaggguuuauuauaauucucuggaggauguuguguuuuuuguuguuuaggggaucccuuucugugucuuacucuuuuucaggacuucuuacccauuuuccaucauaucaguuucuuuucucaguuccucuggccagaaagaguuuuaacuuggaauuuuaacuuuuggguuguagcccuguaaugcagugaucucuuccuggccuucaggcaaagcuguuagugaaaggagaaaaacaaccaaacugggaaauuuacucuucugugaaucacuuuuccaaguuuugacuccccuccagaauuugcuuuuauuuguuuuucagaguccugaaguacuuuuuuugucuuuuuaaaaauuuugcccaaaguaguuguaaacaguggggaaaauaggcuguuuugggguuuaugccaauguacuggaaccagaacucucuuaucuggcuuuaaaaaaagauuuucccuuuuauugauuuuuagcagcuugacuguauuguaccuaaauauggugugugugugugugugcaugcgcacgcacacacgucugugucucuguguguguguauccugcuugguauccuuucaguuuguuagaucugugugaugucaauuuuuauuuaacuugcaaauuuuggccuuuauuuccucaaauauuauuucagacucaauuucuuauuuccuucugggaauccaauuauauauauaugauacuguuugauaucauaugugucuauaaucauauauaugacauauuuauaugaccagauaguaaauaacuuagacuuuaugggccauagagucucuguugcaaccaugcagcucuguucuuuaguuugaaagcaaccacagacaauauauauaaauggauaagcauggcuguguuccaauauaacuuuauuuacaaagauagacaggaagcuguuuuuggcauguagacuauaguuugcugaccccugaguaggugguaaucguugcuggagcuacauugugaauucagggaaucaaagaagugcaaaacagaaauguuggaaauaacuacaauguagguagcggggugcauaaaaaugaggagguaggagauauggcuagaaagauauguuaggacuagguuauuauguucccuguauugcuuuauuugaaaauaguauggaacaaucauaggguauuuuuuguuuguuuucuuuuuuuugucuguuuuucugagacggagucucacuccguugccaggcuggagugcaguggggcgaucuuggcuuacugcaaccuccgccuccugaguucaagagauucuucugccucagccuucuacauagcagggacuacaggcacccaccaccacgcccagcuaauuuuuguauuuuuaguagagaugggauuucaccaucuuggccaggauggucuucaucucuugaccucgugauuugcccgccucgaccucccaaaguacugagauuacaggcgugagccacugcgcccagccaaucauagguuuuuaagcaauguaaugguagaguuaaacuuucaauuuauaaagauaaucucuaguaguguuauagaggaugaaugaaaaggagcagaucugcaaagcagggcuaccuuuaaagagacaguugcaguaacucugacaagugaaaauacugagaaaagauaaugggaauagauggaauaaaguggauuuaaugauauauuuagcaggugacuagaucucaagugcaaauauaauaaugauuuucaucuagauagaaagggaggaagagcuaguuucucaagaguccauucuugggauucuucucucugaauuuucuucuuugguugucucaggcuuaugauuucagauaugcauuugacuuccuggucugugguuuuuagguaaaaccucuuuucuuaaguucuagccuguauuuugaaaagucuacugcuaggauucucucaguccuguucagauacauuauguucaguauauucaaagucuccucgugaacauacugucacucacaaacugccucuuuucccuuaggccagugaaaccgaagucugagauagguucuugagguuggcaauaagaaauuauaaugagccaacacccacucacuucaccuccuuuuuucaggaggcagggaaaagugggaaagugaggcuggacaugggaguauuuagaaauaguguuuaauaauguuuaaagggcaagaaggaaggcaguagcuuaaggaaggagacaaauaauuaaucuuuuggauuagauaaccuguaggagauguucuuaguguccuagccauaucccuuuggcauccauuugcauacugucuucugcaaacaucuaugacuaucugccugaaaagaaacacacuuggccugugugcagggcaacucacaugcgccagagaguuaaugccuucagaaaaacuuuccaccagugauggauggggaguugguagauaaauaccuuugucucaccugcauuuaggauaacugagccauguuuucugcugucuaccagaguucuccacugguucaggcccuaguuccccaucaggguaacuggcuucauaauauguccuuucuugacuuccuucuuuucccuguuuuacuuuuguuuucccuacugguguuuuuccugggaucaccucucaaaauaacuacugcacuugaauucuugaauugacgucugcuucuggggaaacccaaaccaagguagacauuugaauuuggcaugggaauaauaauaaaaauguguuuagcacuuacuaaauaccaggcauaauucuaagugugacaucauccagugggagagguacuguuuucacccuauuguauggaugagagaacugaggcacagagagauuaaaguaauaccaagaucacagugcugguaaaugacagagcuuguauuugaacccaagucauuuguuucuaaauucuguacucuuaaccuaucuugacauagcaggcugaaggaaaagggcaaggauaguaaaaaagagagagagaaugggaauaauuaauagaguaaggcccuggguuagagaucauuucaagguggguggaagaaaagcaaagggaguacauuuguaauggugucucuauuuuauugguuaaauagaugguuagauucucugcucugaguugauggguaggggagggauuuugaaguagcuggaaagguucuagauuuuuaugguagauguaccuugauagagaacuuaacuggcucuagaccagcagucuaaugauguucaguaacuccaauagcuauuauuguuuaggguuguuauagcuuauugaacaagguuuguaacuaaccaguauagaagugaauauagaacaugagcagauagcucacauuagaagugauauauguaguaaagacuuaagggacaggaagaggaagaaaaaggagccaguaaagaagacugagaaggaaccaccaucagagguagaaggaacacuaaaguagagguucuagaagcuggcgggacagggggcagggauguaaagaaguaggcacuguuugguaguuaucguauguaggagaaugugaaggauaaagacugaagaugggcaguugaauuggcuacuagaaaguuugugguauugagaagucucauagacuugcaugaguuugauaguaagguguuaaaaaacuucaauacaaugaaguuuuuuuuuuuuuuuuuuuuuuuuuuuuugagacagggucucacuuugucauccaggcuggggugcaguggcaugaccauagcucagugcagccucuaacuccuggaccaaagcgaucuucccaccucagccaucugaguagcugggacuacaggcacaugccaccgugccuggcuaauuuuuuuuuuuuuaauagagacggggucuugcuauguugcccaggccaggaccauuuuuuucuucaagaaauuuagugaugaagagggauagaggauuacuuaaacuuuuuuccccuuuugaauuggagaaugacaguaggccucuaagguuagaaaccacagaaaaaaagcauaaaggguaaacaaagagagggauguaugguugagcaaaaucucaaggauggugaaugaaaugggaucugguguaugagaggaagugcauacuuggauagaguaagagcugucucuuuugggaugggggaaggaggaaguuucagauuugaaaaggucucagggacauauuuuuagccuuuuuauguuucugugaagaauuccagauucuuuuucugaucuguuuucuagaucuuaaauuuucuauucagcuguguccuguacacuuaaauccaccuauggagucuguagugucaguuauuuuucaugucuaguuugauuuuuuuucaaaugugcuugguuguuccccauucccugcagauauuuuaaugauagucuuuuauuucuuuaaauuugauacacauguucuuguugcaaucuuuccgaaaaucccaccaucugaagucuauauaggugucuuucuguugccuaguucugcuguucucacucagagugccuuguaucucuguguucuuaguuauuugcuugcucucauuccucuuguuguucucugaggccugggaugaauagauuguauucaugauaucauuagaaaguguuacaguuuuacaauugcuucaaggcuugaguuucccuggccuaccuagccuauguuuacuuaagaguacaaauaugcaugaggcagggucuauagccaaagcuuuucagagaguucucuuccccucacuuaugcucccuuccauauuccccuacccucuuuucuuuuuccuucugcugcucugcccauugccaagguagcuuuauuuauaguccuccccccaugugaagacuuccaaauaagaucaagagacugaagcuauauauaagaaaucuguuuucaucucuccccuaaaucaaguugaacuguuaaaaucucuuucuuauuacuaauuagccggcuagguuaaguaaauaaaaguuuucuacuuaguaaugagauaacuauuccucccuaauuuauucauugaugcuugaacaugauaggaguaucauuacauuaauuacacagaaugaaucuggcuucuauggaaaagcuucaguuuacauaaggugcuucauagauugauuuuuaaaaguuggucuuguauccagugaccuugauaauucccuuguuaauucuuuauuuguggauuauuuuguauuuucuauaaauauaauuaucuacaaauaaaaaaugcuuuacuuuuaauuuuuaaccauuaugacuuuuauuucauuugcaucacuuacugaccuucaauauuguguuaacagaaguggugauaguacaaauccuugcauuuuccuccuaugccuaaguggaaauacuuaauuuuucaacauucaguauaguugaauacacuguuaaaaguagguuuuuuauagauaaucuguauuagauuaaguaaaaucuguuccugguucaccaaggaguuucaucacuagugguuguugaguuuuaaaaauacuuuuucuguuucuauugaagugaucauauguuuuguuucuuuuguucuguuauuauauugaauuauguugauuauguauuuauucuuuccacauguuguuagacaaaauuauuuguagguaaauggcucucucuuuuuuuaaaaauaaaagggguaauacacauaccauaaauucacccuuuuauacaacuuauugguuuccaguauauucacaaagucauacaacuaaacauuuuugucucuccauaaaucccaaagcuauuagcagucaguuucuauucuccuuucuaucaguuuuuggcaacuacuacuuccuguuuuuaugaauuugccuaccuagacauuacauauaaauggaauuauacaauuuaugaccuuuuguugccauuguuucuuucacuuagcauaauguuuucaagguucauccauguuguagcaugagucaguacuucauucuuuuuuuauggguaaacaacauucucuuauauggaagugcuacacuuuauacauucauuaguuggugagcauuuggguuguugcuauuuuuuggcugugcaguauuuuugcuucuauguucauaggagauauuggucugaaauuuuuguauuuugaaauguucucuucaaauuuugauaucagaguuaugcuugucuuaugaguugggaaauguuucuucuuuuuauauugucuaaaagagucuaacauugauaauguuugaaagaacuaccagugaauuuuuaaaguauuuggaagaauucaccaacaaagccauccgagucuagaguuuucuuuguggauagauuuugauuagggauccaguuuuuuuucaauauauagaagacuauucagauauuacauuuuuuuucccuuguuuaauguugagaaguuacauuuuuucaaggaauuuauccauuuuauuugucaaauuuaugggcagcaucuguagugaugucuccuuucuuauuucucauauugguaauuugugcuuuuacuuuuuuccugaccauuuuugcucuagguuuauuauauuuauuucauuuuauuuuaaaauauuugcuauauauuuaauucacaaauaauuguacuuauacaugggguauaauaugauauuuugauacauguuuacaauguguaaugaucaaaucaggauaauuagcauauuuaucaccuccgacauuuaucauuuuaucauuucuuugucaugagaccauucaaaauccucucuucuagcuguuugaaguuguauaauacauuguuguuuaugauagucacccuguggugcuauauaacacucaaacuuacuccuacuuucuagcucugauuuugcauccauuagccaaccccuggcuacucuucaacaacucuucuacuuucuacuuuuaugagaucaacuuuuuuagcuuccacauaugaguaaaaacaugccauauucaucuuucuuugccuggcuucuuuaacuuaagauaauguccuccaggcucauccacggugcugcaaaugacagaauuuuacucuuuuuuaaucacuaaaugguauuucauuguguauauauaucacauuuucuuuauccauucaucugcucauggaaacguagguugauuccacaucuuggcuauugugaauaguguagcagugaacaugggaguucugaaucuuuucaacauacggauuuuuuuccuuuggauauacacccaguaguggaauugcuggaucauaugguaguucuguuuuuaguuuuuucaggagccuccauucuauuuuccacaaugguuguacuaauucacauucccaucaacaguguaguucuacuuucuccacaucuucaauagcauuuauuuuuugucuuuuuguuauguauacuaaucuuuucagagaaccaauuuuuggcucccugauaaccucuauugaaugucugcuuuccauuucauugguaucuacucuuauuuuuauuuccuuucuacuacauauuuugcauuuaauuugugguuuucuuucuagcuucuugaguuguaagucuagauaauuuacuuucaguguuuuuuuuuucaguauaugcauuuauguguaugcaaaaggagaugcauuuuguggaaguacugcguuagcagcauucuaccgauuuuguuaugucaaauuucauuuucauuuuauggaaaauauuuucugauuuccauugugacuaguucuuugacccauaguuuauuuagaagucuuguuuuuuugauugccaaacauuugggaauuucuuaguuguuuguuuuuuuuuaauuucucguuuaauuuuuccaugaccagagaauuaccuuaucauucaguccuuggaaauuuguuuagacuuggucugugguccagcauauuaucuauuuugguaaauguucuauaugcacuugaaaagaauauguauucuauuguuguuggauauguuucuguauguaugccaauuaggucagguugauuaaucaugguuuguuuguuuguuuguuuugagacggagucucgcucugucgcccaggcuggaggacaguggugugaucuacgcacacugcaaccgccaccucucggguucaagcgauucuccugccucagccuccugaguagcugggauuacaggugcgugccaccacgcccggcuaauuuuuguauuuuuaguagagacgguauuucaccauguuggugaggcuggucucgaacaccugaccucaugauccaccugccuuggccucccaaagugcugggauuacaggcaugagccaccgcgccuggccgauuaaucauguuuucaaguuuuucuaugucagugcuguuuuggucucuacuuguucuaucaguuacagagagguauguuagaacuuacucuuucaauuguggauuuguauuuucccauuuaacuucugucaauuuuacuuuauauauuuugaagcuguguuacuggaugcauucaaauuuaggaguguuaugauuuccuaaugauuugacccuuuugccauuuagaaaugcucuuuucauuucuuuuaauacuguugccuuaaaaauuacuuugucaaauauuaaaauagccacuccaacuuuuuuugggacacuggagagugugcuugagauacaucuuuuucuguccuuuuagcauguauccuuucauuuaaaauuaugauauuacaguuauuaaaggaagacuuuccuucaguauuucuuguaauauuggucucuugacagugaauuaugucagcuuucauggaucuaaaaacaucuuuauuuuugucuucauucuuacaggauacuuuuagaauccuuuaugugaauuauaucagcuuucauggaucuaaaaacaucuuuauuuuugucuucauucuuaaaagauacauucuuaaagguuacaugauuccagguuacuuucccccaccucuaacccccaucccuccacucuaccaccucccccuccccaccccccagcccuuuucaacacaaagaauggaaacuaucaauuuuauuguuccuuuaagcauaucucuucucuggcugcuuuaaagauuuucucuuuaugcuuugcuuuuagcaauaugaccaugcugugccuagguaugcuuuucuuuggauuuuccugcuuaaaguucccugaguuucuugaaucucucaguugauuucuuucuucacuuuugggaaauugucaguaauuaucuugucauauauugcuuuuguuccauucuuuuuucucucuuucugggauuccaauuauaugaauaugagaccaucugacuuugucccacaugucucguucucuguuugguucaucccauuuuuguuuccgugauugaauucuguuauuuauuuauuuauuuauuuuuggccuguuugcaagucugugaaaccuguuuuucuguaacuuacucugcuuuuaaaaucauaugagaaguucuuaauuucagauguuuauuuuucaguuucagaauguccacuugguucuuuuuuuauaaauuauguugaaaauugccaauugcauuauuuuacacauauuguuaaucucugcaucucagguacuugccuccuaacguuaauaucuggguuuucugugagucugacuaauuuucugguuuucucuugauuaugugucugccacauauuuugcuucuuuugaugucccuuaauguguuuacuuaguguccccgaacuagacuaacacuguguaugaaugaacaugauuuucuuucagaucauguguuuucuccuagagaggugugcucuuugcugugucagacagauagaaugaggaguuugauuaucucaauccagugagggauuacauagaccgcucccucccucuacuaggauucugucuucuuacggaaguuuucucuucccuuuugacccagccucuuuuuuuuuuuuuuuuuuuuuuuuuuugagauggagucuugcucuguagcccaggcuggagugcaguggcgcgaucuuggcucuuggcucgucacaaccucugccuuccagguucaagcgauucuccugccuccgccucccuaguugcugggauugcaggcgugcaccaccauacccagcuaauuuuuugcauuuuuaguagagacgggguuucaccauguuggccaagcuggucucgaacuccugaccucaaguaaucugcccgccucagcuucccaaagugcugguauuacaggugugagccaccgcgcccagccuugacccagccucucuaucauccuucaguguuccaguuacauuucugaggagauauaccacugggaaagcugucuauguaucuagagcuuuucuagauuccagucugucauuucagcccacaugggcaucuaaagcacuacuagucucuuguuuccuuuauuagaguuccucugcuuaagccaagcucaguccuuacucaugcccaagcucugcaguuacccccauggaagaacaagccaguggucucagcugccuuggaagugcucuuccaccucuggauuuuuuguucuuuuaguccucauugcuuccacagcuuucuuacguugguuagucuggucuuugaagcaggcgcauuggccugccuccuaucuaaucacuuacuuuagggaaguggaagucagaaguuuaucuuuauaaaaagaaaaggcagauaauuuuaggagugcuuauuuuuauaagcauagugauguuuugaauaguuuuaucuguguugcauacucauagcuauaaagcauuuuuuuccuuucugauaugggccuguuuaucaaaauaugccccagaucuggggcgagcaaacaaagacccacagaccaaugaggcccaauucuuguuuuuauguagccugugaacuaaaagugguuuuuacauuuuuaaaagguugaaaagaaaauaaaaaaggaagagaauguuuugugagcauuaugugaaauuuggaaguuuuauuguaauauaugcacacuccucucuuuaugugcugccgauggcugcuuucgugcuguaaccauugaguaguugcaacagagaucuugugacucacaaaguguaaaauauuugcuguguggcccuuugcagaaaaaauuucccuauuccugcuuuacaucacaggcucaggaauuuuuuauuucuuauuacuaagagaaauuaagcaaaagauugaaaccauuuuauuccagaaguucuguaaauuuggauuuauuaaaaucuuagcauuuuagaggauuuacaaggaaccucagucuccuucaucucuuuauuuugcaaaugaagcagauuugagugaaagagguuuuaaaauuaugacuacauuuuugguauaaaguauacucaguaauaagcugauagagaaacuauugaucuauaucacugaauaauuugcaaaauugauuuguucuuauauugcagaaguauuugauuuuucuuaagcaguguagcucuuaagaaaauauuuuuggaauuuuuaaaguaaauauuuuaagauaaauauuuaaggcauguuaauagccuuuuccuuuuauugucaaccacaauucuuucaaaucugauggauaugaaguuauuuuugugagaagacugaaagucuuacaggaccaauuccagacauucuucauuaagcuucgauugauuuagaauauaaagcccuaaaucaucagaaauuccaaguuaaauuguuaauguguaagacugguuuuuagaguuucucuuuuauauucccauccucagauauugugaaagguuuaagcuuaguucucaaauauagagauauaaugguguguuauauuacuagcaaauggcauuuuuaaauuuuccaauguugaauacaaauuuuguuuauauaauuuucaacuuauuacuggcucuuuuagaaaacuucuaccucuuccucugcaaaccaaaucaacaacaacaacaaaaaacacaguaaaaguaauuuauaauuaauuugggaauagcuaguucuuggauggccuguacuuaagaauugauggguucagauucauaagaauuguuacaaccaauuaaaugccaucaugcauagaaagaaguauuuuagaaauguacguaaagucauuugaacuuuaaagaaguuccauuagauaaaacagacacaaacauuggucucuaauugggaaaauuugagucaguuauaacuugucuuuaggaaaucuaucugaauuuggauuuauauauucuacuucucugaaaauugguuuggaauaaauuuugaugcuuuuauaaguuauauagaaggggcuaaccucuuaguaguuauguauuccuguugcucaaauaccugauuucacucagguaaucuuuaauauaaaggaaaguugguuuccuaaauaguaugaagaauacguauuguguuuuauuuauuuauuuguucaucugauauuuauugaccaucccugaugcuucacauugaugcaggugcugaaaguacacaguugaaauagacauucaucaugcccucacaaugcuaguaguugaguagauucuauaagcagguauauguauuuauguuuagcauuuggcacuguuaaucuuucucuuucucuuuacuuuuauggcauacuaucuuguggaaaucucauccacauacauaguuuccaugaccuccuuuguacuaaagucugugcaaaauaaucccaaggauaacuccuuagugggccuuucuggcuagagaugcuuuaaaugcacucaugucgauaccauagauguagauaccuuauuuuaaucucugaguaaggcauguagcuguagcucucaacuuccucauuucuccccuuccucacucuuucucuuauacuuucucuuucucuuaaaauacucguugaguacuauaucccaggaacuuuucuggacagaggcuagaguagugaacaagaaagacagggccccugcacuauuggagcuuuuagcuuggcgaggaagcaauacauuaaacaguuccauacauaauuacaguuauuggcuguacaaugaaacauaaauauacgaugaaugagaguguauauuagggaaacucauccaguguggggaguuagacuuaagugacacuuaugcugagaccucgaagauaaguagugguuagcaggagaagacgugguagagaauuucaggaagagggaaaaccuuugugaaaguugugaugaagcuuaacagguucagacaacugaaagaauauccuucuugcuggaguaugaugaaucagguggaaaagaaugcaaaaugaggcaggagagauugauggaggucaguuauuggaagaggaucuuuuaaacgaugucggugcuuuuggacuuuaucuuaagagaauugagaagauacugauuuuuaagcuggggaauuauccacucagguuugugucuuuaaaaguugaguuagguuccuaugugaagaauggauugaaggguauggaugugcagaaaugaguuaagcuuuugcagugguccagguaagagguggugguaaccuagcuuauuagcauugcagcaguaaagaugguguggacagauucaauaacuguuuaugagauauaauugaccagauuuugugauuauuuugauuucaagagugaaacugaaggcaaugucaaggauaacauuuucaucugcuuguuacucuugucuauuuguugacauuuugguauuuugaaguuacacaucuucaaaaucaaacccauuacuuuuuuuccagcaggcuaacucuuccuucuaacuucucuauuuuuaagagugacauugucuaccuccaagugaccuaggcuuaaaauuuuucucuuuugucacugcuguuacuaaauuaguuaccaaaucuuaaggacuugaccccuucagcaucuggaacaaccuccuccccuucguucucccugcauucccucuuccccccgacuucauccuuuuuucuuuauuacagcaguaguauccucuuguuagaucacuaaacugugcuuuccauucaagucucugagcuccuuggggacaagaacugucuuuuucauuuugugucuuuacuacuuugcaucucagcauggugaacauaaaacauauuaagugaaaugaaaauaaaauguuuuccuugcuucuuguuucuugcaccauaauucuuauucuuuaucacauauuuuuuucuguuucucaaaaguuauucaggggcuuccuuuugcuuaaagaauaauuuggucuuaggacuaugugauaaugaaguauccagacuggcugcuggagacauaaaguauaugagcuggggauuuuccuauaguaguuuaguaaaaaguggcucuuaagucccuuugcaccguagcccucacuaccaaaaagagcagauuuuuuuucuuggaaacaucacugacauuuguaaacaucccacuauggauaaaguauaaaacacuucauuugaugccuuuuuaauguuuuaaguuuauguuuuugcagaauucaaauuuguauuaucauuuaauauauauuguauauugcuuagcugccccauguuaucuucucaauagcuacuuuauauguuaguaucuuauauguguauguaaaguauauuguuucacauaaagaaauuuugcaagaaaaagauccaaaugucuacuuuggaaauacccauuuuugauagcuuuguauguccuaauaugaacauucauauuuuuuucccauuuuucuuuuaauauuuaggaauaagaaaauuuuaaauaagaagaaauugaaaagaaaacagaagagcaaaucaaaagugaagacaagaagcaagguaaagcugcugguaauugauaaggaauaggacuuuuucauauggugauuugaauaaaaaugccaagauuaaaaaauauaauuaaaccauuuuauuaguaugugcugaaguaauuuuguaaaagcccuuuaugauuugguuccucuuuuaguuucaucuuucuuuuggguguuucuuuucuuucuugccuuuuuuuuuucuuuuuugaaacagggucuuguuuugucacccaggcuggaguccaguaguuuccugggcucaagugauccuuccaccucagccuccugaguagcugggacuacaaguaaaugccaccacaaccagcuaauuguuaaauuuuuuguagagacagggucucacgguauuggccaggcuugucucgaacucgugggcucaagcaauccucucaccucggccucccaaaguacugacauugcagacaugagccacugugcccagccuauuucugggauuuucuugaccaguagccuggaaguuaauaucuggauguugaaaauuauuugcuauuuauucuuauuaucuuugaucaguccuuuggggaacauauccauuucuguucucuuuuuucaaucugacuacagguacuagaaacuugaguaaaauuagcuuguaaacugggacuuggauuuggguucaucauaugccuuucuugacaggaauuagggaaacuugguguguccauauuguucugagccucuuuugacuguugguagcucugcaaaagaaaaggcaauauggaauauuugaauuaggugagaccuuagaaaccaagaaucuauuuucaccuaaugcagagaucucuauaaaauccaucuuuuuuauacugaacauuuucagugaccagagcacuugauauaacagucucuuuucuauugaacaucuagacagaaggaagagaggagucguaacuaugauuccugaauagcuucacuuugaguuaaagaaacaauagauuugcugggccuguauagcaacuauagaggcaauuguuuccuacacuuuuaaguuaguguuuuuacuauuguaacugagagaaaucuacuucaaaguagcaaaccuaaaauaaaaugaaagguugggggauggcauuuauuugguggcucuaucuugagacacagauggauccggggaugaaaugauaucauuggcugggugcaguggcucacgccuguaauccccgcacuuugggaggccgaggcuggcagaucacgaggucaagaggucgagaccauccuggccaacauggugaaacccugucucuacgaaaaauacaaaaauuagcugggcgugguggugggugccuguagucccagcuacucaggaggcugaggcaggagauugcuugaacccgggaggagcagguugcagugagcugagaucgcaccacugcacuccagccuggcgacagaguaagacuccgucucaaaaauaaauaaauaaauaaaaauaaucaaacccauauuuucagcucuugcuucugccuuccucuguguguggacuuauuaccugugacugaggcugaggcugccaguagcuccaacuccauuugcucugagcaagaggcaaucucuuauacuagucauagcagaaagucuuggguaggauuuucgguuuaccugcaucauuugcuuugaccacggagauacgggauacuuugguuagacugaguuauauuuuuaacccugagaugggcagugggugagcacccuggugaauaggccacaugaaaugagggaggaauaguuacccuaaggaaaguguugccggguaggcagaaaaauaaucuguucacuguaucccuucucauuacuucugcuucugggauagaggagggaaguggagcgcauugucaauauacagaaaaccucuaacaaauacagucauuccaaccucuaucccuuuucaacuuuuuggugcuaugugcaaaucggaguaugggaaucuugaauaucuuuuaaguuuuuuuaagguuucauuuggugauuuuccugaagugguggcauaugauauccaggaagaggugaggagaagucaaggucuuuuguccccuucaauucggccuccaacuagcuuugugcccuuaguaauucaguuuuuuuccucuugcucucaguauuucuauaucuucuuuuuaagaguaguuugagauaacagugauguaaguaaguucauucauuuauuccucaaacauuaauugcaugcugaguaugugcaggcauuaugcuggauguuugggauacaaagaugaguaagaggcauuuuuugcucauggaaagcauauaaaguaguaaaaugguguuguuagucuccuugaccuguauuacuuuuuccagauuauuuuucaucuacccucuuucugaaaguuauuuuuaaaaugccauuuagcuggcauuuuaucuacuuuauaucuacuuuauauauauuuuauauauauguauauauauauguauauauauauauauauauauauauagccauuauaucuacuuuauggcuaucaucaaccccucuauuucuccucauccaucagucaucuccuuuauuuaauuuccaucuuacccagguuagauaccagucuuucuuuuuagaaaaacucuuauuuaaucuguaacaaauuacaaaaacuugaugguuuaaauuaacacucguuaucuuacaguucuggaaaucugaaguccaaaauggaucucacugagcuaaaaucaaggugucagcaaggcuuuauuccuucuggaggcucuaggagggaaucuguuuuuuugccuuuccaguuucuauaguagaggcugcucagaugucuuggguuguggcccccuuccaucuucaaagccaguggcgguugguugaguuuucucaugcggcaucacugauaguuuucuguuguuuuaucuccuccucuuacuguccagccucccucuuucacuuguaaggacccuugugauuacauuggcccauccagauaaucugugcauuucaaaauccuuaguuuaaucacauauacagagucccuuuugccauguaagguaauauucaccuggguucuggggaauuaggguauagaaguuuuuggaggcuauuauuuaccuaccauaucucccuuguauauuuguugcauuaaucugacaaaacucaaucuugugugaauccaguuauuuugucccucccuuaaggugaguuccaugugcugccaaagagaguuacacaagaguuaacugauaaugauacacauucaugaucaucaaucucaaguauaccauagccagacuaucuuauuauuuuuucuggucaaauaguucucuuuucuucugugauuauuucagaccuuugccaugcuccucaaaccucugauaaauucuaccuuccagcacaugacuucacuuucuuacaggagaaaucaaauucauuacucagaaaaguuccucaacuuccuaaucccaaaugcgucugucuucaggcuucucaguagcugagccugacauagagauuugaaguuugcaguucaguaaguuuugaaaguuaacauucaugcauagaagcacuacugcagucaaaguucagaacauuucuaucaucuccagggguuuucuuuuuuuuucuuucuuuuuuuuuuuuuuuuuuugagacggagucuugcucugucucccaggcuggagugcaguggugugcgaucucagcucacugcagcuucuaccuccuggguucaagcaauucccugccucagccuccugaguagcugggauuacaggcaccagccaccacguccagcuaauuuuuguauuuuuaguagagacaagauuucaccauguuggccaggcugucucaaacuccugaccucaggugaaccacccgccuuggccucccaaagugcugggauuacaggcacaagccaccgugccuggccgguuuucuuacccucugcugauuccaucccucccuauaacccuggcuguagacaaccacagauauauuuucugucacuguagauuaguuuucauuuucuagaacuucauauaaaugugaucauauugugagugcucuuuuuuuuuuaaaucuggugucuuucccucagcauaaugauuuguguuaauguuguuguauaucaauaguucauuccauuuuuuugcugauuuuauauacauauauaugcacuuguguguguauguguguguguucaguuuucuugggugcauacugaggaguggaauguuuaggugguuuuuccuuugauuugccagaaggacucauaaaucucacaagcaauuuauacucauggcuaagauuuauuacaacaaaggauacagagcaagcagcaggaaaaagguauguguuugugauguauaggaaguuauggcauaggcuuccuaguucuucauugacugagcuuucaugucagaaagaaagacaugcuuucucucuggcagugaacuacagagaaauguguauauuguuuuugcucaggugaguuuuagaauucaagacuuuguggguuuggucacacagacauaucuuguuagucaaucagacaugguaagugaaacucagguacacauuguaaagcuugauguucguacaugcagagcagucugacaggccaggaggcaugguccauugcucuguguguucauaacacaaucaucaaucacuaccacaaagaaaacucuaaacauccacauucccaaagguuagccaagggucaaucaugguuuccuuggggaaauacaaggaguaagcaaucaugccugcagcguuaacuuuuuccucagagugggcacgguaaauguacguuuaguuuagcuuuuuuuuuuuuuuugagacagaguuucgcucuuguuccgcagguuagagugcaauggcacgaucucggcucauugcaaccuccgccucccagguucaagcaauucuccugccucaggcucccgaggagcugggauuacaggcaugcaccgccacgcccggcuaauuuuguauuuuuaguagagacgggguuucuccauguggaggcuggucucgaacuccugaccucaggugaucugcccgccuuggccucccaaagugcugggauuacaggcgugagucacugcacccggccuguacauuuagcuuuuuaagaaacuagaaaacucuuuuccaaagugguuguuccaaucuguagucccaccagugguauaugaccaaucuaguugcuucauaucuuugcaaacauaugguauucgcuuuuuaaauuuuagucagccuacuaaguagggguuucccauugugguuuuagcuugcuuuucucuaaugacuaaugaugugaaaucuuuucauguaccuuuugccauucuuauuuuuuugaugugaaaugucuguucagaucuugccucuuauuuuuguaauugucuucuucuuauugaauugccagaguuucucauauauucuaaauacaagucuuuugucagauaucugcauuccaaauacauuucuccuguucuguggcuugcuuuugggggaagaauugccauuuuaaugauauugaauuuuccaauccaugaacaugguauaugucuccauuuauuuaagucuuuaaauuucacucagcaacacuuuuuuguuuucaguguguagggcuuacacauauuuuauuacuuuuauuuacaauuauuauauauuuuugauguuacuguaaaugcaguuauuuuugaaaauuuauuuugcuuugagaugauuucaguaugaaugcaguguguauguguuugugugcaccuaagucuguguaauuuuaucacauguguagguccaugugacucuuaccacagucuggauauacagcaguuccaucacaaggauucucugugauauccuuuauagccacagguaucuuccuuccucacccucuccuuagcuucuggcaaccacugaucuguucagcauuuauaauuuugccauuuuaagaauguuguccagugaaauuguacaguauguaaucauuuaagauuggugcuuuuuuuccccacuuggcaaaaugucuuugagauucacacacauuguugcauauuguuuguuccuugaugaguaagcauuucaugguauggauguacuauaguuuguuuaaccauuuacccauuaaaagauaucugaguuguuucuagcuuuugacuauuuuaaaagaaugcuauuacgaacauucguguacugguuuuugugugaacauaaguuuuuauuucucugguguaaauguccaagaacauaauugcuggauuauaugguaagcacauauuuaguuuuguaggaaauugcuguacuuucuuccagaguggcuguaccauuuuacaugaccaucagcaauguauaaguuucuccucauccccaccagcauuugguguugucacuauuuauuuuagccauucugauagguguguacuauaucucauuuuaauuugcauuuuccuaguagcuaaugauguugaaauucuuuucaugugcuuauucacccuuuguguaaauaucuucuauauugauguguuuauuccuaucuuuugcccauuuguuaauuggauuccuuguuuguuuuuacuguugacuuuugagaauucuuuauauauucugaauacucauccuuuguuggauaugugguuugcaaauauuuucucccagucugugacuucaaugcuauuauuuuugaaauuacauuuuuucaguuguucauuccuaguauguggauauacuacucauuuuuauauaguaauuuuauauccugugauuuuguuaaaucugcauacuauuucugguaacuuuuuugcagauuccuuaagauucucuacauguuuuuuuacaaguaaaaacauuucuuuuuuagaaaauacuucuugccuuuuucccuuggcuggauaggauauuuuccuugcacuagauaggauauccaguacaauguugaugaguugcugagaguagaccaauuugccuggaucacaaucuuagagggaaagcauucagucuauuaccauguuagcugugguuauuuuguagauacccuuuaucaaguugagaaaauucccuucuauuccuaacuuagacuuuuuuuuuuucuaucaugaaucgauacuggauuuuugucaagugaucuuucuguguuuauuugaaguauaauauauuuuuucucuguuacaacagugguugcuuuuccaguguugugccagcauugucccuggguuaaaccucaguuggucauaauguauuacuuuuuuauauauuguuggauuugaauagcuaauacuuguaauaucucuggauauuuggaugagauauuuguaauaucucuuauacauauauucauaaguuauaugccaugccaauuuaacuuuuugauguauuucuuauuuaacaaguguauuuuuuuuuuccaauucuuuauggaagaagagucgaauauuugggaccaaguguuuuugguacuugagguaucauuuuguuuaucuuagauacuuccuggacauacucuaauuauuggaaguugaauuucuaaaauauuuuaaaacagcuuuuuauauuuauaauauaaauguugaucuugaaauuguaguugcugucugaugaauaaaauauugggcauaaaagagaaacuguuuagucuuaacaaauuaccaaucacaugauuuuuagccuuuaucaauacugauaggugagagagagcuuagggaagcaucuacaguuuacuuggcauuacuguuacuugaaugagaaugaaaugagcugaugaaaauuaaguguuuuuuugggaggcccucauuucuguguaaacuucuauaucuacuuuuaaaagcauucaaaaugcaaucuaauguuuguaguaggucauugagacucuacagugugucuagagucucuuaggaagucguaaaaugaauuuccuuugauacagaacucuaagaguuaagcuuuguugagucuauuccugucauggcgauacaagaauauuucuaaguuuuuugcccauccuuuuccagcccuugucagauugguugguuauugcugcauugcucaaaaaauagugagguauagaaaaggggacuagaaguuggguccauagacuuagacugucucugcugugucacauaaugugucuucugcaagucaguuagugugucuaaucuuuacuuuuauguaaaaugggacuugaugauagaaaagagugugaaauggaaauauucuguuuuguauuucagucugaaaacuuagagaauacaguaaucauaccagauaucaaacuacauagcaauccuucugcuuucaauauuuacuguaauguacgccauugcguucuggaauggcagaaaaaggaaauaucauuggcagccgcaucuaagaacucugugcagaguggagaaucagauagugaugaagaagaggaauccaaagagcccccuaucaagcuuccaaagguaagccacugaguucuauuaauauuuagauguguaaccugcagguguucuggcuauaaugcauauauacgcauugcuaaaauacuuugcuuuauguaaaauugcacacuaaaaauaacacggcuuaugggcaaaaauagauuuggagcagaaaaggaaaacucugcaacuuuauaacuaaggugcuaacaaagucaauaauugauaauucacuggaaagcgcaggaagggagaucaguggguuggagucuguuauaggggcaauuaaaaaauguacaaaagcaguaggguggaaaugcuaguauagaggcauugagccauggcagauggaaguagagcucugagccagugagccgagaguaaggugggcacaagagaaagccaagagcccuggaaagcugggaggugcuccucaccugggaugcagguaugcguuuuuauuuuucuugaaauagaacuacaaagccucucagcuguguaguagcagggcugagagccuuuuccuuucugccuaagcuuauaauuguacucuugauauugugguuucccuugauuaggaaaaaaaaaaaucaccuaugaaccaacugaacuucugcauuauucugauauuacucccuuauuuaccaggagcauauaaacuaguugguauuucuauaauagaagcauguauuguaggccgggcgcaguggcucucacaccuguaaucccagcacuuugggaggccaaggcggguggaucaccugaggucaggaguuugagaacagccuggccaacauggugaaacccugucucuacuaaaaauacaaaaauuagcccggcauuguggcagucgccuauaaucccagcuacucagaggcugaggcaggaaaauugcuugaacccaggaggcggagguugcagugagccgagaucaugccauugcacuccggccugggugacagagugagacugucucaaaaaaaaaaaaagaaacuggcugggcguaauggcucacgccuguaaucccagcucuuugggaggccaaggcgggcggaucacgaggucaggagaucgagaccauccuggcuaacacggugaaaccccgucuguacuaaaaacacaaaaaaaacuuagcccgucacgguggcgggcgccuguagucccagcuacucgggaggcugaggcaggagaauggcgugaacccgggaggcggagcuugcagugagccgagauggcgccacugcacuccagccuggacaacagagcuagacuccauuuaccaaaacaaaaaaccuguauuauagaacuacucucaguuuacucuguucuguuuaaguauugguauauuuaagacuggaaggucuauauauauauauauauauauauauauauuuuuuuuuuuuuuuuuuuuuuuuuuuuuuuuuuugagacggagucuagcucuguugcccaggcuggagugcaguggugccaucucggcucacugcaagcuccgccucccagguucaggccauucuccugccucagccucccaaguagcugggacuacaggcaccugccaccgcgcccggcuaauuuuuuuuuguauuuuuaguagagacgggguuucaccguguuagccgggauggucucgaucuccugaccucgugauccgccugccucggccucccaacgugcugggauuacaggcgugagccacugcacccagccuguuauauauauuuuuucuauauaguagauauaguuaauauuuacaacaaaagaauaggugaaaauauagacauuuuuaaauggugccuuuauaugacuuaugcauauugcuuuuuucuaaacagagcuauucaaaaugauuuuauaauuauaaaugauuuaugacuauugccuuuuuacuaaacugauaccuuaaaauuaugccuugaaagcuuauacauauccacaagggauuguguaaauauuuuuuacuacuuggaaauagcagcauaaauggaaccuggucugaguucuuuugcacauuuuaugguggcuguuccuaaguacaccaccauccuuaaucauauugucagguucuucucaccuuauucucggcagauggcuugcuucauauuucauagaguaauacaaguuuugugaacuuacucagcuucuugaucagccaucuucacauguccuuuuugccuccuguuuuagagugggacccuuuucuuuuucuuauuuccuuugucugcaauguccuaacuguaccuacucuaauagcuccuuccuuccuuccuuugcuuuccuuugcuuuccuuuccuuuccuuuccuuuccuuuccuuuccuuucccuuccuuucuccuuuuuucuuuucccuuuccuuuucccuuuuccuuugccuuucccuuuccuuuccuuucuuucacggaguuuugcucuugcuguccaggcuggagugcaauggcaugaucuuggcuuacugaaaccugugccuccuggguucaagcaauucuccugccucagccuccugaguagcugggauuacaggcaugugccaccgcgccuggcuaauuuuguauuuuuauuagagaugggguuucuccauguugguaaagcuggucucaaacucuggaccucaggugaucuacccaccuuggccucccaaagugcugggauuacaggugugagucaccgugccuggccaauagcuucuuucuuuaaccuaaaacaaacauguuuaucuuuaauaugggagcugcucuacauagaaauuauggucucuaauuguaauuucuuaugcuuaacuaggagagauugagauaaaaaacauaguugaguuaggacguagggcuggaggacuuguauaauuuacuuuuuaguuagaauaccaauucuguguaugugugagucacacuguauuauaguaauugugcuacuuaaguucaauauugugagagaaaacaaaagccuggguaaauuuuuuacacagguaugcagauuuugaauaguaaacuguaguucaaauuaaauugcauaaacaagaacaauggauuccuaggguguuuaaaaacaucaggauuagugaguauuaaaugaaauaucaggcauucuuaagauaaccuuuugcagcauaauuaacagagucaaagggguaucuuucaaagaaaauuaaagaagaucagauagcccaagugauuaauacugaauuuucuaccaaguacugaccugucugcaaacaggguuagcauggguuauggagccaaacugcugggguucaaacaccauuaaaauuacuagcuaugugacacuggaaguuauuugacacauccgugccucaguuuugucaucuauagauuggggguugcaucuaccucauaggguuguagugacaauuuaaaugaauuaauggauguugagugcuugagagaacaguaccuggcagaaagaagugcucgguaaaugauauauauaguuguaagugucaguuuaggugcaaacaagaaaauguguaggugcaaaugaauuugaguuacuugucaaggaacucuucaguuuauuaaaaaaauuaugcaagcaaaugaaacuucuagagaaucagugcaaucaccugaugaaugagagguaaagagaggaagaagugaugagaugccucuaugcagaggcaagcagauacuauggguggggagugaaacuuucaggugauauuuuuuggcagccauuuccaugacaugaaggauugacacugaggacgaaauuagucucuuaagguuugaggugaugggauuugaaggcaagugggaaauguuggcauuuuucuuuucccuuugaccuucucugugccucagccccaaaugcugcuauuauccuaguuugcuccuuuucuuuguuccucuguugcuccuccuaaguguguggcugucccauuccuucuugccugagguuucuguuucuuguacucuuuuuuuuuuuuccuuaacaugauuaagacaguuuuuaaucuguuguugaaguguuguuguaauacaguuuuauuuuucccauucuugaguuuuaaauuauuauuuaguuacuaauaaauugaguuugacuguuauauagaccuugauugucacccuuuugcuuuuugcuuuuguuuuuguguuuugcggaucaguaaucauugauguauuuaaacgagcuuucuauucccugaaugcuucuacauuaaguuuuuuaaccagcucaaacugucacuaaaaucuacauccucuaaaacuuuacagauuuuauagcuacauaauuuuuauuauuuuuguuuuuauuuucauuuugagacagggucuggcucugucacuggggcuggagugcaguggcgugaucucagcucaccguuaacuuccgccuccugggcucaagugaucaucccacauuagccucccauguagcugggacuacagguguuugccaccaccccaggauacuuuuuguauuuuuaguagagaugggguuuugccagauugcccaggcuggucucgaacucuugagcucaagcagucugaccgccucagccuuccaaaguacugggauuacaggcaggagucaccgugccuggugcauaauuuuuaaauaguaacgcuuagaagucauauuucccaucugaacccauuugaagccagucaugccacauuauuaaaagauuuagacuuaccuaggaucauuucuuucuuaauucaguauauucuuuuugaauuuguagccagcauuauauuagguccugagaacaaaaggaugagacauaauuccugcccucaagaaagcauugucuuguagggauaagaaccaggucaauaaauauucucuagugccuuaaggauugauagggagugcuagauauaguggaacacguuagagaaaggacucaacacuggcugagauagagcaagagagagagagcaggaagcuaaaucaugaagggccuuaugugccauguaauugauucagauguuaucucauaauuaguaaauauugaagauuuuaagcaaaagaauaucaucagacuugcaugauugcaucagacucaccacccuguaguuaugaauaugccuuacuaacacuggaguaacuuuguacuccaguaaguaaguaacuuuguacuccaguuaguaaguaacuuuguacuccgguuaguaaggcauauccauaacuacaggguggugagugagacuggagacagaggaaccauuuaggcaguuauugcaguugucuagagaguguuaaugaggguuggaauuaugguagugacaguguuuugaauauaggaaauguuaagcagaauugacaggaauuaguaauaaauuggcuauaacgacugaaaaagaaggcagaaucuaaagauauucuuaaagguuuuguguggugagggccuuuacugaaagagggaauacuggaugaggaacagugcuuggcugaaaugaugaucaaguuuaguucacaugcugauucugagguaaaugugaaguauccagugugugcuauguagggcugaaguucaaaaaauaagugucagcuagaaaaauagauuugggaguuaucacuauguaggcacaaguugaaacaaauuucugugagagaucggagggggugggaucaagaacauuguuugaaaaaauagcuuugaaaaguugaaaaguuuugaaaaguucucuuccucugagugugaagagaagggaagaagaugguaguagucauagauaaauuuguuaggcaaggaacucagaaacuucacacucauacuuucuuucuuuuuuuuuuuuuuuucaagauggaguuucacucugcuugcccaggcugaagugcaguggcacgaucuuggcucacugcagccuccaccuccuggguucaagugauucuccugccucagccucccaaguagcugggauuacaggcaugcgccaccaugccuggcuaauuuuguauuuuuaguagagaugggguuucaccauguuggcuaggcugguuugcaacuccugaccucaggugaucucccaaccuuggccucccaaagugcugggauuauaggugugagcuaccacacccggccucacauucagaauucuccaucuuagccuucuccuccucucuuucugcugcugccucuucccccuccuuuuuucucugucucuagauuuuuaaauuuuuuauuauuuguagauauuaucucuguaccaaauauuugcuuuauacaaacaauuuuaaaagacaguauacuucacucuaugguaauauguaaauauaauuuugauuuccuuuugagcuuuuucaaauauaaaaguauaggaagugauuuuaggaccuuuuaacuaaacaagauacaauuuuuaaggguaaagaauuaauuauuaaauccaaaugugauguaacuaaacuuuuaugaucacacuuagucaugaaauaauaaagucacguuuggaaauauaugauuugagaagggcaaaauaaaaccuugaaagacucuuuauauaucauuuuucuuuggccaaauauauuuuuaucucacuuuccuagcauauuagacuggcuguaucagguaauuauuugggcuucauguuucuuuaucuuucaaauaugauagauaaccuucaaaauuuaauuauuugagagcagcaguaaagguaaaauucaguaaauuuacaaaagacuauuuucugaagagaagugcgaaagcauguguuggguaauuaguuauaguucguuauggaaaguauugaagcuucuuguguucuuuuauuguuauaauuauuauuuuuauuaaauaucacauuuauuuauuuugcuaauuauacauauuuauuguagaugauuugaaaaaucagaacauuuuucuaaagagguauuaaaaaucggaaguaauauuugaaauaccauuaaccaaaauauaccccaauauaaacauuuuuauuucuuuugucauuuuuucuauguacacauuaaaauguuuuuuacacacaaaugaaauaauacuauauuggcaggacuauauuuuuucuccuuacacucuuccuuccugauacugaaggagggagaaauauguguuuucauugacuauaagacuucaaacuguuuuaaagucuacuuucaaaguucaaacuuuugguaaaauacuuuauacuuagccaaacagcagaaaaagacuuauuuaagaacaugucuguuaccucugugcaauaauccauagcuaaauauuaaaaauucuuuaauaguugcagaacuugagguugauuuuuguuguguauugaauauauauuacuauucugaaaaugaauguuuucccauuuguuaaacaaaaagucuacaaugaaccaagauguggauaauuagugagacucucacaguguuuaacccagacagaugaagaguucccuaucaucauugugaccaaaguuuuaugggccagucucacuaaaaccggcuagcucuguuucuaggcagcccaccugaguugccuauugccauucacuuguuauuacaccuuaaacuuaccagagagaucaagaaccuguucauuaggcagucuuacuguuucuggcaagguucaauaauuccguugucaccguaggaaacuguaucuauaauaaaugaaccuuagccaaaaaugucaucugugaaaaauccucuuggauuuaugaaaaaucaugguugguagcagaguaagcaaucugaaagaauaacagaauauaguagucuuccauuggcuugagaauagagccccauauuuuguacucuggagaucuuugacuucacauuucucuuuccuguaaguacauaagcagauggaaaucuuggacagcauguucuuguuuucuaguccauuccaggaaaagaaacuauaucaaaugugaaaguuuaaucacuuaauguguuuaaucaauugaaacucuaugcagacucuucuguaauauuagcuauaaucaagucuguuagcauuuuagauaacuucuccaaagacaguccuccuaguuauuugacuucuuagcuauaucuguuguuuccagaaaacuuguaaauguuaaucagaacuacaauugacuuaccuucagccgacuugcuucugguuuagaaaauguauuucugagaugcagugguuuuuuagcaaacaauuuagugaauaaauuaaacaaauauuuaaugugugccuaccauaugcuagguaauuggcuaggcaugggagguauuaagccguuuaagacauguuccuuguauauuggaagauaauacaagccguuuaagacauguuccuuguauauuggaagaucccaacaugguugggaaaaugaaaacaaaaauaguuauacuguaauguaauaaaugcuauaacagaggucuguauugaguaugaauuauauagcaugacuaauuuacccuauuagauuauaaacucuuagaggacagggucuaguauaccuucauauuuccuaaagugaguuugcacaauaugagugcuuaggagguauuuauguaauauaugaauuaaugcaaaaauaucagcagagagaauauucuuccacuguuguguucaauagaauuaaugguuuugggaguuucuacuaauuagucuuauuucaauuuuucuguuacuucuccaaacaauuuaauuaauacuucuugaacugguucucagaauguugacauugccugagaaauggaauuugucuuuuguuuuaucagucuuaugaagguauauccuuaaacucauucauugcaauuugcucucucaaucuuuaguaacaaauuuaucucuuuugcuggauauagagucugauuuuucuugcaccugaugaggaauaguaagauaauuaaaggaaaaguaccagugauauuuuuagcuaagcaguuuuaaauuguuuugugaucauccuacaagaagggauaccaacuauaaauaauaauauagugauuguaccauuauagaaaaggcuaagacgaaaagcuccuuguaaaaucuuuuuacuauaugugcuguguugacuuuauuucugguuauagguaacaauuaacaugacuuuugacaaaaagaguacugaauuuuccuugaguacaaucaaaugaacuuugcaaauuaauauaguuuauuucuucugagugaaugcaaucuagucucuaguucauuguuauaagccauuuucaugauguuuuauuauggcuccauuauacauauacauuaucauuugcuguggaaguaacuuguaccaacuaaacugcuuagaaaguguuacuagcuuacaugucauaaaguauauauauuuuuuccuuuuaaauagauuauugagguuggccuuugugaaguuuuugaauugaucaaagagacacgauuuucucauccaucccugugucucaggagucuccaagcccugcucaacgugcugcagggccagcagccagaaggccuccagucugagccaccugagguccuagguaagagccaaggcucauucagugaagcauuuaaaagugaauauaauuaauaauagaguauuguacacuucaaaauuguuaagagaauauuucuaaaguucucacuacagaaaauguuaaguacuugaggugauagauguuaauuaguccacauuuuauucaugaaucauaacaucacuuuauaccccauaaauuuauauaauuauaaauugucaauuugcaguuuuuaaaaagugaagagcuucucuuaugaagcacacacaauagccuguaaugcagucuuuauuuaauugugguacggaaacagcagggguauaaguucuagaguauuuuuuucuguguuccacugaaguuaugguuuaagaguugaaguucgugcacacacauuucucaauuaguaugaugaagcggggggcaaacaaaacauaaaucccuggaauccagaaauaauccucaaaccuuaaggucacuauuaacugaaaucguucuuauuaaacuuuuggccaaaauagcuaacauucacuuucucuaacuuguuacucucaauaguuuuaaaaaacaggggaaaaggaaauaaaugccacaaagccaaaacaguacaauuaguuucuaaauugaggggacuuuuuuuuguauucaucauaaauaaaaaucuauuuguguuauggauuaaacuucugacuuagcaacuuucauuaaguaaauaaaguguucgcuuuucuuaaaguauguuccgauucuugccuuucauaucagugacccagacucaacauguaauccuuuaaauaagauaggagcuuuuacuuaaaagguacuaaggaauagaaauauagauggaagcauaauuuuuaacugguuaauugcuuuuuuucuccgaugcuaacuaugggucuuuaaacuaucuaaaguuuucuagauccuucuauuauuauaggaaaauucucagaaguacuagagcugugguucucauuaugugguucucaauucucauuagcauguaucagaguuaucggggacuucccuaugguguuucugauuccauagacuugggguggggcccaaaaguuuguauuuggaauuaguuucuuggugauacagaugcugguuugaggaguacacugcugguuuagacuaaaacuugguccuuuuuuuccgacuuggcuauuuagauuuuguaggacccaccugugagaaccaaacugcaugaaccuaacuacaugucagauuuuucuuuuuuggucgcauguggggacucaguuauuguguuugacuuuuguuuguuuuaaugagagggaggaugcuggucauugaaucaagcugaggauuuuuuaaaaccaccccccucacauacacaguuauuaaaagcuauuaccaaauagaagcugucauguuggcaggcaagcaccguguugguuauuguuaugauagcaccagugaucauauuaauauugugaagugcugcuuggcuugacagcauuuuacugaagauuugauuuauuuuauuuaacaauauuuugcucgguuuucuuggauuugguuuguuaguuagcaaauaauuggaauguugaaauacccgcgaagacuuggaugucguauuuccuacuuugaacauguuauuucuuuccuccuaagucuucuaccauucucaugucucaugucaguuguuauauacuuuccuuuguauccauucuguacauacuuucuuuccuuuauucuuuuaaaacuagaacuuguucuuaauacuggcuuuggcauauaauaugugcuuuagucuuaucuuccaucaaaacuuucacauuauuggcugggugugguggcuuaugccuguaaucccagcacuuugggaggcugaggcaggaggauagcuuaaggcugggaguuugggaccagucugggcaacuuagaccccuaucucuccaaaaaaaaaaaaaaaaaaaaaaacugggcauggaaaugagugcuacucaagaggcuaaggugggaggaccgcucgagcccaggagucugaggcuacagucggcugugaucaugccacugcgcugcacucuagcugggugacagaaugagaccucaucucuaccaaaaaaaaaacccccaaaaaaucccacaaaacccaaaaauauuucaccuuauuaaucuguucauuuuuauuuucuuguuuaaaguuucaaauucugcuguacugccuuucgucugucuuccauccuuucaguguuuacugcugaucucgucacugcuuuggcuuauuuuucuauguaagggauuuauuaucacuucauguuuucuauuuuguuaaauuagcucaaagauaaaagcacugauuugguucuuuuauacuaaauuucuuuugaaacuugccucuccuccuuuuuuuaaucuaauaucacaaucuuauugguuauccuuuuuuucccauucgguuguuuucguguuauucaugaaaauauguguauauuuauauaacucuuacuguggaacaucuugaugauuaguauacaccaagcuucuucucuuugcaaauagauuuugauuuuuaaauuaucuauuuaaaaauauauuuccuuauauccauauauucuguucaauuagauuauauucucgaguacucacugaaauguaauagcacccccuuuguuaugugcuaagaaugugcgauacuauugcuguuauuauggaacuuagcaucagagaguuggauauguguauaauuacaaauguggauaaaucguauggaggaaaguagaaggaguucugagaguccuuuuuuguuuuuugagacggagucucgcucuguugcccaggcuggaaugcaguggugcgaucuuggcucacugcaacuuccaccuccuggguucaagcuauucuccugccucagcuuccugaguagcuuggacuacaggcgcguuccacaaugcccggcuaauuuuuguauuuuuaguagagacaggguuucacuauguuggccaggcuggucucaaacuccugaccucaggugauuugcccaccucagccucccaaaaugcuaggauuacaggcaugagccacugcgccuggccaagauuccuuuuuuaacuuaaaaauuuuuuauuuauuuaucuuuagggacaggaucuuacuauauugcccaggguagccucaaacccuggacucaagugauccuccugccuccaccucccaaguagcugugacuauagguacacacugcugcacccagcuccuucugagagucuuuaacaggcucccugaagaugugacauaugagauuuagagggugaauaggagggagugaauucgauuauaagugcucuaggcagaaauaacagcauuuaguaaggcucugagacagaaaggagaaugaaugaaaagaagagcaauauggcuagaauguggagagugaaggaaacagucuugugacaggugaggaaggaggcagggacaugcagagcuuuacaugccauguuaaagaauuugauuagugggcuaggaggaauggaaagucauucucuauuucauuacaugaagaauauuguuuuuuaaauagccuuauuuucuuaaauuauuuguuuaaacuauugacuauuuucuuucccuggauucuuaaccuuuuugaaaggguagagacauucuuugucauguuugccaauacccuaguguagaauaguugccagugugugagaguucgguauauauuugcugaauaaucaacagauguacucacugaaggauaauaauuggaggaaggauggguagauggaaauauggacaaacagggauagaugaaaggauggagggaaggaaggauagcuggaggaaaagguagaggaaaggauaaauggaaaaaaauggaaguauaggauguguacagacaagugaagagaggaagggggaaagaaaagaagacagaagggaggaagaaauuaacaaaggagugaaagaauuuuaaguagacaaucagauuuuugguuugaaauucucccuggcuauuggggcaaaagcgaaugguaagagauaauuucuuaacacuuuuuaucaaagagaugaugauagcauggauuggaaagaugaugaugagauagggaaaaguggaguuauccauuaggaaguaaaauaaacaggacuuaauuugggauuagcuauggaagaugagggauugguaggggcugccuggguuucuguaaguuaccagauaacccacagguggcauuuuaguuuuuagagaauugcaguacauuacuccucuuucucuuguucuccuccuucucucccuucccuuucccucucuucauguuucucaguuuuucuuuuucuaacucucuuuuucccucuccaucugauuauucacucuauaaggauuuucaagucuccguucuauggaagaaauacccagaugucuguugauugaaucuuagauggagguguucagggaauuuugugcagagaccucugcugguuguaaaacauuuguguguguguguguuucaucuucaccacuaaaugacuuuaugauuuaggaaaaaucuuuugauaccacauaucucaauuucauuauuaaagggggagaauaucuguccuauugacuuggagguuuuucuaggguauaaaugaauuacauccuaagugugaauugcuauuauguuaaugauauagccaauuuuauauuaaagcacauuauugcauauguuuuauguuucuauuacuuugaaaauauauacauaauuuccuggacacuuaacauuuuaagaagccuccuaaucuaaaagguaaaauaaguaugacaaguagucuauuacuugauaggaugaguuucuugaauaugugaaugccucuaggcaagcuuguuuuaaaagaccuuagauugucuuuuuuuacuaagaaaaauaaggaguugaacugaauguucuuuaagacccuuguuacauaaauauuuuaacuuuuggggaagagaguaacuagaaagaaacuaaagcaaaguaauuguucuagauuccuuaaauuucguuuauaaugagacaaaguaaaaauaaauaaauauacgcauauaauguuccguauguuggaugaauauaauugaauucuauuuuauccacagagucucucuuccagcuucuuuuggaaaucaccguucgaaguacugggaugaaugacagcacaggacaguccuuaacagcacuuuccugugcuugccucuuuagucugguggcuucuuggggagaaacaggaaggacacuucaggccaucucugcuauccucaccaacaauggaagccaugcuugccaaacuauucagguauuucauauuuauaucugcuuagaaguuuauaagaugacaaguuacaguuucgucucaauuucugucaauaggaauucugcuuuuucucacucauuacaguagcuuaaucuguccaagauugauacauaaauaaucuacaguauuucaauuaagugauauguauguuuaacucugaagcuuuaaauauaauaaaaugaauuuuggccagaccucuuaaaucuuuaagcuggucuuugccuuaacaccauagccuucucuuuccuugcuguuuucuugcugucugcguucucccuucuucccaucuuucccugaguuuuuuaguauggaauucauucaugguuuuaaauaucuuuucucuauugaaagaaaaagauaugguaucaaucugauauauuuuugauugguugauuaugauuuuuuuaugaauugauucguuucugaguuacuucagcuguguauaaaacauuuuaggcuuuuaauauucaguuguggaacaaacaagcucaucaccauuuuaguggugggaaaaauaauccuuauaggcaaacuugacuuaauuauuugggaaggcucuggaaauugagaaagaaguuaugaucuuaagaccugacugucuacucuucucuggccccuugggcaacccuagggcagguggaagggaugccucaauccuguuauuagcagaccaaagauagcaaaaggaguauauuggucauuuucugucuuauucagugauuuugaacucuccuggucaaacaagacccauucccuuacucaagauuucugcucuuuucuuccuuucugccuugcuuggaauccuuuugucccuuuuuaugguccuuaauuauuuugaaguugcucuaauacagugguuuucaagcuguguucuguagacaugcuuucaggguuuggcaaauguuuaauuuaaauauauguuuaaaauaugcaaauauuuuaaaaauuguaauaaaguaacacaaacauucagauaccauauaccagauuuuaauaggauagugaccaccaacauaugagcuuaugaauuuugauaugauuugcuuuuauauagagacuuaggaaugccauuagagcucauagcaggaguauaagaacuacguucauggaaagccucccagaggauaugaggugagaucuaaacuaaugaguugaaaucagccaggagaaauuuuugguguuggugguguagagagagaauguucuagguauccacaugcuaaggcauggaggugagaguaagagugaaauauuugaaagcugaaagaaguuuaguauagcuauagcauagagagcugucaaauagcguagccacagcauacagagcuggcaaauaacagagacaggacucgagggcuuaucugucuccaauauuuaugcucaaucacuagacaacacaaaacuacuugauccucugaaucaauagcugcaguucucuacagaccugccacaucaccacauccccaacucuagccuaaacuccauauuaaagcccauuaccuuaacauggcuugcagugcucuucaugauuuggccuuuuaucuaccaacuucauuucccaaaacucuccuggccugacuguugguagagggagaaaagcuuucccugagaaugugugcauuaaguccguuuucacgcugcugauagagauguacccgagacugggcaauuuacaaaagaaagagguuuaauggauuuauaguuccacauggcuggagaaaccucacaaucaugguggaaggcaaggaggagcaagucaugucuuacguggauggcagcaggcaaagagagcuuguucagggaaauuccucuuuauaaaaccaucagaucucgugaggcuuauucgcuaucaugagaacagcacaggaaagacuugcccccaugauccaguuaccucccacugggucccuuccacaacacgugggaauucaagaugagauuugagugggaacacaaccaaaccauaugaguauguguaacucuucacaucucagauuuguuuuggcacccaaaugcauacuacuuguccauuucauaaagcuuaacagagaguuuaaagcaggguagacaugguaguacugcaagaugcuguauugaaagacacugaaauccuuucuggaggguugaacucuugacuucaaaggcuuucugcaaauaaaacacuauuuauugcauuugagcucagaaacaaauuaauaaaaaaagcacauggaaaaaggcaccauuauugagaauuagcagaaacaaauaugguagaaucaauccugccaaguccuuagauauugaaauuauuugauauagaauguguauguguaugaauauauaaaguaugguuaaaguaauaaaagaaaauaucaaaaguaugauuaaguagugagaauauaaaaaguagucagacauuaggaaaaaaaacaaaucgaacuccuagaaaugaaaaaccaaauaauuacaauuagaaacuuaaaauggguuaacuauuguauaauaugguugaagauggaaauggugaacugaaagauaaagaggaagaaauuaucuagaaugcaacagagagacaaggagagaaauauggaagauaaaauaagaaacauggaucgagaaugacaaaaucuaauguaauacaaucugaguuccacaaggcaauaauagauuuguggagauagaguacuugaaauaauggcuaagauuuuacagaauuggugaaugacauggaaucccaagaguaaggaagucuaccuugcuugagauuugcuucuuauagaugaacuuuuaguugguacuuuuugcuggcaugcgaaauaucauucugaacaauuuauugucuuaugaaugaugauguauuaccaaaguaucuuuguucuguguuuguaacauuuaaaaauguuuuuucauuauuuuucuucucuuuugauuaggugccaacaauucuaaauucgcuacagagaaguguacaagcaguuuuggugggaaaaauucaaauucaggacugguuuaguaauggcauuaagaaagcagcuuuaaugcacaaguggccauuaaaagaaauaucuguugaugaagaugaccaaugucuacuucagaaugauggauuuuuucuuuaucuauuaugcaaggauggauuauauaaaauaggcucuggauacaguggaacaguuaggguaaugugauuccuuacaguuccuuaauuauacagaguuauaaccauaaugaauuguguucuguguguuucuaguuucauuucuagaauaugaucuaauuuuaguguaauaauauuuauuugaaaaccauaauugaaauacaugcauuaaaugucauucacccauuuguauuauuuuucauugauuauuaauuaugaaaccacugauauacuaacuuuuguuuuuuuugcagggccauauauacaauucuacaucccguauuagaaacagaaaagaaaaaaagucuugguuaggguaugcucagguaagaaacuauccacaauaaaccaaaauuuucuuaucuuuuacaacaugugauuuguccuuguuuaaucaguaauaucacuucuauuuaaacagaaaugauaauauauuuuuacuaauauggccauaauaacugaauaguguagcguaaagaacacugucucagaacucauaagagguucaauuuuaguucuggcccugcuuccuacuagcuguaugacuggacaacucaguuaacuuauuggguccucuguuauuuagcuuuaauaugggauuaaacauaccuucuuuagaguucuuguguaagugagccucuagauaagaauugaagaccaccuuuaucauuagcacauuuuuuuuuuuaauugagacagaaucucgcugugucacccagguuagaguggaguggcacagucucggcucacugcaaccucugccuccugaguucaagugauucuugugccucagcuuccugagaaggcccaugccaccaugccuagcuaauuuuuuuguauuuuuaguagagacaggguuuugucauuuuggccagguuggucucaaaccccugaccugaagugagccacccgccugggccucccagagugcugggauuacaggccugagccaccccacccagccucauuagcacauuuaaauuggaaauguauacauguccugaggccaaauuaggguuucuuaccacagacucuuucauuuuagucuagauucaguacuuucuaggaaacaguguuuggccuacucaguagacagcuaccugcaugaagaauaugcaaagaaucacaagagagaaagaaaagcccuggguuuuugugucuuaaugcugugaucuuaucuccugaccaacauagucagauagguguuagccuuuuacaaggucagcagccagauggauacauuacuccucuuauggagaaaagcaaaugaaggauggacaagagggacuagaaauauuuuuuuccauacaguaccuaccugaacagugaagcccaaguuccuuuguauaaggauaaagaauaaagauuucccugcaugccugccuugcugagcuugugagauuuguugucaggaucaaaugauaaaagauauuugaaagucuuuugaaaacuauggaaauuacuauuguuacaugaagaauaauucuacuguaucaccuauuggggagaauuugaaauuaaauuuuuuuuuuuuuuuggaguuguaguuuugcucuugucgcugaggcuggaaugcaguggcgugaucucagcucacugcaaccuccgccucccagguucaggcgauucucuugccucagccucccgaguagcugggauuacaggugcccaccaccacguccagcuaauuuuuguauuuuuaguagagacggguuuaaccaugccggccaggcuugucucgaacucuuaaucccaggugauccaccugccucagccucccaaagugcugggauuacaggcgugagccaccgcccccagccugaaauuaaauuuuagauaacaaauuaguuucucaguaauugucucuuaaaaauugaacuuaguuuaaaauaucucaucagauuuuuauuugccacucuauuguguuuuaucuaagaaauaaugccguggaaaguauauuauuauagcaguguguucaauggcauaccacaccuucugaaaccacuaugcuauucauuuucaaauagcaaacucaauacuuguuauuuuucuuaaaguacuuguuaaaguaacagugaucauucauauuauuuacuuggcaagugguauggucauuuugaacaaaauguuuguaacuguacuguccuguuuaguauaccuaauuauguuucugggaauauguuacaucaauuuucaauaauguaugacuuuuccucuaauugagaggaauguucuuauauuuuuaaucauuaauaucuuuuagacaucaauauugauguauuauuguaccucaaaaaccuguaauauggagcuguauggcugcuguuucugcugaauuaguaauaaauauuuuaacaggaaaauuuuuugcuguuaucaggguuauuuauuauauagagaugugaauaaccacagcaugacagccauaaggauaagcccugaaacacuggagcaagaugguacugugauguuaccagguauguuucaaguagucauuuuuucuccacaagcaauuuuaagaaaugugcauguuaagcuauuuagacacauaaagaaugauuagcaagggauagugcuugcuuauaaaaggguuuuaaaaaucuugacauacaaagcauuuuauagucuacgugaaguuaauacauaucaagagaauagacauagaaauauaacaaguuuuaauauuuguuuucaaacuuggccgucuauggccuaaucucugaccucaccccaccacugcugaauuaguggggugauguaacuguguugcucuuaauaaaaaucagaacucuggcucucaugugacucaguauaaagaaccuucuguuuauuuuuacuuuaacaacagugcaguuggguuuuccuccuuauuuaauuuaauuuaauuuuauuuaauuuaauuuaauuuuauuuuauuuuauuuuauguuaaagggguuucagagacagagaguuuaggguaggucaggaauuuuuuuuuuuaauuucaucauuuaugcuucuuaugcuucuuaauacuuugauaaaggucuuuggacacaguuuauuuugcuuuaauuuugaggcuuuuauauauucacuuaaaucacugcuaaauuaucaggcaguaggucuccaauuuugaugaaugcuggaaaaaugcauauucuuuauuguaagaucuuugaauuuguuuauaauguugauacuuucugaggcuguuuauauuaaaaucuugagugucuaaugugucugucaauaauuucauaguagcaauauuacuuguaagcguuugaccaucugaaagugagagcuacuucugaagagugcauugagaagaauaauugcuccugggcugcauguuuauuuuuaaauauaaucuuaauaauuucaucaaacauuuauuugaaccuuacuacauauacauagauacauauuaguguacaugacacuauguuaaaguaaauaugacauuucauguccauuucagaaauagaggagcuuuggaaagcggaugacuuaauaaaaucauuuugaaaauaaccaucuauuuucagauaugucuacaggguuuuuuuuuuuuuuuuuuuuuucauuacaaguccuggaccaugucuuuggucauaauaauaauaauaauaaugacaauaauauuaaaaaauacuuuuaauaacaugcacacuccccccacauauuuauacauauauugaaaguaaucauguuuguuguauaaaaaucauaugaacaaaaaagaaugaauugaaauaauuauaaucccacuucccauauauaaacacuaugaacauauugguaaauauccuucucguauuuuuccuuuguguauauguccauacuuguaaaaaagugugaucauaugcuacauauugcuuuuuuaaucuaucucuuucacuuaauauucugaaaauauuucuaggucauuaaauagucuucuacaaugucacuuaaauguuacaaaauauauuccauugauuaauguuugagaaugaaagccuuccaggguuuugcuauauaaauuacacuguaaugagcguuccuaucgugcugucuuugugccagucauuuuaggauaaugacauagaagaaaaauucuaaauugacacaucccauccgcuauaacacauggguacuaauaucaaggauuuacuucugagaaacccugcacauuuaauagagacugugacuuauugauaagacaauuugaaaauaugugccuacagcuguuuuauuuauucugccuugauaaaaaaauuacucguuaaugucuuuauucaguuuaaaucucguugcuuuguuuaacuugugaaaugcaacuuugaacaauacaaguguggcuuucuguguuucauaagugugugcuguauuaguggugaagaaugaaccaaacuucaggaagauagucccauauuugucuucagaacuggcagauguugcuugauauauuccugaagauacaagcuuaaaauauuacaugauggauaaagaaaggauaaagagaaaaucuugaaaucacguggcagaagacuccucccucaagccugaagaagccuuuuguaauuuucuuguuucuuugaccuggacugaauuuucauccaauagcacuuuuuguuuuucguggguaggaauagcucugcucuguagccuuccaaucaaggagcagaaguaaauugucagguuuauagaugguaaugaauaccauguuucaaguugacauaaaucagguaauuccuugagcuucauguuccagcuugucuuacaguauaguuuauuuaaaaaguauuucaaccuuguuuugaugaacuuaaaacauacuuuuuuuaucugauaauugucauuuuauucuuuaaaccucggcuuaucuuacagauuguaucuuuaugucauuuucucuccaugucuggugacagguugccucaguucaugaggcuuuuugcuacucuucuugcgccgcuucacuccucaccccugcguuuaucugaaauuauaaugaguuuuucuucuuugcuuuuuaguuuaaaaucuuacugcuuagagcuugagaagcaucuuucuugcgccucuuuguguucuguacaguggacuaggaacucuuucuuuugauuucuccucucuuugauuaccaagucucuugggcuaccagugggccuugucucccaguuucuauuuccaguuugugaucccugaauucucuauuugguaagggucugccuguguuuugcauauuuaugauaaggaaguaugcuaguaugaagcuccugggcaaagauaaagaauaauccagcuuauucgggugggcuccauuacugcauuucaaaaucagaauuuuauguuuuguugauucaggugcaacuagaaaugaaauguuauuuuuuguuuugguauugugauuaauggagagauucauccuaguuuucugcaguuauuuugggaaguaugugugugugugugugugugcuuuuaacuugcuugcugaaaauuuguuuuuccaaaaggacagaauuuauccuugauguugauuuugcuuguaguuuuguguuauuuaguagcaaucacuaacacguguuccugugguccuucuguaauacugguaucccuuguuacaauugagcuugugcauuauuuugaucaaaguauaugguguacuauucuauggagauacaugcaguauugaugaaauaugguauucuagccaagauacaugacugcuuugagauaaaaauaaaagcauaagcauauauuugucugcucuuguuggacaaacauuuaaaaaguuuagagcacacuaaaugcuaaaaaugcugugaauaaacauugaauuuuuaagugggaaauguacaacugguuuugaauauccauuuuacaaagcaagggauaucuguaguuggacacaauagaugucaaauacagaagcuuuaggucguauuuuucugugacacuaaugacugugauguaugucugagaguagaguguugccuccauugcaugugauuguauugaaaugauuguaaccaacauuauaguuuguucaucguggugcauguuuacugucagacuauaucuaauacuaauucauuuugaaauuaggugggaucucagguccuugguuauggaagauuuauaaauauaagcaaaaauguaauaaguaugauuaguugaauuaguuucugcuaauuuauaauucuuuauuaaaaagcacagucuccuuuugaguuuauccuuauugcguggagaacucucauuuugacuucaacagaggaguaaauucauuuugcaagguguuugcuuguauuguaauauaaauacuuuuucuuuugcacagauugccacacugaaggucaaaauauuuuauucacugauggagaauauauuaaucagauagcugcuucaagagauguaaguauccugaaucuuaaguagcuaguguaaauggaauuccuuuuccuuaaauuauuuagcuuuuauuagauagacuguagagccuugaacgaccucuuuauguaauguaaugcuguggauguuuuauuuuucuuaggauggcuuuguugucagaauauuugccacaagcacugaaccuguucuacagcaagaauugcaacuuaaacuggcuagaaaaugcuuacaugccugugguaucucacuauucgaucuggaaaaggacuugcauauuauaaguaagauagcaaauuaaguguuuucccuauauuuuaauuuucaauuuuucauacucuuaaaaaugaacauuguguuuucaccaguucagcuuauguuguagcagcuauuuugugucuguuacuauuaauauaaaggauaauuuugaauuaauaugaauaaauaacugggaaacacagucuuuaaacaaaguaugauauuugaagaccauucuaaggaauugacuaauaauuucucuuuuuugcuuugaauagagcaaaagaaaauaaaauuuaaugagaauuauggauggauauuggugaaugucauuaguuuauaugcugcaucauuuuucaacuauuuaaaaauuugaaaacuuacguuguaaauguuauuacaacaauauacauaguucucucguugaaauuuuuaaaguuuuuacuugaauagauuuucaagguaacuauagaaugaucucauagauugucaaaaugguaauuggccuuacacacggaucaguaaucuuucacuuggauagagaaauacagauaaccacagaguauuucuugggcuuagauuauuuacuuuuguaauguuguaaaaguaauuaggaucaugaguucuccugagaguuuuaguuuuggcuugccaugccacuccagguuuaauagugaccuuccguaacuuguaggguucuuugcaagauccaucuuuuuugacuguuaucucauuacauuucauaaacuuggcauuagugcuuuacuuucuauauucuaauuauguaguauuuuuauaauucuucccuagaaaaaucuugaauugaaauuacagauuuaaaauuuuuaaagcccauaaacuaguuaguaguuuguauagcuggacaaagucauaaaauguaccauauguaaagcuacaauuacucauaguuuuacaauuugaaaauaugcauaaggaucuguguguguauaugcauauuuacauauauauauauuugaauugauggaguagcuauauaagaugucuuucuguagaaaaagacauaggcagagaaucugaaauacuuuaauucaaauaucugcauggcauuguuccaagcuugaaugacucugugucuggacuaaccucuccaaccuuuauauaugcuuauuuguaaaccaagugguauaguugugagaaucaaaugagauaaauuuugugaauuguauaaugccugguaccuaauaaacgcucaauaaaacuuugagcauuuauacauuaauucaaggaauauugcugacauugaauuuuuaaauuuuuuugucguauauuuaaaaaauuaauuugguacugguuuggaacaagagaaacagauuaugauaacuuuaucuuuccuuggaguacuauaccuaugguuaauauuuuuaaaaauuugagcacaugacauuuugucauccuuguuuuuuagugauuuugaauugacauugcaaucacuuaaaauagugcauguuguauuuagaauucuucauauuagaaaugcaauaguauuuauuagucucguauuucagguacaggauuugaugaggagucagcaauucuuggugcaggacgagaguuugcgcuaaugaaaacagcaaauggaaagguaaauuauucucuuuggauuaaaaaugagcauucucugauuuaagagauuaaaauacaaucuguugauuaguuuauauaguuugcauguuuaagaagaaucaucuuuuaaauuuugauuuaaaauuauuuuuuauaagauaaaauuuuauucauguagggaacaguacaggcaugccucauuuuauugugcuuaguuuuguuacacuucacaaauaauugcucuuuuuacaaauugaagguuugugacaacccugaguugagcaagucuguuggcaucauuuuucuaaccgccugugcucacuuugugucucugugucacacuuugguaauucucgaaauauuucagacuucuuuauuauuauuauaucuguuauggugaucuguuaucuuugauguuacuauuguaauuauuuuagggugcugugaauugugccuauagaagacaggaaacuuaauggauaaaagauaugaaaaagcuauuaugaacugugucuucuuggcaaaauauguguauuucuugcucaacucccagaagcugaauaguguaaaaaagaguuuguuuuuaugugaauuuuauuuuucaauaaaauauugauguccuuuuuuuuccucaugugaaaccugaugcacuauuccaaaaaguaccauaauuccuuuuuuuuuuuaauacauaagauauauuacacuggcaaauaccagagucuuggaaucaaacaaggugguccuucagcaggaaaauggguugagcuaccaauuacaaaaucuccaaagauaguacacuucucaguuggacacgauggcucucacgcccuuuuaguugcagaagaugggagcauauucuuuacaggaucugcuaguaaaggagaagauggagaaucaaguaaguugagugaucaacuaugcauuuaauaaaaauaaaugcuuuauuuuaguaaaaauaaaacuuuauuaagauaaaguuuaugaauuucaauaacaccacaccaacuuuauauauauaucauugacuugauguaacugcuuaauaaauacauauugaaugaaugaggaacuuauuuuacuuuccaggaucuaacaagaauacaugugaauuacaacuugggaaaaaaaggagauuuuagauauguguuaguagaaugguauuaauaaugcaauagcuaauuuagagauugggcccuccaggaguuugguagaaaacuaauauuacucacugagaauuugaauguacuucagggaaugaggaucuagcaaugauagcguaaauauuaauugaccagaugaggcuagcagguucacugauuuuaaaugacauguugggaagcccaggccuuugugaaaauaaacaaauagugucauaaaugcaaauaauauggguuuuuuuuuuagcuuuauauacaaaccauuauuauuauuauuuguacauagaggucuugauuuaaucuaauuucuuuuuuaaagcuaagagcagacggcaauccaaaccuuauaaaccuaaaaagauaauuaagauggaaggaaagauugugguauauacagccugcaauaauggaaguaguucuguuauuucuaaagauggagaacucuacauguuuggaaaagaugccauuuacucugauaguucaaguaaguuaauaaaaaguuuuacuuuuaugcaaagaaguuucaauacuaguuauguaugacaaagacauaucuagaaaauuuauguugguggcaugcuuucucuacauuuuuuacauuuccuuccaaaugugaaauauuucgaaagagaaauuuucugucauaucuugucacuaggagcacugucccuaguuucaugcaaagcuaaucauagagcuuggcaagggaagcuucgcuguagcugugacuucuguggauguuuucccuagacucaggugcuuaugggacaugucccugggacagugguaguauccugaagaagugauuuucaugacauagcuaguuuauaauuguugaaguauuuuaucucccccauuaggguguuuggcugggaugaucugucuuauuuacuauucuauccccagugcccagcacagugucuggcacauuguagggucucaagaauuauuuucuagugccugggugacugauaaaccaaaaguuugagaaguggauaugagggguagaacuagcuaaaugguuuuauauuuauaaaugcuaaucucaaaaacuugucauauuugguuacuagauuuucuuucuagcagcuagaaaugaauauaaugagugaagcaucccacuuggaaggauuuuaugugugauaaauauguaaagccuuugaguuucuuuguaaaaaaggaaacuagaauuaaugaaguuuaugauuagaaauauauguaauugucccaugcuggggaaauuacaccuguagaacauuuauagcaauuaauuauuaaguggagguguacccagaugauaagugaacuggcuuaauguuguaauauuuagauucucaauuggcugcagcuaucagaguaaaucaaaauuugggaguggguucuuguacaguuuaaaaauaauauucaauauaauuguugcuugcuaacauccacuggguagagcugauggaaacuuguauauuucuucaacauauauuuauugagcaugggugauacauuagugauugauggaccugacagaccuggauacugccuuuuugaggauccgagagacaguuggguauuacagaacuuaaauauuggggaagugguauugaaugguuauggacauagacugagauccuagcaccaacacuuuuuuuuuuugagagggagucucacucugucucccaggcuggagugcaguggcacaaucucagcuuacugcaaccucugccuccuagguuccagcgauugucccaccucagccucccaaguagcugagauuauaggcacgugccacaacacccagcuaauuuuuuguauuuuuuguauuuuuaguagagacgagguuucacuguguuggccaggcuggucucgaacuccugaccucaagugauacacucgccucagccuccucaagugcugggaauacaggcgugagccaccgcgcauggcccuuggcaccaacgcuuuuaauuggguaacaguuuacuuaaucuuuaacuggguaacaguuuacuaaacauuuaagaguuuucuuuuuguuuuuuucuaccugcaaaaaauagauaaugauagcaccugcuucauauaguuguuaugaagauuauaggagguagaacuuaagaaaugcuuagcacaucauguaaggucucaaagcaugucagcuaguacuguuaauaauaauaauaaauaacuacuguuuuauauauauacacacacccuuaccuuuuucaaaugugcuaaauauuaaaaguggaaauuuuugagguauaauuaacaaaaagaccuaaacuagugaaaggugaaagugaaggccaccuuaagguagugauaucugagcuaauaauguagaacaguuuucccaaagcauaauaugagauugauacuauuuguaauuuaaauaaaacaaauacuugauaacauguuuuuauuuuaauguauauuggaaaaauaauaaucuuugauuguuaauguuaaagaugcuucaaucaauuuagaguugauacaaaacauauuaaauagauaauaugaguggcacuuggauaugacaaauauaaugaaaguaauacaugaauaagugaaguuuagaaaauaacuguguauuggauuguggaagaaagcauuguagguugaaaaggauuaaaaaauacuguuuugaaaagucucacugguuucuacauaaacaauuucaugucaauauacuauggcaaguauuuuacuuuguuuugcugaggcaggucaaagcagguaaaauaaauuauuuauggacuccuuugugcuuagaccagaaaaguuugaaaguacuguggagagguauuaccauuuggaggaagcauucaggagaaguaagcuugagagaaagcuacaguaaagauaugucccaagucuggaugauaauguuuuaggauucacugaagcuacguuacaaaguuacaaaguuaauucagugauacucugccagucuuuuggcuacuuauuucucauuuuguugaguuauuuugccccagaaauaaacgguucugcauugagguaguucuuuuacuaggcucagaagggccuuuuuguuguuuuuacuaaauuuguuucuuuccuauagguuugguaacugauuugaagggccauuuuguaacucagguagcuaugggcaaagcucacacuuguguuuuaaugaagaauggagagguguggacauuugguguaaauaauaaaggacaguguggacgagauacuggugccaugaaccaaggugggaaagguaggucuuuaauucuuagauauuaaaauuuguguugucuuuucauuaguuuuucagaacaacauagugaaaagucuuguucuuuucaaaaugaguggcucuucuuuuucuuuuuguuccuauuuaaauuuuuuuuaaaaauuuuauggguagauaguagguauauguaugggguacaugaguuguuuugauacaggccuacaauguguaauaauaaucacaggguaaauggggucuccaucaucucaagcauguauccuuucuuuguguuaugagcacuccaguuauacucccucaguuguuaaaguauacaaaaaauuaucgccaacuguagccacccuguugugcuaucaaauaguagaucucuuguaucuaauuauauuuuugugccaacuaaccaucccauuucccacccacucucccugacuacccuucccagucucuaguaaccagcauuguacucucuaucuucaugaguucaauuguuuuaauuuuuagcucccacaaaugagugacaacaugugaaguuggucuuucggugccuggcuucuuucacuuaacauaauauccuccaguuacauccuuguuguugcaaaugauaggaucucaguguuuuuuaugguuaaauaguacuaccuuguguuuauaugccacauuuucuuuauccacucaucuguugauggacacuuagguugcuuccaaaucuuggcuauugugaauagugcugcaauaaacaugagagugcagauaucucuuugauguacuaauuuccuuucuuuuggguauauccauagcagugggauuguuggaucauauugaguucuaguuucaguuuuuuggggaagcuccauacuguucucuccagaguggcuguacuaaauuuacauucucacuaacaguguacaaguguucccuuuucuccacauccucuccaacauuuguuauugccugucuuuuggauaaaagccacguuaacuggggagagaugguaucucaguguaguuuugauuugcauuucucugaugauccaugauguugagcaccuuuucauauaccuguuugcuauucauaugucuacuuuugaaaaaugucuauucagaacuuuuucacauuuuuuaauuggauuugaguggcucuuugacguuauauuugugaauuaggaaaaccacugaauuucuuauuuauuugauaauauuuacugauaaaauaucacuggaaaaacaaauacacuuuagauuuuuuauuuuugagcaaaugugcuggcuuacuccaaucaucuucuaaauucuacauaaaauagugcuucuuuggcuuagcaucuuugaugacugcauuacuccagaaaagucuuuuccaaacauuuuuuuauuagcugcuguuacacgacauguuuuaaauuuuaaccauuuuuggcagcaaucuuucuggcguauauuaucuucccauuuaacagcacaugcuaccuguaauuuaaccuguucuugacaacuaagagugauccuuaugaauaucugacacuuuaccaagaaaagacuaaauuguagacacaccuucuucacaauauccuuugcuccaacccucaggccauugaagagaacaaagggcuuucuccuuugauugcccuguuugcuguggucuuguuuuguuguugugguuguaaauagcaugucuacuucuugcccucaauuuuuauaucuagcugcuaucguuauguuuauaacuuucacuccaauuucugauuuuggucaagagauuaaaccauacauauauauuauuagaacuaagcguugaacuuugguuaaaguaccaauaauuucgaggauuaaugcuguauaaauuaacaaaaccugguuuuucuguuuugaggcuuugaugucagacucaucuggaucucagaaacccaccauucuuugucuuugccuuauucgugugucuguguguguauuuaaaaugcaucacuuuaaaaaugagcaaguuacuagaauauauuggcaaaugaagaaggaacaaaagaaagaaaagaaauggauuacuucacaauggaaauacuuugauuuauuacuaaauuagugaacuuguuuuggauaauaacugcuaggacaaaggggagaaucggguuuuuuuaauauauaauaugaauauauauucagauuauguuuuauaagaagucugaacuaaacaacauuguuuccuuauucugaaacucuugugaaaauugagcguacauuuacaccuauguucuagauucuucagugacauuuuguaauaaucaaaguaaaauuguuaaaagauuuuuuuaauaagaaucauaccuacccugcugguaaguaaugaauuagaaagcagaugaguaaaguaagacacauacagugcauacugauugcagagucauaacagaugcuggggagaauguggagaaaggggaaugcucauacuuggcuaguggaaauguaaauuaguacagcaacuauggaaaacauagauuuuucauucguaugaaggugacucaaaaaacugaaaauggagcugccacaugaucuagcaauuccacuucuggguauauguaucaaaaagaaaggaaaucuguaugucagagagaugccugcauucucagguuuaucauagccauauccacaacaccaagauauggaaucaacuuaaguauccaucaacagaugaaugaguaaagaaaaugugguacauacacaauagaauauuauucaucccuaaaaaagaaugaaauauuguuauuugcagaaacauggauagaacugaaggacaugauguuaacugcaauaaaauaaaccagggacagagacaaauaucacucauauaugggaacuaaaaaauugauuucauggagauaguaaauagaauagugauuaccagagacuuguaaggauagugggagggggagaggaagagugguugguuaauagguacaaaaauacaguuagagagaaggaauaaguucuaauguucaggagcagaguagggugaaugucguuaacaacaauauauuguguauuucaaaauagcuagaagagagaauuuagaauaucccaguuaucuugacuugaucccaguuacccagauuugaucauuagacauuauaugcauguaugaaaacucacauauaugccauaaauagguauaacaguuauguaucaauuuaaaacgaacguaaaggaauauuuuaaaaguuuauuuaaaccaggaaaguacagaacauauugaaauauuaaaaaauugugucucuaccaugucuugucauuuuuuuucaguuaaaaaaaaaucacagauaagauucaagugccccauaucccccuuccaaggcuuauuaucauauuccauuucuccccagagcuaaccgcgaucaugacuuugauaagcauacguucaaucauguucuuauauauuuuuacauguucuuuuauauuuuauguguaaaauaauauugcauaaugaugucuguuuuacacauaaaauauacuacuguuuuauguguuuuuauaaguguuaaucuguuauuuacauuuuucuacaaauuuuuuuuucucaucauucuguuagaaauauguccauguugguacauauaaaucuaaaugauucauguuaacuaauguguaauauaccacacagugaacaugcuauaguguauccauucuccuguugauggaugggcuuauuuccaauuuuucauuguuauaaaugaguuuaaaaccuccuuuauaaauguuuccuggaaaaccugugagacuuucucugauguaauugcucuauuguggauuucaguuuuacuggauuuuucuugaaagagauuguaacaauuuauacucucaccaguagaguuggauuuuccacaucacaucugauauugacagacugauuuuugucaguuugguggcuaugaaaugauacuguaauuuuuuauuuguuacauugaaguauaauaugcaugcaggaaaauauacauaguaucuugaugaauuuucucaaauugauuguauucauguaaucagcacccagauuaagaaaccacauauuaccagcagcccagaaagccccacuguauguuccucucugcccuucaguuaauuaccauaaauuaguuuucuuuuuauacuugauauaagugaaaucaugcaguaugaacucuuuuguguccaguuucuuuuuauuguuuuauguuuaugaaguucauacauauuguuacaaguaguuauagauuguucauuuuuguucuauuaaauuauauauagauacuacaguuuuaaaauuguuucuaguauuugggcauuuggaugguuuccaguuuugguuauuaugaauaauguugcugugaacauucuaguaaaugucuuuuggugaaaguguuuauucauggcuuuuggguauauaccuaggaguagaauugcugguucucucacuuuucuuuuaauuuucauucccuugauuauuaauacugaguuugaacaucucuucaaacuuuauuuuacuuacuaaaaauugauuuguaggagcuuuuuuacguauuauguuuuauauaucuuugacuaaccugugguuuacaguuucauuuguuauguauaauuuuaaaauuuugaugucaaaauuuucaaccuuuuucuuuauaaauuuuugaugaauguagccuggugagagauuuuauuuuccauauaaauuagaaccagcuuuauuugcuuggcauugugauugagauuccauugacuguaaagauuaauuugaggauaauaguuccaguauuggaaugauuaaaugaguaaugcuuauagagcuaguuacaaauagugcucaguacauuuuagcuaugauuauugaaaauagucacugaggcuuccuucaggaucacuuuauucuaauccuagauauagcuagcugaugcuugguuaucuaauuuuucugcuugcccauagauuagaaguggcaaaaccccaaaaggcuauauaugcuaugaguuuauuucuugguuagauagaccuguauugagugauagcuguauguuaaauggaugugauaggugugagagaauaagauugacuaagaauaagagauauuaugagcaagacuuaaccucauaacuuagauccuuuaggaaagucaaauauaaaaaauaauuacuugacucccacagauuuguucuccugucauagggucuuauaacacuguguuccuucaaaacccuaccaguuguaguuuacauuuuuauuugguuauuugauuaaugucugucuuucuuacuacauuauaagcuucauaacagcucaguauuaccgucuucaguuucuagagcagaggucugcagaguauaaccugaugucauuuuuuuauauagcccucuaagcuaaaaauugauuuuacauuguaaggauuguaaaaaaugugacaaagauuuguaugggccacagagccuaaauuauuuacuggcucuuuauaaaagguuugcugauuucuugccgugaaggaaucccuggaguauaguagguguucaauuuagaaaaaaagaugaaugaauuguauuguaacaccauuuuaaaaaguuguuaggugagguauaaacaggcacugaggagguagugacugacugccuggaaaagguagcaagugcuuuaauagggaaugacuucugagcugaauuuuugaaggcugaaguuucucuacuagaugagauaggcagagacaucuuguaaaugaggaaggaagaggcagagggagcaagaaugaacaaaggcccugagcauauggaaggacacaggguguuuggagagcagagggaaaagaaaugagauuggagaaaauuaggagccaucuugugccuacugccucuugcugaguuuuguucuucugaagaccuuggaaggucacuggagguuuguaaauuaugaaguugucaugugcuuugggagggugauugguggcaguaggaggaugaucuagaguggggaacucuuggcuuggagcaugguugggaggcuuucuuuggucuguugaaugaaaguguugguagugaggauggaaaacaggaaaagauuuaaaaguaugauugacagaagguaacagccaagagacauuugacaauagccuuccuugccuucuuuugcagaaaugaaauggggagaguguuuauuaguggucccuaaauuaaaauuuauuuuuguuacucaaauuuaagcauuucuuuguauaauugcuuggauuagcaugcugucauuuuuuaaacugggaaauauagucauccaucuuuuauacaugaaaguaaccuguauaaaaauuacaaauugaucugucaaauaggguuuggaguugaaaauauggcaacagcaauggaugaagaccuggaagaagaacuagaugaaaaagaugagaagucuaugaugugcccuccaggcaugcacaaauggaagcuggagcagugcaugguuugcacugucuguggagacuguacagguuauggagccagcugugucaguaguggacggccagacagaguccccggaggguaagagacaaugauuccuacuaaagaacaugugcagaacacauuucuuugcaaaaucauuccggaguauacucuacuauuaauauuuuuuucuuaaagaccaguggcaucuucacuugaucuuagccaaaaggccaagaaaguauuauaauucuuauaauuguuuucuguuauaauaauuuauaauuuaaugucaucucuaagguugccuuucuuucauuugauucauuuaaaccauuauuuaaaaacagaccauaaguuuuucaagacuuggggcuguacuuuuauuuguauuauuuuucaaagccuauuuaaugcuagauaucuauuauauuucuuucuguugaacaugaaucuuuucuaaauaaaauuaucgauaucauaaagaguacuugauuagauauauaguuuuguuuuaaauuaaauguaccauuuauaaauuuagaaacguuguaugcuugcuucuaaaguuacaucauaccugcuauauuuauccuuguucucaauggaccacauuuuucaggguucuauauuauugucaauuuacaguuaauauguaaguuuggcagaauaagaaugcagguuuucugcuaggauguuaggaagaauuuugaaucuauuuucuacauugcuaguuauagccacuauaacaugaugggauauucuuugugugaucagcuuuguaauaauuggcugauuugggggaguagagaaaauuuugugaagagaagcccagaaggaagacagccaucccugccucuugaccuuccucuuugucaacucuguaauaguugcuucuucccaaauauugucuggaucuaauaggaguuuauuucuaaguuuauauuuggccuuucauaguuaaauaggucauauauaacaggccuuuucuuuaaggcugcugagauaugauuuuuuuuuuuuuuuugagacggagucucgcucugucgcccaggcuggagugcaguggcgggaucucggcucacugcaagcuccgccucccggguucacgccauucuccugccucgaccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccaugaacuuuuaaaaacaaauuuucuuuacauuauuaguauaagcaauaaagucgucuuuaucaaaggauaauauuuauucuguagugcuuuauguuuggcucuguuuucuguuuuuuaagcaccuaacuucuuuauuuuuaaauuuaauuuggaugcagaaagacucugauuauuuuuuaacaauguuggaauugaaauuuauucuccuggaucucuccaacgcuauuuccauuaaaauucaguguuagcuggguguaguggcccaugucuguaaucccagcacuuugggaggcugaggccagaggaucacuugaggccaggaguuugaaaccagcuucagcagcauagcaacaccccuaacucaaaaaauauauaauaaaaauaaaauuuaauauccccacucucugagcuuaagcagccaguauauaucgugaacaaaaucuauaaauuaucuggucccuuuugaaauuaauuauucuucguuuuuuccuccagagacuuacauaauuuauaauaauuauucauagacuuacauggacaauacuaaccaaguauaauaauugcuuuaugaaugaagcaaacugaauauaucagaauauuaaggacuauuaagcugacuucaauuauuauaaaauugugacuacauaucuuauuaugauaaaguacauauaaaauugaccagcuuaaccauuuuuaaguagacaguucugugguauuaaauccauucauaauguugugcaacuauuaccaccaugcaucuccauaacuuuucaucuuguaaaacugagacucuguaacuguuaaacaaugacuccucauucuucccucuccccugccucuggcauccacuauucuuguuuucuuucugugucugauugacuacucuagguaccucucauauaaagagaaucagaguauuugucuuuuuugugacuggcuuauuucacuuagcauaauauccucaguucauccagguugucacauaugucggaacaucuuugcuuuuugaggcugaauaauauucuauuguauguauauuaccacauuuugcuuauccauucacucacugaugaacacuuugguugcuuccacauuguaacuauugugaguaaugcgcugugaagaugaguguacaaggagcucuuugagacccuguuuucaguucuuuugggcauauacccagaaguggaauuguuggacuauaugguaauuuuauuuuuaaucuuuugaggaacugccauacuauuuuucacagcggccaaccauuuuacauucccaccaauaguguacagauguuccaguuucuccacauccuucuuaacacuuaugaucuguuauuuugguaguggcauccuaaugggugugagauaguaucucauuauaguuuugauuugaauuucuccagugauuagugauguucagcaucuuuccauauacuuuuuggccauuuguagaucuuuggagaaaugcuauucaaguccuuugcucacuuuugaaucagguugucaguuucuuuuguuguuguugaugaguuuuaggaauucucuauauaguuugaauauuaauuccuuaucagauauaugauuugaaaauaaaaaguucugucuguggguuguguuuuuacucuguugauguugucuuuucaagcagaaaauuuuuaaaauuuucaugaaguccaguugucuauuguuuuuugguuauugucgccugugccuuugguaucauauccaagaaauuauuucccaaucuaguguugugaaggguuacuguuaucuuuucuucuucuuuuuuuuuuuuugauuauacuuuaaguuuuaggguacaugugcgcaacgugcagguuaguuacauauguauacaugugccauguuggugugcugcacccauuaacucguuauuuaacauuagguauaucuccuaaugcuaucccuccccgcuucccccaccccacaacaggccccggugugugauguuccuuuucuucuaagaguuuuuuguuuuuuuuuguaauaguuuuaggucuuacauuuaggucuuugauucauuuugaguuaauuuuuguauaugcugcuagagaaguguccagaucaaguuuucccagcaauguuuauugaaaugauuauccuuucucuauugaaccaucuuggcuccuuugucaaaaaucaucugaccauauaugugaaggaagauuucucagcugucuauucuaucccauuggucuguaugacugucuuuaugccacaccacauuguuuugauuacuguagauuuguaguaaguuuugaagucaaaaccgaguacuuuguucuucuuuuucaagauuguuuggcuauuugaggucccuagagauuuucuaugaauuuuaggauagguuuuucuauuuuguaaaaaccaucauugggauuuugauagggauuacaaugaaucuguagauugcuuuggguaguaugaacaucuuaaaaacauuaagucuucuaauccaugaacauagauguguuucuacuuaugucaucuuuaauuucuuucagcaauguuuuguaguucucauuucaccucauugguuaauuacuaaguguauucuuuuugaugcuauggaauuguuucuguaauuuccuuuucauauuguucauuguuagugucuagaaauacaacugauuuuuguguguugacuuuguaucuuccuacuuugcugaauucauuuucucuauugguuuuuuugagugcaaucuuuaggguuuucuacuuaugagauuguauuaucugugaacauagauaauuuuacuucuuccuuucugcuuuggaugaccuuuauuucuuuuccuguccaauugcccuggcuagaacuucuagugcuguuuaggauuggucaaagugagcauccuugucuucuuccugauauuacgaggaaaagcuuucagucucucaccauuaugauguucacuguguguuuuucauaugugguuuuuauguugagaucauuuccuucuauuccuaguuugucuacuguuuuuauuaugaaagggcauugaauuuugucaaaugcuuuuuguacaucaauugagaugaucauguguuucuuuucuuucauucuguuaauguguuacauuacauggauugauuuucauuuguugcauuccaggaguaaaucccacuucguuaugguguauaauucuuuuaauauccugcugaauuuguuuuguuaguauuuuguugaggauuuucacaucauuauucauaagggauauuggucuguagggguuuuuuuuuuugccucccccugccccucucccuccucccuuucuucucuuucuccuucuccuucuucuuucuucuccuccuccucuuccuccuucuccuucuuuuccuccuucuccuucuccuccugcuccuccuccuccuccuucuccuucuuuuccuccuucuccuccuucuccuucuuuuccuucuuccuucuucuucuuucuucucuucuuucuucuucuuuuucuucaucuuuugucugacauugguauugggguaauccugaccucaaagaaugaauucuuguucucuccucuucaguuuuuuggaaaauuuugagaauuggugucauaaacacuauuuuaaaaauagugucagucaggcauauuacugugucacaguuuuuacuguguaguaagugaucuuccaaauuguuuauaaugcuugcuuuuaaaagugacacauuucacagggugucuagcuaugucuuuuaaacugcugccagauauguucuuccuuuuguaccuucugaaaucuguauaaccugggguucaacaaggcugucaaaaguuucaagaacugaucugaugaacuacauuaaagcuauaccuucuacaaaauaugugacuaagaaguuacuuucccugaccccaagucaguuucugggagugucuuugucaacauauaccccauaugguucacaaucgauaugaaagggcugaaggagaaaaagaacagguaauuggacucugugaaaggagagaaugggaggugaaggcauguaaagaagagagggggaaggagacauauauguguuuguguguguguauauauauguguguguguguguauacauauauauauacauauauauguauuauuuuuuccuuuccaaugugugaauguuuuuauuuccuuuguguguguguguguguguguguguguguguguguguguuacuuuacguucugggauacaugugcagaacgugcagguuuguuacauagguauacacaugccauggugguuugcuguaccugucaaccggucauuagguauuucuccuaaugcuaucccuccccuagcccccaccccccaacaggccccaguaugugauguucccuuuccuguguccauguguucucauuguucaacucccacuuaugagugagaacaugcaguguuugguuuucuguuccuggguuaguuugcugagaaugaugguuuccagccuucauucaugucccugcaaagaacacgaacucauucuuuuuuauggcugcauaguauuccauagugaauaugugccacauuuucuuuauccaaccuaucauugaugagcauuuggguugguuccaagucuuugcuauugugaauaaugaugaaauaaacguacauguacaugugucuuuguaguaggaugauuuauaauccucuggguauauaccuaguaaugggacugcugggucaaaugguauuucugauucuagauccuugaggaauuaccacacugccuuccacaaugguugaacuaauuuacacucccaccaacaguguaaaagcguuccuauuucuccacauccucuccagaaucuguuguguccugacuuuuuaaugaucaccauuguaacuggcgugacauguuuucucauugugguuuugauuugcauuucucuaaugaccagugauggugagcuuuuuuucguuuguuggcugcauaaaugucuucguuugagaagugucuguucuuauccuucgcccacuuuuugauggggugguuuguuuucuuguaaauuuaaguucugcugcauaaauaaaugucuucuuguaagaagugucuguucauauccuuugcccacuuuuugaugggguuguuuguuuucuuguaaauguguuuaaguucuuuguagauucuggauauuagcccuuugucagaugaguaaauugcaaaaauuuucucccauucuguagguugccuguucacucugaugauacuuucuuuugcugugcagaagcucuuuaguuuaauuagaucccauuugucaauuuuggcuuuuguugccauugcuuuugguguuuuagucaugaagucuuugcccaugccuguguccuaaaugguauuaccuagguuuucuuccaggguuuuuauagucuuaggucuuauguuuaaaucuuuaauccaucuugaauuaauuuuuguauaagguguaaggaagggguccaguuucaguuuucugcauaugucuagccaguuuucccagcaccauuuauuaaauagggaaugggaaggagacauauuacaugaagcuggcaagcuuaggcucuguugcugaaggcuaccaacaccugccuucacuuaucugcuggacagcaacauuguuugauuguuuuuagccaaccaacccaucugggucacuuaauccuaaagcuucuggugcuucacuaacugcaaaaagacuuuuaaaggauuguuuuuaaaguagugacuuugaugauagucgaaucuguguguauuuucuguagaaauauaccaauuaugccuauugggaguuuaaucagucuuguuuuuaauuauucugcuauuuauaucuuuucuuuaaaaugaacaaucgugaucuaaagaggugauuucauugcuuacucauuuaacaauuucaaaaauguggaaaauaaguuauagaaaagaguuuuaaagacaaauuaggaauaucucaguugucuuuuuuuuuuuuuuuuguauuucccccuaggaucugugguugugguuccggagaaucugguugugcuguguguggauguugcaaggccugugcaagagaguuagauggucaagaggcaagacaaagaggaauucuugaugcagugaaagaaaugauaccuuuagaucuucuuuuagguaauuuugauugauuauacuaugcuacacugaguuguccucaacucaguaagucugacaguuuaaacaauuucuuuuagauauauguuaauaaauuaggauaauaauuaauguaugcaauacugcuuuuacgguaacugacaauaugacauuguuuaagggaugagauucuuuuuuuuuuuuuucuuuuuuugagauggagucuugcucuguugccaaggcuggaguacaguagcucaaucucagcucacugcaaccuccgccuucuagguucaagugauugucccaucucggccucccgaguagcuggaauuacaggugcccgcuaccacaccuggcuaauuuuuguauuuuuaguagagacgggguuucaccauguuggccaggcuggucuugaacuccugaccucaggugaucugcccaccuuggccucccaaagugcugggauuacaggugugggccaccaugccuagccagaaugagauucuuuuucccuuuuuggcuaagaauuauuaaaguaaaaauauuguguguuuuagacaauguuuuugcuagcuuuuacuuucuugaauuuuauguaguucugucauagcuauuauauaacauauauguuguuguuguuguuguuuuuggccaaucaucuagcugucccagugcccgggguuaacauugaagaacaccuucaguuacgacaagaagaaaaacggcaacguguaaucagaaggcacagauuagaggaaggaagagguaagauguagcuacagagaaaaaguacaugaaaauccacuuuccuacccuauccugaaaccacugaaaaguucacacaauaaacuaauuugguaagaaaucaucaaaauuaaaauuagcaauauucugauaacucauauaaugggaaaauauucaggguauucaugcuucuucuaauaacauacguuuagguauuuauaauugugcuaauaacauacuuuuaauucagcaggguguuuauggcauaagucagccauauuaagaacugugccaucugccuacuaucaauaacuauuagaaauggcaacuuuuuaaaaauagauauucucacaacuuguccuucacccggacuuuggacucaucuauuugaccguggaacaaaauucaauuuagucuuuuucauuucuauuuucuuacucauuuaugcucauuaucauuuggacauaguccugcuaugcugcccuccaguucagcacauaacuaugcuuucauguguccuuuuuuggaaaaaccucauucuaguuauuuacaggaagaguaagauggcaggucugcagguuucauuugcaaagauaggucuauuguuuaucuuuuccucauuguuuaugagcuuaaaaguuucuuagcuuaaaaauacauuuaacuggccaggcacgguggcucacgccuguaaucccagcacuuugggaagcugaggcaggcagaucacaagaucaagagaucaagaccauccuggccaacauggugaaaccccaucacuacuaaaaguacaaaaaaauuagcugggcgugguggugugcgccuguagucccagcuacucaggagacugaggcaggagaaucacuugaaccuggcagguggagcuugcagugagccaugaucgcaccacugcacuccagccuggcgacagagugagacuccaucucaaaagaaaacaaacaaaaaaaauuuaacugugguuauaauugguauuugaauacgcaaagauaaauauauguauuacuaaagauuuccuugcucaguaaauuuuuuuuuuguaggauuaagacaaauuguuauggaagucuaugauuuuauuccuccaauaggcaaaauuuugauuagaaauguuuacugauauugcauauuuuaaaugcuuauuagaaauggcaugauauuugaugcaugaaauaaaccuuuuacccauuuaaccaucauuauauuuuuuucuagcuauucuuuuuguuaauauauggaauaaguaguaaaauguauaauacacauggugaauucuaguuuuacuaaacuuaaauuguaaaacauauacuuggcacaugaagaguguucuucauagcaucugauaagugauguugauugauaaggugaauauuuacuauuguuuggcuuugcuugcauaauguccuuuaaaggauauuuuaaugagauuaauauagauacugucaguauuuacauuauauaaguauaugggaaaauugcauguuaaauauuucuuacaaaacaggauagaauuaaguuucugaugugguaauuaauaauuuuuuauguugauauaauuuuuucagauuaguuaccauucuaucuguuugcuaccuguuucuucuuucuuuagaaauauuagguugagcgacaugaaugaaccuacaaaaugcagcuauuucuuacauuuaaacuacaguauagcacauccuuacacuuaauuauucacauuuaauuacuugccuaaugcgguguaucuuguuacucuuuuucucuucccucuaaaaaagcuauucuucucuagguauaguauauuugugcauauaggaaauaaaggaacauugaaucgugcauugauaacuugacauaacuuggugauugcagaauauucuuuugccauuuauuuuuaaauuugacauaaaccugugaaacauaauuguaaacauuaacccuuuaaaguuaaaaaaaaaauccuccacuagcuaaauauuuaaagaaauuauguuguuguaucugacuuuccaaagauagauugagguucuaggcacuuaguguauauuuugugacaaauagguuucaucugcaguccuaaauauauagaacaucaguagaaacacuuuguucagauuauugguguacauaaauuuuaucuuguccuuauuuuuugguagaacucuuucuuagaucacccuccuucauguuugguaaaacaauauauagugaauaucuuuucuugaguggaaucuucaguaugaaccucaauuaucacaguccuugcuuuccauggcacuaaaauuaacagaaaugugugcacauuggaaccauguccuccccuuucacagucaccacaguuaccuagaaucaugcgaaaggaggacagaguucccguauuucuguguuucaguuaacacagcacuaugcaaagugaugccugcuuguauguuuuguuuguuuguuuauuuauuuauuuauuuugagaugaagucucacucuguugcccaggcuggagugcagcugcacaaucuuggcccacugcaaccucucccucccagguucaagcgauucuccuacaucagccucuugaguagcugggacuacaggugcccgccaccacgccuggcuaauuuuuguauuuuuaguagaggcgagguuucaccauguuggccaggcugguuucaaacuccugacgucaaaugauccaccugccucagccucccaaaguguugggauuauaggugugaggcacugugcccaaccuauuuuauuuuaaaugaauauuuuugcauuuggacaagaauucuaacuauguauucauuuuuuaaaaaaucaaacuucagagucauucagugacuuuggaaauccuuauacuguauuaaguaauuaaaaaucuauucugauaugacacuuuuaugauuuuaucuuuauauuauucuuagcacuccauuaagcaauuuuuauuuaaaaacaaauuuuuauaagaaaacaaaauuagaugaauaugauauacuuacacuuccauagagauaaaacaagaaagauaaauaccaaaauauuaacaaugcuuuuuccugacaggugaguuuauagauauuuuuuauuuucuucuuuacaauuuguuuccuaaauauucuccaauaagcauauuaguguauaaauagaguaaaaguuauguuuuacaacugaagccauuuuaaaaaaauacugauuagguuuaaggcauccauacuuugcuuaccuuugcuuuuuaaaaaauauuuuuauuuuaauuggauggaggacucucuuucaggugcugugcuuuucauuacuuucuggccaugguucucaagguggucucaaagggaccagcaucacuugggcacuuguuagaaguaccaguucucaggccccacuucagaucucuacugaaacaaaaaacugggggaguacagccaguaaacugugcuuuaauagcguuccaggugauucugauggucccaaagugugagacuuagugugcuaggucaguuguuugcacuuugcgguuugauccaaugaccuucugcaucagaaucaccugggccuaaugaaucagaauuuaugggucaagggucuuggaaauagaucugagucacuugcacaguguucuaaggcucuucucuggcacugugcuagaaaagauuguaguggcuuugcucccaugaggaauagaaacaucaaauaaaauguuaguguuccggcugccauacauacagaucuuuuauuucuuuggccuguugauacuuuuuagaaacuaaaaauuuaguaguauguuaauaauuauacuuacuaguaauuggcuuuuaccuguguuaacauuucagaauuuaagaauuagguuauguuagauuauuuuacuugacuuuucugucucaucuuauuuaccaagucugaacuaaguuuuucauagaugaucagaacucugggcucuaguucuuuuuuuuugagucacagucccacucuguuacccaggcuggagugcaguggugcgaucucggcucacugcaaccuccgccucucgguuucaagcgauucuccugccucggccucccgaguagcugggauuauaggcaugcaccaccacaccuggcuaauuuugcauuuuuguuagagaugggguuucaccauguuggccaggcuggucucaaacuucugaccucaggugaucagccucccaaagugcugggaguacaggugugagccacugcgcucggccugggcccuaguucuuguacuaaagccuugcucagacagcuucaggccuauugacguaauuuaguuacuguuuuaugacaccaggucucuuauaauggaauguguuauugaaacccaagaaagcaaugauauuacugcuucuucauacauuuggaacuuuuuaauuuuaaaucuuuguguuauuaauagucuaguuaauuuuuuuaauuuaucuuuuuagguauuaauaguauucauuuauagauuuuaguucaaugguuugugauaacuugucuuuuuuagauuauauuggguugauugauguauuaauuuaacugugcaagugaagugcuuauucagugaaauucuuaaguagggcucuugaagucaucagaagaacuaguggaugaucauaucaaugauuuuauccuuauauuccuuuucagcacucuguuucguaaggaaaauuaaacuucaauaauguuagcuuuuucuucuuucuucuaaguauccaaguuucauaauugugagcuguagaugggcuaaacccauguccuggcuuacaugggagagucccauuuuauagguguccaggcauauuucuuuuuuuuuuuuuuuuuuuuuuuuugagacggagucucgcucugucgcccaggcuggagugcaguggugcuaucucggcucacugcaagcuccgccuccuggguucacaccacucuucugccucagccucccgaguagcugggacugcaggcguucaccaccacaccgggcuaauuuuuuguauuuuuacuagagaugggguuucacuuuguuagccaggauagccucaaucuccugaccuuguaauccgccugccuuggccucccaaagugcugggauuacaggcgugagccaccgcguccggcauguugcuauuacuuuuuaagcccuuaaaaccauuaugguuuucuugauuugacgcaucaaauccaauauuagcugauauuccagugacacauaaaagucucuuuuuaaauuaaaguauuauaugaagaauuuagagaguauaaguaagaaaaaauagaucagcauaacccuuuauacaaagagaaccauuaguagaauuuugguguaacuucucacacuuuuuuacuuauuucauauaauuucauacugugauagauauugguguccuguuuguauucccuuuaauauuauaucaugaaauuuuuuugugcuuuauugcaaauaccauauuaaaguaauauaggaauuuaggucaagguuuugcauaaaccuauuccuuaauucaauuauuguuuuuauuucguugucaucuucuaaucaaguuuuacuuauuucuaguuauaucauugacugaauuuuguuuuacauuuuugcuuaguguuauaauacauauauuuuuauguuuugcuuguauuguaccccuaccuucccauuuccaucccccccucaaaguaaauguuaauagucuaauaucuuacucuauuaaaauauaaucauguacagagacuuacacauaugugaaaguguagacauauguuuauuuacaaaaguaguauucuguauauacauuugcaacaucuuuuucucauuuuacaauacaagaagaacacacuguaggucaguaaauguggaucuaccacauucuauacaguaacuaccuaauaucauaauauggcuauaccauaguuuauauaaccauuauuuauugaugggcauucagguuauuguaaguuuuuguggguuuuacuguaauaaauauucuuaaacuuagagcuacauauuaguguuuguauaguagagcuuucccaaaauagaauguguggggcagagaguauauaucugucuuaaauuuuaacagauaauucacauuguuuuaaaaauguuauaggaauuuguuuauacucccuagacuaauguauaagaguaguguuuuccucuagcaucaccuguauucauuauucuuuuauuuauuuauuuauuuauuuauuuuuuguagaggcaggaucuugcuauguugcccaggcuggccucgaacaacugggcccaagugacccuccugccucagccucccgaguagcuaggacuguacaggcaugugccaccacaccuggguuuaguuauucuuuuuaauucuuggaaaacaguggugaacaauguuaucucauuguuaauuuaaauaacacaaaaucauauucuguguaaaauuauuucauaaaucucauuuuaauggcugcguauuauuccauuuaguagauguauuauaguuuuuaauuacuuucauuuggguauuuuuaaaauguugcuauaaugaauaaaguuguaguaaacaccuuugaggugaaauccuuuaaaaauauuuuagaguuuucuuuaggauagauuccuagggugcaguuacuagaucaaaggauaauaauuuuuaugaucuugaaauauaucaccaagagcuuucugaaaggcuuguacuauuuaacacugccacuuauuccaugcuuuuucugccuaccugccuacagaugaacucugaauuacccauugucuacacaugaguguagcuucuaucuaaaccugguuaucucauaccccuauuuuacucacuccucucccaaugaaagaaauaaaucaccaaguucuauuuauacagccuucuuaauucuuuaauagcuuuuuaauaucuacuuuucagaaucuuacuguuuccuuagcugaggcuucuuuucuuugccuaucugacagcaaaaagccuuuuaacuggccuuaccuccagucuuaucuucuaagccauuagccaccuucuuuccagaauauucauucugcaauacagaucagaucaguagcacuucucuguuuaaaaccaaaaggcuauucauaguccuuaggaugaaggauauacuuuuaucucuacagccucaucucucucuauucucauuucuuuucccuugcccuuccuuuuuuuccccuaccucugaaccuuuaugcuacuuguuaccuccuuuauuugaccucaucuuauguggugguuucuuuuaucucuacacugucuaccuucccacccucaaguuuuguuagcuucuccucuaguuugugugccuccuuuuguuauagcauacugucauaauuucuuguuuaguuguguguaaacccucccuccccucauuagaaugugagcuucuugaagcagagauuguaucuuguuuaucaaggguucccagaacuucacaugguaccuguuaguaccaugauuuguaguauauuuuuguugacuaauugaaagcagguuagggacuuaucaucucuagaaugaaguuuugugguauaaaaagguuuuaauuaucuguuuuuuugcauaccucuccaagcaaauuucccaagacuuuugcuccaucacauauacucuguaaaagucagcuacauguauuuuuaaugacuauacaauauuguuuaauaucuuuaugcuuuuauaaaauccuaauuuauauccuauuccuuuuaacuggaaugcccucucuuccuuuccuuuucucuuguuaaacuuuuugucauucuuugaaaccuugcugauuguccugaguuuauuuaguaucuuuucuuacuucaggacauaauguguauagauuucuuuuauagcauuuauuguaauauuucauaguuuguguuuuuauuucuguuuuuuucccuaguggacugaauuccagugagaccuguaucuuugucauuauauucauuucaccuagugucugcuaaauaaaagauaaucagaaaauuuggugaauaaauuagugacucaacuauauuuaaagaaacauuauuuuagcccaugggauacaauaguauuuucgagcccaauugcuuuaauuuuuagacaugauugcccccgugccuucuugauuuauaaaucaaaagauucuaaaaagauugaauuuagcaagacauuaaacgggugugggugugauguauuuucaugaggagaaacaauauuguaggcagaccauagaaaucagaaaaugguaauauaacaauauuauuaccuuaauaucuauaacuuuuuuauauaguuggaaaauacuuuuuauaguaauuuauauaucugcuuuguaacaauugagaaaucaugcauguuaagaaaauaaggcauuuuguucauauuuguucauauuugaaauaucaauuuuauuacauuuuagaaauggaacucaguuuacauaaccuuagccugagaaaauaauugguacugcauuauugagaacuuauucuucuguuaacauuaaauuagcauguuucuaucuguaguagucauagaauauguuauucaugguuuuucauacaauuugagguauuugcauuuuuguuuauaucuagaaacauaauugaaauaugguuccuuuacccacuuguacauuuaaugaaggguacuuugauauuuaauuugacauuuaugaaauuuuauuagagggcaguaggcucaauuugucccaucauuagaaaaauuaaacugaagaucaauagagaaucaugaaaaaacuuguuuuaaauaaaaauguucagugcuuauauagugucauaauuccuguuucaguuaaugguaaccugucaaauuuagaguguuuucaaauuugaagacauuuuugauguuguuaaaacucaaggaaacuauaguucugcuguauaagaaaaaaaccuaaaauuuuaaguuguaacuaaaauuuauuuuucuuuucaagguaaauaaauguuaaugggaaaaaugauuuauuuuauuuuauuaaaauaaauuuggcuguauauuuuuuccuuaaauaccauauaaguggaaagagcuauaaucuguguggguauguauuuauauauguauauauauauguacauaguggcacuuuagaagaaaugauuuaaugaaagauguuuccaaaauguuauuuggguuaggugcccccuuuaccaucaauauaaagcccaagcuccuuucucucucucucucucucucguucucucucucucucuguguguauacauauaucuauaugcagaauauagacauuuuuguuuuguuuuugaucaucugguuuucuuaaccucuauuuaugauuuguaguaaacucgguaacauuuuuauuuugguuuuguagcaagauuaauacaaauauuaaaccuggaagagcuuguuaaaacuuaaugguuaauuuaaaaauuaguuuuuauguuucaauggaaaagauaucugucuucaacgaauacaugguuuacugacuuugaauauauaugauauuaaaaaaguauuuguaagauaauuugauugauuuaaauugaacuucuugauuaucuauuugagacuauuaguaacuacacaauaauuuuaugaguauacaagacggguuuuguacuuuauaaauuauauuuaagauauuaacuuuuaugugaaauggugauuagguuauggguggggguggggggcuggaguggggaaauuggaagaaaaguauaauguccaaaaccguuaagaauaaauuuuuaugcuuuuuaguuugaauuauuuuuuguucauuauaguguuuucauuuugugaguuuuucuaugcacauacaaaauguuucuccucaggcccccuuguauuugcugguccuauuuuuaugaaccaucgagaacaggcucuagccagacucagaucccauccagcacagcuaaagcauaaacgggacaagcacaaagguauuuggucuuccuuaucaccuaggugggauacuuucccaauuucuuccacucauuugaauuuugucucugggaaaaugcacaaaccugauucuucuacuuugcuucuaucaugauguagccugaggagaaagaacauucugaaagugauaccguuugucagugacugucaugcuucuuguuuuuuuguugucguuagcuuucauaaaggagauauuuuacaauauaucuuuuccuuguccauuucuuuucaaauuucaaaaaguuaagggaagguggaaaaaauaauuauugcuuucugucuuacauccuuuauuauuugcucuuuaaugacugugaucuggccuuuuacaauucuuuuuugaaugcuguuuauaugcuuuaggauaaacaauauuacuaaauucaguauauuaaaugaugauaauaagacugccauuacacuuuuccacuguuuauuaauuaaguuuauauaaacaacaaaugaauauacaaauauuugaugguuguggguuaaguagagauaagugcaagcaaagcacgaaucaugaagacuuucucuagucccuggugauggucagagggcuauccuagucugugaggaaguaggaaucuagcucgguguuguccuuugagaucucagaguucuggguuaauuaaauauauucuuaaagcaugcuuauuuucuuguaaaccacaaauuaugggucagcuaagaucaggaaagaauuuaauacaaggaauuuauaaauuuauauaaaauuuuugccuuguauccuggccuuugaaccaguguucuuccuuagcuagcacaacuuaaaacucccauuuucuuaaaugccuaagauagguccugcaaaauagaauaggaaguuuuaaaaacaugcuuuccauguagacaaauuaaucuaauuaauguuuggauccuuuucuuuuuuuugcugcaaaauugucauagucuaauuuaaaaaaauuucauaggcaauauaguauaauccacuuuauuuuuauuugccucuuucagucugucaguuugccacucaaaacaaaaacauaaacaaaauagacaaaacucaucuuuaguaaagguguaaauagagcacaacuuaagauauacucugcagaaauaaaaauaguguuuuaaaucuaaugcaauuaaccacaguaaaauuugugauuacuuuauuuacugagugcucuaacaaugccauaaauauuuaaggaauuuucaaccuaagacagcugauuccaaaaagaaaagauacauauauaaggaauaauauuugggguaugcaaugaaauuguuauuugccagaaugucugaucuuuuaugauuucuacuaugucacaauuagaacagauuuuuucaguuucuuucuucccccaaauauaugaaagugaaguuuucccaauaguuuaacugagguuaaauauucacauuucaugaaacaguuuaaaaccuuuucagcuccauguuaguaucucauggacaaguaucuuuacccuuuccagauuuuuaaaugaaacguuaaaugaaaaccaagguuacauauuuaaagcaaacuuuucccaaugucacauaaugauuggcuauagaaauuauucagugaggcugggcgcaguggcacaugccuguaauugcagcacuuuggaaggcugaggggguggaucacuugaggucaggaguucgaggccagccuggcuaacauggcgaaaccucaucucuacuaaaaauacaaauaauaaugauaacaauaauaagcccagugugguggcacaugccuguaaucccagguacucaggaagcugaggcaugagaacaauaaucacuugagccugggaggcagagguugcagugaaaaaacaaguuauucaaugauagcuagucuucaaguuugcuugucaugggguuacuuuauaacaaguuucuuuguauacuuguaaccacucuguaaggaccuacuuuguaauaucacaguguaggaccaguuuuauuggauuuuaggguuuuauagagugagauaguuuuaucuuuuuacuccccaaauacauuuacaaugcaaauaauaauuuaucaauugguacccuauuuuuuugugaagaguauuaauuuacugcucacuaauuucccuccagccacuaaccauuuacacucacugucuugucauuuaauuaucucuccauucacugcuuuuacuuuuacgacauguugaacaucccuaauuugaaaauucgaaaugcuccaagaucugaaacuuuuugagcaccaacaugaagcccccaagugggaaauuccacaccugaccuccugugacagguugcagucccagcacacagcuuauucaguguccuaaagugaaagcaauccucucagcccucuucagcuaugauaaagcuuuuccaugcacagcaugauggugacgccaaucacaguuugucuacguggguggcuggguggcugagguaccuuugcuuucugauagugcagggauacaaauuuucaugcaccaaauuauuuaaaauauugcauaaaauuaucuuucggcuaugugaguaauuuguauaugaaauaucaaugaauuucauguuuagacuugggucccauccccaagauaucucauaauguauaugcaaauauuccaaaauuugaacaaacuccaaaauccaaaacacuucuggucccaagcauuucaaauaagggaugcucaaccuguacauauuuucagucuuuuaauaaguauuuuuucuacauauauuuuucucuucaccuuacccaguuuaucuucuaguuuaucuacugagaaguuuaugguauugauugcuauguucuauccuacauuuaauuauguugguacaaauuauaggaugguaauaguuaaaauuuuuuagacugugacuuuuuugugaggguguaaggagaguaagaacuguggauuuauuguuaacaggacuaaguucuaagauggaaaguuggagaacuucugggugauuggagaaaauucagagaaggucagaauucauccuauacaggcagauauugacuaaaggcaaagcagaguauauagacugaaucaauaaguaaaauuccauauaaaauacaguaaauuauucuaaaaugugccuauaaacuauauucgaaacagaauuaacauuuguuucagcuauucaguaccuuacacagaaaaauguguuaauaguguacauaguuaggaacaucugaauuguucuagagauaguccuaaaaucuauuuuaaaaugacugauuugaaaaucugaaggcacacugauaaacaucugagucuauuuuacucuuacuuucuguuuggaaauggugcagugugaugaaaauauuauagccuuuggaauuaggcuucaauuuuauuucugaauuugucauuuacuagaacuacauggcugugcaaaaugucuuaaucucuuuggcuucaguuuucuuauuuuaaaaacaagaauaguaauucuuaacugauuguguugcuaugaagauuaaaauauauguguguagucuuugcacacccacauauguagucuuugcacauauaaauccuccaugaauacuagcuuuaauauuuugaauugaauuauuuguuuucucuuucagaauuaucuuaaagguacaauauuugagauuuauuaaaugcauaguuuauuuuuacaaaggauuuaagguuucaaccauuugguggugguaaaaugcaugagccuuauuuaugauuaaacucuaaauuuguccuaccauuuaugauuuugggcugguuacuuaaccccuuaacccuucaagccuuaguuuuuucaucuguaagauggacaaagaauaccuauauuaucagauugcuuuauucauuaaagaaaguaacaauaguaaauauugauugagcacuuuucauauuuuauuuaauucucauaggaaccugaugaguuacauaucauuguugcuauauuauagauaggaaagcuaggaccagaagguccaguguccaguugucauacaacuagcaaaugagaagagccaagauuccaguccaaguucuuaaguuccaguacucccaagcacucauccacugugguauuuaauuguuuacaguguucaguuagcacacagcaagugcuuaguaaauugcaacuacuuuuguccuugcugauuuguuuuaaugauuuugcuccaaguacucacuguguucugugguaguuucuguuauaugcaugacuguaggauuacccuccaaaaguauagauuuuaguaaaaauuaaaauuagaaguuagagucccuuagauacugaacccucuuuuuucucuguguauacaaauauguguauauaauuauauauaauguguacauacauauaauauuuuaguuacauaguugccaaggcuuuguagcuacuguaguuucaguguuacaugguauacacacacacacacacacacacacacacacacacacaacauauucaucuuagggaaaauacagaugugcucauacuuaaauggccaauuauaagauuauucacaucugucaauuuuuuauugacaauguuuaauuuuuuauauagaucuaagcuuuggucuuauugcugcucauuaacacuuuacugaauaaugagcuugaacagauuuuuuuuuuuuuuuugagacagggucucacucuaucaccuaggcuggagugcaauggcaugaucacggcucacugcagccuugaccucccgggcucaggugauucucccaccucagccacccaaguagcugggacugcagguauucaccaccacacccagcuaguuuuuuguauuuuuaguagagacaggguuuuaccauguugcccaggcuggucuugagcuccuaggcucaaguaaucugccuuucucagccucccaaagcccugagauuacaggugugaaccaccaugcccagcuugagcagaauuaaucuugcugaauucacuugcugguucuugaauuuggacuaaauuuuuggccacuuauuaagugccuuuuuucuuugauaaacuuugguuaaugucugaguuauaggaauuauacucaauuuuuugauaucaaauaccauauacagauauauauauaaaauauauauuuuaauucugccacugcugcugauaaagauuaagacccucaucucaauuuuuuuacuuguaagauuuucacugucuauaauaauugagaaguuguuuuguacaguuacaguuuguuucaaugaacaaaauguuucuaguauuauuuugaccucuaaauaacagcugcuacuuuuuuagucauugugguuguauucacuaaauuaccaaccuuuaaaaauaaucuccuuccuugaugcuaugucucuauugugggauuuaugccuauauuuaaucuccuacucaagggaggagacaaaaugcuaaauucaaagguaaaaccuuauaacuaggcaucaauacauuuauauaaaguggaaugauacuugaaauguuuaauuaagucuggcagaaucauaugaacacaauguauuuucuauguuaaaucucauuugguuuuaauaauuagacauuuuuaccaauugagauaaagccguaaaauuucuuuacaucuggcgucuuauuaaauagccuuuggaagauauguauuuguguguguguguguguguguguguguguguguguguauguguguguguguguguaggcuuuugcauauauuuuaccauuccacuaucuuuccaacaugaggaggcuuugaacugaguauauuuuauuuuggauggagugaaacuaaauguuguugguuuuuuuuuuuuuuuuuuaguccauccauucuuugauuuaauuuggcaaacccacauuagauaauuuagcagaagaggaauuauaucuucauccuauuauaguaaaaccucucacuaauucugaauuuaugauauuugagaugcaguauuugugaucuuuuuugaguaaaaaauucaaaauaauuucuuccucugaauuuucagggucauacuuauaaggggaaaccugucuaaaaucacuagcuuuucaaaccaagggcucaagaaaugaaggauuccuucaacgugccuucagccucuggguccagcaguuaauucuuguauguuaaaggacuuuuauguuuaugguacauuuuaaauguaauauuggccuauuuugaaauauaauguagguaaccacacucuauuuauuguagcauuuaguuuaaucuguaaucuguacugcuugaagguaacaaaacugaauuuuuacuucaguguucuguaugauuaagacguuuccaguaagccacacaggccuaccuguucuauguuauuccgaauuagugagguuuuacuguccuagugucguaaagaguuucagucuucuugaaauuauaggcauuuaguuacggaaaggaaaguaauaauguagguagauuuugucucaccuggauguuacuaaagguuagguaaaaaaagaauaaacacaaaaugauuuaauauuauucuguuuaacauucuaaaaugcacaaugaaaauacaggauagaaagugugugucuguagauucacauauguaucuucauauaauacacacuuguuuagaguugcuauaccacuugagagugguuuagacuaguugaacuugugaaauuccuuccagauuuacauuuauucuguguacaaggaauuugaaucuugaugauauaaaggucauauguuagugauguauagaaguacauugugauuagaaaaaguaaguuguuguuauuuacacauuccaaacaaaaauuuuuauauucuggaaugugguuuuugaugcuaugguuagauuguuggaaaauucaaaguuggauugcaaaagccaaggguaaagaaaaggcuuaaagcaagcucaaugaaggaaauugugagaagggaggaggaaagaaggagugaaagcagaaaaaagguuugguugaggguagugauuggggacagggagaaaaccacaaagcaauauggcugaaggugaugguggcacaggaaacaugaauaagaauaggccauugaacugcaauauauugaauaaagcucuuuggucuuuauacauuuugaaaaguucaguugaguuucaaaauacuuaugggcaguguagccuuucuaagaucuauuuaggaaaucuaagucacuugugaauccauuagcaauuuuuuaaaaauggcuaguacuaacaauaucacuaaguuuaaaauaauuguuaaaugacuuugcaugcaguaauuuuuuauggaaacuaaauuuucccauauaaacuguuacauuuuaaauuuuguuauuucuauaacuuaaugacccguuuauuacauaagguuuuauccauaaccagaucuuaucucuguuuuuauuaauuuagugauauuugcaaauggaaguauauagucuaucuuuucaaaauuccuucuuugcagguagauucuugaucuaucacuucuaacagcuacagauucuucuugcuuguuccuuuuaacauuuuucucuuguucuuccauaauaaacugauuuaaauuuuuauuuugaagaugaauaauggcuuaaucauaauucacaaauuauaacacuugcagauggaaguggagaaagaggcgaaaaggaugcaagcaaaaucacaacauacccuccaggcucugugcgauuugacugugagcuccgggcaguccaagucagcuguggauuucaccauucagguagcggcuggaacuuuaggguauaacugcguuuuuacaauugugcucaguaacuuauuucuucagauuugaugaacauagccuguuaacuguguguuaaaagcuguagcguggcagucucucaaaucuguaagaccuuuguauuuauuacagaaucucuuuaaacaacuauggcaugauggaacagguacuugucuagagaucuaacuucuagucugucuuccuguggacuucuuuuauaauucaagacagucuggaagaugaaauaauccuuuaaaucucuuucaguucuagaaugcugugguuuuuguaacauguucccauauuuuguuaauguucagugauaaauguaugucaacaaauuuacuuucuuaaaauguagaaaauaauuaaauucuuaguaaauuauuggcauuuggguuagcuuuugcuguacuguucaaccuuuauaaaaacaaaaauguuaaauuccuuccuugaagauuauuugauaagguauuaacagacauuaaaguucugcuguuucauugauguuguacguaauugugcagaccuccuauccuagauaggagagaacaauauuuuauauguaguuacucauuauuaagaagauuuuacaguugaccugaaccaguguguuaauaagaauuaauguuauuaaauggcauuuauacgaauuuuuaaguguguauuaugaaaaaauuauacauuuauaugaccuacaaaaauauuuuucagaacuaaaauuaauuucucauuaaauacaaauuuguccuucaguuaccuauuuuuaaugguucuauaaaucuuaaauagugaaaauuacacugcuuuuaguauaguugugauagaaauguaaaaugcauauaaugaaaaaauaaagcuguguguuuugguugcagugguuuuaauggaaaauggagaugucuauacauuugguuaugggcagcaugggcagcuaggacauggagaugucaacuccagguacuugcuaacuuuucauuugaagauccagaguuauuuuuucuucuguuuucuuuuccuucuuuuuucuuucuuuucucuuuuuaaguauauauuucuagaauuaaaauaauauuauaccacugcuuugcaaaguguggcccaugaauuauuggugguuucugaucuuaugguugagugcuuuuguagagauaaaggauuuuguaguuucaggagaaaagcugauauauauuuuaaauaggagagugauuaugauugucacaaaauaucacuauauucuuagcaauuaucuuuuuaaaggcugugcauggcaauagaaaaauagugaauuguauuuuuaaaaaaugucagcaauggauucaaacauauuccugaugucuguuuugaaauuuuggucuaauaacaugcagucauugaagcuuuugaauaauuuuuggacagaaccuauuggucucucugauuaacucuuuugacuuauugcaaauaguaguagagagacuggugguaauuuccuaauaucccuacuucauuuguuuuaguuuuaguuuuaguucgugacaugaucgugcagcuaaagauucccuuucucagcuuccauugcagcaggauguggccaugugaacuuaagugauaggugccacuuuggaaucuugcuguuaaagggaaaggguguaccuuuccauuuguccuucucucuucccagcuugcuggcuggaaugaauauguggaagcagaaacuaaagaagucaucacagagauaaguuggagacuguguacugagaauggcagaaucauaagaugggaauaggcugggucucugacaccaugaacugccucaucagcuucuuaaauugcaugcuucuugcgugagaaauaaacuuguaucuugaagucccucuuacuugucuuucauuacagcagccgaguuuguauucuacguaaugcagucagaauacuuuuggucaaaaguaauagaaaauccaucuuuauuaguucaggucuuccagaaagcagaugccaagacaggauuagauaugcaaagaauuuauuagauacauguaguuuugacccuaugaaaggagaaagagaaggaagaaucggguaggagucuagguuccagcauaacauuaagagaguuuuagccaggccagugauguguccccaagcugaggauaccuuuggaaggguccugcauugggcaggaauagaccaacauucauaccuucaccauguucagucacagcugguagcaccccaggggacgaauguccucgugcauccaaagggacagcaccugaggcuguuauaauaguuaacucugcucucuguagcagauugucuugaaggagaucugaguggucugugucugugguugucucaccauggaaacaggaguauuuaugaagucuggaaagauagagagcagcuucaagccagacuucacucagcaauucacuuagcugcaaaaacuuaccuuuugaccuucuacucugccuuauucuuccucgcagucacaguguauaugccagaaucaaggggacuucuaugguuucuccuuuacauacagugaaagaaagagaacuuaccuucacauagucauuaaauaaaauucaagguugucacugugucuugaacucacucuacuauuguggcagggauggaauucugccauuuacaugguaaagauuagugauucuuaacccuggcuguauauuagaauuacuuagggaauuugaaaaaauaucauauguggauucuacauccagcauuucugagagauguguguguugaaaggcuugugggugggacagggguggggagugguccuugauaggaugccagcaucagaguuuuuucuaaaagguccccagauucuauauguauccaggaugagaaccacucucuacccuucgagcugaggcagggucagaucugugggcacugcauaaaaaauggcaacaaaagggaauguccugaguuauguuuaugaauguuguugcuaaugauaagagacgauugagauaucauugaguugaacuucuuauuaaaaacacaacugaaacauaaaauugauacuacuaucaagagguuuguaaaacuaucacaaucauaaauauuuaaugacuaauaucauacuugcaaagagcaaaagauguguuuggcagaauuacuuuaucagaugugucugcuggauaugacauaauaccaacaguguugagcaauuacugucacagguguuagaugccaacugauauuuugcuuugcaauugaguaacauuacugaaaugcagaggcugaaucuggguaguaauuacaguuggcccucuguaccuguggguucugcaucuguggauucaaucaaucuugacagaaaacauaguuaggccuacgauaauugcaucuguacugcacauguacagauguuuuugucuuguuauuauuuccuaaacaacagaguauaacaacuauuaacaugguguuuacauuguauuagguauuauaaguaaucuagagauguuuuaaaguauacaggaggauguguaguuuauguacaaauacuaugccaauuuauauaagggauuugagcaucccuagaguuugguagcugcaggggauccuggaaccaauuccccauggaugcugagggaugacuauaaccuguguggggaagaacguggcaacuuuuuguucuguuucucauuugagaguugggacacagaagaagaggguuuauuuguaucaucguggcuauuguuguuguuauuuagcuggugguuauuuugugagccauagaaacugggaaaggugcauugcaguuagauaagauggggucucagucauguaugcagcaaagagggcacuucacagaaaauaauuggcaaauaguauuucauggucuugccagaguggaaagggaaguagugaaaagcauggccauguuauagucagguuauguuaucuuacugugcacuuggcacucagaagaaugagcagcaugagcacaacauccuuccacaccacacugagguguguuggccgcugagagggaagguguucaugucagcuuuuaaaaugaagagauuaccuaaaaacauuacuucgugguccugauuauaccagugaacaccauucuucgauucccaagucugaagagauauagggcaguuucaggccagacuuccucagguaauaauauuguagcaauaugcucaauauuuuaaauugcuugaauuuaucgucuucaugaaauacgauagcauuuaauguugaaacaaaauaucaggguuucuuaugaagauuaaacauugguaggaucuacacagugguauaguaacugguagaugcuacauagucaucgaaccuggaacuguagaggcaagguucagcucuucacuucuuaccaaccauaugacuauaauuucuuaagauuaaacacuggugggauuuguuuuaacugcccaaaguuguucuuuuccagcauggaauguuuugguccuuguuccauugagugguaacugaaagacugauuacaugaagugugggcagagcuacaacggauaaugcaguagucauaccuauauacugugccuaguggauuagauauucaucaagaccgcuucagucuuaagcacucaguuacccugucugucuggacuuuuguggaacuuggaaaguagcaaccaagaacucuguuauuaauucagaaaggaguugauuaugucuauagaggaacaaucuugggaggaacaaagcuucuauagcauauguauuaacuacaacaaagcaaaacauuuacagauaguugaaauaaaggguuacaguuggagaauauguuugaaaagucucuaguaaucaagagcuguuaacuggaauuuacuauauagcacacauuaauaauguguuguuuaagaucaauauugugguaugcaugauaaugaagauggaaaaguguuauugauauucucuuuauuuaauguguuauauugccagaaugacugaguucagucucuagguuggguccugauucugucacuugguagcuauaugaucuuggccagguuacuuaaucuucuugugucucaguuucucaaguuuaaauauccauaaucugaugauacuuucuucuucugugaugcagcccuacuuuauuucccuuugacuuuaugccccacagcccucuacuuuuuuacucuuuuuucacccuuuuuuuaacuuuauuuccuacucaaguuaaagacuguugcuuaauuucuucaccuauacucuuaccaguuucuucaguuuucccacucucuuggucguggugcuaggacaugauaaaaccgcaaacaugaaucaaucuuaauauuuccuaugccuauacuuaggcuucuggaagguaagaaaucaccauaccuaugcagauugauacuuaauuuccagauucaaccaguuccuguacaauggucauuaauccuccuguuguguaguauugaacuauuugacuuaauaccuuuugagaguuugaugaaagacauggggucucuaugaaaaauacaagaauauacacuuaaaaauuugcuugcaaauuuaggagaucuuuugaagcucacucauggacuuccuagaaguccuuuauaucugaguugaaaacuccugcucucgguauguaucuauuccaucuaccaccacaccuuuucucgaaucuucaaacucuccacucaccuguuuccuccuuuuagcauaggaucuccauguacauugcaacagauguaagaaauuauucagcccaccaacccugcaaaccuacuuccauccauaccacuucucugcuucuuuccucauguuacaguuaaagaggaaccuguuguguccuugcuaugaaaccuagcugucuuuuccuuagagaucuauuucuguuuccugucuucucucuaaccuuugucuuuagcgucuuuauuuugagucaccuuuuaaacuuccucaaaucucuuaucauuaaaaaaaaaaaauccucuccuucagcuucauuuuuccuuuagcugcuggcucuccuuucuuuuucccuuuagugcugggauacuuagagcuacuuuguguauucucugacuccuuaucugcugcauuguggugccugcuuccaccaaagagaccuccuucugcuaaaucgagugguuagguguaugucuccuuagagcauuuggcauguacuuuauuuuccacgcuugaaaccuacuccuccaaugagucuccuugaguucuuucuuucugugugguuuauucuagaugucugugagcuguucuuccucggucuguaucuaaaauguuagaagagacucauaagggaaauuaggaucucuucuuuucucucucaaagagucuuccuagaucucauucauucucauagcuuaagugaauauuaccacuaucuacucuguugcuuaagcaaaaaaaaucuuccuugccccauaucgaucaucugccaaguuucaucaauucuguuccuuacauagcuaucaaagucaccaucucuuucacucugcacugcuccuaguuaaggccuucaucauaaauuacccaaacuacuauauaauuuuuaaaauuuaaagugucauaauuacauuucucaaaagcagagcucuccugcuauguguggacuauuucuauaaugguuguguuucuaauuacagauaaugguuacuaaaaauggcuguuaaaaguaggaaaggauacuaggaugucauuuaucauaauaguuacuguucauuaaguguuaacugugugccagacgcugauccaaguacuugacacguaugggccucuuuacuguucacaggaacucuguggggguagacaccguuuguuaguauucuccaugugauaaagaggaaacugaaauacaaaaagaaugaaaaacuuguucgaagucuggucgcauuauuauuaaguuggggagccaggauucacaaccagccagucuagcuuuaaagccugagcuuguagucacugcucuaaugccucucaugauacuguguuuugacucauuaacugugauucuaagaucuaaacuuauagcuuagugauaaaaguuagaaaagaugaucauaaaauuauuucaucuaguuccuggauugaauuucuguuaaggcauuacaugauuuuuauuucauccaauaauuauuuauaaagaucucuaacaggccagucaguauacagaguaccagauuaaaaauaaauguagcaccaguuuuucagaaauuauuaugugucuauaauuaggguaauuacauuuagaagaucuuuuugaugaucuccuuaaagucagcaacugucuuuuucaucuuuguuuaccuaguaccuggaauggagauaggcguuuagcacuuaaauguuuacugaauauucuuaugagugccuuuuaucuuuccuacuccuuguugcauugcuuacuuauuguuuuuauuuuaguugaguuuuguaagaaauugacuuacuuuuuuuuuuuuuaaccuaggggaugucccacucuuguucaagcauugccaggcccuagcacacaagucacugcaggcagcaaccauacggcaguacuuuuaauggauggacaggucuucacauuuggaaguuuuucuguaaggaauuuuuaaaacauuaauaauauugcauuauaccauugccuuauaauuugucuauauuagcucuuuuuucuguuuccagaauauaauauaacaauuauauuauaauuguuacauaugcauauuucaugccuucauccccaacacacacuaaaccugaaugauauucuuugaaguaauuuuccucucuagcucagcauuagaauuuauugaauuuaacagcuuuguuagaauuggacauguuuauuucagauuaaagucuuuuaagcauucaauagagcuaauucugucauaggaaagguuauuucucaucuaacuuguagagaugaauuuuucuuaacacauagaacuaugcuauuuuguaaccuuuuaaaagccuaguuuuuuuuauuugauuuguuuaaaauuauacuuucuuuuuuccuuuuccacccucugagucuauccgccugucuguuacauaggcgcuugugcacauucucucccucucucugcaccaaagcuuaaagagugaaaaugcucuaagaauuuuguguaguuugggcauaguagauaucaagaaaaaucuuugcgagacugugcuaauacucuuguaccauuucagauguggauaauuacuaagaacucuugaaccuaagugucugagaugacauuuacagcuuuugauuuuuuaaaaacuguaaauguguacuuaaaauauuuuauuugaaaaugguuucaaacuuacagaaagauugcacaacuaagaacaguguguagaauaucugguuagugucuuuaaccagauucaccuauuguuaacauuuugauccagcauuugcuuuauuauugcacauguggcuguucucuuucucacacacgcaguguguguguaugcacaaauguguguguguacguauguauauaaaauauuuuuuuuucucaaauccuuugacaaugucuuguguacauuauggcccguuaccuccuacauacuuuaguuuguauuuugugaauugaccuaauaauuauuuuuuggcauuucuuuccccuccaaucuaggaucaggcauuacauuugccuguugugugucuuuagucuccuuuaaucuguaacauuucuacagcuauguauugucuauuauaacauugacauuuuugaagaguauauaguacuguuuugaaaaauagaauccucuucauuuuuguuucuuugauaauguccucauguuuagaugcagguugugcacccaggccaagauacucuguaaguuauguuguguuugcccucacugcaucacaucugaaggcucagaauguccaucugcucuucauugauuauggacauuuugaucaccugaucaaaugucugauuucuguacuguuucuccuuugaaacuauaagcaaccuguagguugacacuuuuaagaugccugcuucucaucaaaauuucccccuagauuuagcauccauugaucauucuuuccugagcuagucuuuacuauaauguuuaaaaaauggugauuuuuuucaacuccaguaggcacuuggccuuuuacucuaagcaagagcccuccuuuccuguuuacuuguuuuucuacuuauuauugguauagacucagguauuuguauuuucuucauuaucaucuuuaauuauuugggugccuagauuaucuccgauuuggccagcaguagccccuucaaguuggcuccuguauucuugugacaugccccuucauuuuuuggagugcuuccuuucuuuccagcauaacaaguuguucaggguuuaucuuguacaggcccuguaugacuguccuagaaucagccauuucuccaagaacccugauucuuuuuaguggggaauaguauuagacacuaacugggcacuagaaguguucauugcuacaggacgucuuuggaucucugguaugcauauauuuauauguccacauauauguauguauuuuagaaaucauaggccaggugugguggcucauaccuauaaucccagcacuuuggcaggccaguguaggaggaucacucaagcccaggaguuugagaccagccuggacaacauagugagaccccaucucuauuaaaaaaauuagcugggugccguggcacaugccagugguccuagcugcucaggagguugagguaggaggaucacuugagcccuggaggucgaggcuguagugagagcugugauuccaucauugcccucuggccuggacagcagagcaagauccugucucaaaaagaaagaaaaagaaccccacugugacuucuacuuccaauccauucccacaagguucuuucuuaccuguccuguucuauauuuauguacuuucuuccucaguaagaaucuuuccucucaacaauaucaauauauuuauuucucacuuaguccccagauaugucuaaaauaguuuuauauuugcuuugccuguacaaguucaaaaaaacaaacucacugaaaggucauucuugcucuuuccccucccaccugcuccccaccccaagucugaagguguauagucaagcacuguccaugaguggccuggauucucucucucacuccuuucaguggaaauugugauuccuuuggaauagaguggggcucauuuguuucaguuuaagauuccccucacccuauccuuugauuaaguuuuauuucauuuuuaaaauauauagaacauuuacauguugcuaaaaauuaaguuauacaaaaauuguauacucaagaggugucacuuccucccauauccuugacauuccugccuccccacaccuuucauuccauacuuggagguaaugaaugucauuguuuuacaguuuauucuucuuguguuucuucuugugaagauauauaagcaugcagacacacuauuuuauauauauauaccuauauauguauguauguguauacacaguuaugcacuguauaacaguauuuuggucagugauggacugcguaugcuaagguguucccauaagauuauaauaaguacuuugacuauaacuuuucuauguuuacaugcagaaauacuuacuaauggguuacaguugccuacaguauucaguacaccagcaugcuguacagguugguagccuaggagcaauaggcuacaccauaucaccuaaguauguaguagauauaccgucuagguuuguauaaguccacucugauguucgcagcaucacagaaucaccuaaugacacauauuucagaacauaucccugucauuaagugacaugugacuguacauaaauauauauauuuccccuuucccguuuuuuaaagguaauagccuauauaugcucuuuugcacuuugcucuuuucgcuucagcaucucuccuagaaaucacuccauaucaauucauaaagcucuucauuuuuuuuuuuaccuccauguaauaccccauuguguguauauaugauaguuuauucauucaguuucucauguuuauauauuuacgugguuuccaauacuuuguaaugguaguagugaauauuguuagagguguaucuuugagauaaauuccuagaagugagauuacuguguugaagguuaaugccuauguaguuuugugagauauuaacaauucuccuguauuuugcuuucacacuaacgguguaugagauugccuguuuccacagaauugccaacagaauguguugugguaccuuuaauuugugccagucugaugggugaggaaugguccugcuuacuuccaaguuccuuugccuuuaguuggugcucugauccucaaaguucggauccauauuuaguauuuuggcauugaagguuaacuuucuuuuugggggcauguguuucccugugcuuuuucuaacuucuucacacgccucuguccuccuucuuaagaacuucccuguucgugcuuugcacaugcucagguuugcaguagccgguggguggagagaacucuuggaauuuggcucuucugcuuacaggaaacauagagaucaugacacccgcugucuccuuccacugcugaagguuugagucacauauagauuuguuugcacagcauauuuuugugucuuuugaggugguuaugugagugauaagauuugacgucagacagucauuguccuccagucccagcaguccuaguugugaacuuuuaugaauuuaaauguggcuuauuuauaaccacauucugguccuuaugggguuguccagguaucuaacacauuuuuggacugcuuuucuucauauuaguugguaguaagggaauacauauuuauuucaauagucaaugaaaaagauaacuaauuuauuuuuccuccaaaagcagaauauaucccugaauaugauauauuuugcucacuauuuacuuuuuuuuuucuuuuugagacagagccucacucugucauccaggcuagaauguaguggcaugaugaucucagcucacugaaaccuccggcucccagauucaagcaauucuuaugccucagccuccugaguagcugggauuacaggcccaugccaccacacccagcuaauuuucguauuuuuaguagagacgagguuucaccauguuggccaggcuggucucaaacaccugaccucaggugauccucccaucucggccucccaaagugcugggauuacaggcgugagcuacugcaccuggccccuguuuacauuuuugugcucucuuauuuuugucaaaaaauaaggacagaucuuaaaagaguaugagaaauaaauguugaguguuuuggcugcuucucuaaucaugugcuugccauguuuccuucccugguucuguccagggauugaagcucaguugcuuccacaguuaguuuguggcuguguuuucuugcugugcuaccuggugguuggaugagaacgugaccagaguguucgcagugcuccaggcucccuuguuccagaaugcugugaggggagagaggucccgagccagggguggaagaauaucuauugagucaaugucagcauucuuuuauucuuuuucagcuacaggcuuacuagugagaaacuuccuauuacuuuuuaaauuaaacucuuaccugaccaggucccuauagagagccauacuuuuaaacugguuaauaguuauuuacuuaaaauaucauaucuuaccauugauugugcuguuuauuuuaaaacauaaaugaaauaauuuagggacauaucaugugaaaacaacauuacauauuuuucuaauuguauucacaguuucaguauuuauuuuggucuuuuuacauggauauucucagauuauaugaguucaauagugacuuucuuuuauacuaucaacuuacuaugucaaagugacuuuuuaaaugaacaauuuggaauacuaauauuuuaacauauuguguguauuugucguacuuuucauuuaaauguaggugaagacaaaguauuuuggagauacuucuugcguggaaaauauuucaaacuuuuuuuuaaaaaauaaugcacuuuuuaagacuuuccaggaauaauagaaauuauuuuauuacuuuauaaauauuugguccaaauucuuacauauuguauuuauuuuaaaaacccaaacuaacaauuggugaaaaauaagguuucauagauugauuuuuaucuacugccuccuuaacuuuaugaaaauuagauuguuuacacagcaauauugcuaauaugguuuauuuaaucuuuuagaaaggacaacugggcagaccaauuuuggaugugccauauuggaaugcaaagccagcucccaugccuaacauuggaucaaaauauggaagaaaagcuacuuggauaggugcaaguggggaccaaacuuuuuuacgaauugaugaagcacuuauuaauucucauguacuugcuacaucagaaauuuuugccaguaaacacauaauagguaauaccagaaauaaacaaaugccccuuccaaacucuugucuugauugauaguaaaugguuuaucuuucccuuuaaugaaauguacuuuuguagcuuuuuguuuucuuucugcucaaagaaauuuaaacaaagccuguaaaugucuccguuuauaugugucucuaugcugaaagaauggaauaauugggagaucuggaaaccacaguauuugugagcuagacagugguagaacuauaaacuaaauucuaguaggauaaaauccauauuagaguaagagaguuuuaugcauuguuuauugcuaaauaaauguuagaaauuaauuuuuaugggagguuauauaaauccaacuuugaaauuucacgaagaccaaguuaucaaucuguacuguguccaugauacugugaauaauuauauaauagagugguauagcaagagauuaggagcauguguuguggauuuagacaucuugagguuuuauuccuaauucucccacuuaaagauuuuuuaauuacuuagccucuuuuauucucugcuuauucaccugagaaauggagauaauacuacuuuauggguuuuggagaauuuaaaaggguaauauauauuaaaauuauauauaaauauuuuuuucuuaaggcuugguaccugcuucuauaucagaaccuccuccauuuaaaugccuucugauaaauaaaguggaugggaguuguaaaacuuuuaaugacucagaacaagaggaucugcaaggauuuggugugugucuugauccuguauaugauguaauuuggagguaagcaucucaguuuauaaaauagucaauaaguuuugaugcaguuauacucuuaugguaauauaaacuuuauuuacagguggacuuuucacaugugaguacucuccuguuuaucuaauaacugcaauucugucucagugauucacagggaccuuuauacuguagcauagugguuaagagcaugcauuuuaagcaacacuaccuagguuuaucccagcuccacaacuugcuuucugugucacccuggagaaguuacuuugacugugugccucaguuuucucauuuaugaaauggggaugcuaauacuacagaggugcauacuaggugccauauaaguguuugcuauuaucauuauaauuauuaauuuuacuguugagaguucuguuguuauuuuuagucugucaucaauccuguuuauauuguauagaauucauucuauuuuuuguucucauaauuauuauuaacuaugaggaggaaauuaugccaaagacaauaaagaauaaagaagauaauugagcuugcccuuuaagaaugugcauuaaaaaauacucuuacugguagagaaauauacaggauuauaugcauucuggaaauuauaaaaacauagagauaaauaaggcacaaaagagacucaagaaauuauguugcauuuguuugaaauuuauuguggugcugggccgggugcgguggcucacgccuguaaucccagcacuuugggaggccaaggcgggcagaucacgaggucaggagaucgagaccauccuggcuaacacagugaaacccugucucuacuaaaaauacgaaaaauuagccgggcgugguggcgggcaccuguaaucccagcuacucgggaggcugaggcaggagaauggcgugaaccugggaggcggaauuugcagugagccgagaucgcaccacugcacuccagccugggcgagacucugucucaaaaaaaaaaaaaaagaaaaaaaaauuauuguggugcuuuauauacaaaaugaauaaauaaguuacccuucuuaguguuucuagcuuuggauacuaauaggagguguacccugccaucaccacaguggcucaucacagggcugagcacuucuuuccuuuugcggccggccuuaguaggcaagauuccaguaaguugaaagguugaaguagugugagugaggagacuuuuucucugucuuccuucuucuacccaugccugcuugcauucucaucagacagccaaguucuaagaggccaugugguagcaaugggauagaugaucucaaaugucuugccaacuccuugguaauuuucuuccguguuccaaaauagagauuaauaacgaggcuugcauucagagugaagagacugcugcacuucccagguugcuggccagcuuccucucuuauuugggcauuuuaugagaaggcguaguggccaguauugaguugaguacaucucaaaucaauuacaucucccuggcagcauugugcaggguagaugaaauaacaagagacuaugggugaguggucuuuugugaucauucuuaugaagacaugagguauuaagaaccaaaguuagaauggucacagugggauagaauggaggggauagagaggagaaaagauguaaagauagaauuggcugcaguuacuuaccgauuagaagucaauguucaagagacuuaguuaccaaagagcaggcucugguuuggacuuagguguaaauugauguuuuacuguuuuguaguucuuacauguuuuauuuuuaaaugaaguaaauuugcauuagcaaaacaaaaauaaaaauuggcaguguggaaucuguuucuggaugcauucacuaaguuagcaauaacaguauaacuaagcguaacaguaaaaacuuacuugaacuagaaccauuuccguggggucuuaacagaacucucaaguaugauguucagcugguugaaccuugucuuuuccauuuaugguaguagcaaugggacagaugaucucaaaugcccugccagcuccuugaucaauuucuccauuguuggaaaacagagauuaagagauguuuugguaaaacagcugagagguauuuuucuuuaaaucaggaucagaauuucuguuauccugacuucuggcugcuuugugucuuuuguguuuuucaauggggcacuuaaauuuuauaauuaucauaugcauugcacauccaauauuagcuuacuuugacuuuccuucuggccugcaucugcuucauuuuauauucuuuaggagccaacuuugccugaguaauuagaaacaacaucuauaaagagcagauaaauguuaagaacaccuguuuuauuucccacauacaaauuuacacaaauaauaugugaauuuguguuauuuuuuaaaaaacaaagcaaaaauacauacaggaaaaaggauggucauacucuguaucuguuucuuuucccauaccgaauuccacuagccuucucuguggaucacaaguaugaaguuugauuuauaucaucugacaccuuuuaaaaugcauguauuuuucuuuuuauguaaauaaaaacauaccuacucuaaaaguuagauuuuuugcucaaaaauaauuuagagaucuuuccaagucaguauuuaaagaacagcuucauuauuaaaauuguggaauucuguagucuggguauaccaaauauacuuaacuguuugcccaucagugaacauuuuagauuuuuuuuaauauuacgauacuaccuacaaugcuacagugaacaaauacacagguaucuacacacagaguuuuacacacauguggaaguauuucugcaagcuagcuuuuaaaauguagaauugcugaguuaaaagauaggcucacagaauuguaaaaugacugagguaagucugaaucacuuuagaaguuuauuuuuccaagguugaggagaugccugggaagaaaagacaagccacagcaggaucugugcccuguacuuuuucugaagagguuugaggccuucagcauuuaaagaggaaaagagagcaggaggagaaaaggaaaagaaaaaaugagaggauguggucacauucuuguaagguuuugauuaggcuuacugaauccacauguugcacaugaaaaggaagggguagagggaacagugaauuuuguauuuggaguuaaaguaaacauagaguagaggaagcagucaaauacucauucaucuggggcuggggcggguggggcuugguggggggaugggcagauaauuucuaguaucuucuugucucuuaccaugaauuuuccagaaccaaaaagagauuugaauccauggauauuagaaacuauguguuucuauuauuuaccaucaagagaguuagugaaacuguugaacacuaaagaccaaggggaaaucuuaaaagcaaccagagagaaaagaaugauuaccuaaacaaugagaucaacagaacuucccaaaagcaauaaugcaauaauauuaaugcuacuaguuauagaagcuaccauaauauauuuucucccaaaugcuauuuuaagugcuuuuuaaaaauaauuuaaaauuuuuuaauugugguaaaaaaacaguauaaaauuuaccaucuuaaucauuuugaaagucugcagucagugguguuuaguguauuuauguuauugugaaauagaucaucagaacuuuuuuuucuuggaaaacugagacucuauaguuauuaaacaauagcuugcaucccucacuucccgaccccuaaaagagguaaagaaguggagauaguuuuuugaaguuuuuguuacaaaagagaucagagaaaugggaugaugaagacguuguggguuccuaauaguuuuuaauugguuuuuacuguuuauucauaugguugaacauccacauccauucuaucugugcuuccuuucuauggauagcauuccauguccuugccaauuuuugcuauggauugauuguuucuagcucuuauacauugaggauauuguagcugugucucacagguacacuucacauuuuucuucaacuuguccuuugucuuuaaacuuuuuuaaugggguauuuguugaguuucauauuuauauguauguaucaaaacuuuauacagucaaguauuauaaucuacauuacuauuuucuguauuaaguauuauaaucuacguuacuauuuucaaauuauuucacuuuuagugauauaguuuuuuuauauguuuagcuuagauccagaagauaaugagcuacauuuguccucuuuaagcugacuauauuauuuauucucuuuguaucaucaguuauguuuuaggaauuuuuuuuaaaaacaaaaccacauugaggugcuguaauuauucuuuuucuuuaaagguuucgaccaaauacuagagagcugugguguuacaaugcggugguugcugaugccaggcuucccucugcagcagacaugcaguccagauguaguauccuaaguccugaacuugccuuaccaacaggaucaagggcccucacuacccgaucucaugcagcuuugcacauuuuagguaggguugcgauuugauguaccauuaauucacauuaaugugugcuguccaggguuuuuuuuuagaguauuuaaauuuauauguaauucugucuuguuuguuaaauaauaauaauguacaaaauaaguuaaauccucuaagaggcuaauuccacagaaaacaauacaugagaccuguacuaacacuaucaaagauuuauguaugcccaauuauuuaauuuucacagagguagacccuuaaaaauaauguuuuugcucaacuugaauguauaaacuuuuaaagauaugauaaaauuuucaaguauauaauauuuaauuuauguauauuauguuaaauaaauucuauaaaauguaaugaauuuuauauacaucuucuguuucuucuuauauaacacaguuuuccacagcauaucaacuucauucuuauuuaauuacuuugagauguaguacuuauuuaauuacuuugagauguagugcaauauauuauuuuguaacuggaaauuuuauaucacucuauguaacuauguauuuuguugcuuuuaaaaaugauccuuaaaaagacucauuuucagacucuagcacuugcaggugugaaaucauauuccuaaauauaauuaccauaucauaaauauaacucuuuguuucuuuuuucucaaauuucauuuugguuucuauuguagacauccaaaacuaguguugauuaaguuugugugacacuaaugugucuuccucaaauagcacuuuaagaaucaaacuaauuuggaguuucauaaaaggaagaaccuuguaagaauucaaagguuaagugauuucaacuuuucagagauccaguuuuguguaaaagguugucguauggcaaguuuaaauaugaucauuaaucagacaagggauaauuuguauugguuuuaagcauucuuccaugaaaugauguuuaaagcuuggaguaacauucugaguuuauuuauuuuaauuuauccccuauagcauuuaaugucaucaauaccauaggacauuuuaauuucaaggaguuaaauuuuguuucuuuguuguuuuagguugucuugauaccuuggcagcuaugcaggacuuaaaaauggguguugcaaguacagaggaagagacucaagcaguaaugaagguuuauucuaaagaagauuauagugugguaaacagguuugaaaguauguauacuucgguuuaggaaauguugucuuacaacugaaauauauauggaucuuuuaaaacauagauuaugauuuauauauucuaggucauggaggaggcugggguuauucugcccauucaguagaagcuauacguuucagugccgacacugauauuuuacuugguggucuuggucuguuuggagguagaggagaauauacugcuaaaauuaagguaaaguucaucaacaauguuguccuuuuuuguuugaacauacugauuuugacuuaauuuauuauuuuauuauuuaaugucuaauuuuuuuccuuuuuaacuggguuuauuuuguuuuuaaugcuucuuuuuaaaaagcgauagagaaaacauugcuaaaaucgaauacaguaauacuaaauuuuuuaaauuuauuuauuuauuauuauuauacuuuaaguuuuaggguacaugugcacaaugugcagguuaguuacauauguauacaugugccaugcugaugcgcugcacccacgaacuugucaucuagcauuagguauaucucccaaugcuaucccuccccccuccccccaccccacaacagucuccagagugugauguuccccuuccuguguccauguguucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuucaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugauggugagcauuuuuucaaguguuuuuuggcugcauaaaugucuucuuuugagaagugucuguucauguccuucacccacuuuuugaugggguuguuuguuuuuuuucuuguaaauugguuugaguucauuguagauucuggauauuagcccuuugucagaugaguagguugcaaaaauuuucucccauuuuguagguugccuguucacucugaugguaguuucuuuugcugugcagaagcucuuuaguuuaauuagaucccauuugucaauuuugucuuuuguugccauugcuuuugguguuuuagacaagaaguccuugcccaugccuauguccugaaugguaaugccuagguuuucuucuaggguuuuuaugguuuuaggucuaacguuuaagucuuuaauccaucuugaauugauuuuuguguaagguguaaggaagggauccaguuucagcuuucuacauauggcuagccaguuuucccagcaccauuuauuaaauagggaauccuuuccccauuucuuguuuuucucagguuugucaaagaucagauaguuguagauauguggcauuauuucugagggcucuguuccguuccauugaucuauaucucuguuuugguaccaauaccaugcuguuuugguuacuguagccuuguaguauaguuugaagucagguagugugaugccuccagcuuuguucuuuuggcuuaggauugacuuggucuugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcaugggauguucuuccauuuguuuguauccucuuuuauuuccuugagcagugguuuguaguucuccuugaagagguccuucccaucccuuguaaguuggauuccuagguauuuuauuuucuuugaagcaauugugaaugggaguucacucaugauuuggcucucuguuugucuguuguugguguauaagaaugcuuaugauuuuuguacauugauuuuguauccugagacuuugcugaaguuguuuaucagcuuaaggagguuuugggcugagaugaugggguuuucuagauauacaaucaugucgucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauacuggcuguggguuugucauagauagcucuuauuauuuugaaauaugucccaugaauaccuaauuuauugagaguuuuuagcaugaaggguuguugaauuuugucaaaggccuuuucugcaucuguugagauaauccugugguuuuugucuuugguucuguuuauaugcuggauuacauuuauugauuugcauauauugaaccauccuugcaucccagggaugaagcccacuugaucaugguggauaagcuuuuugaugugcugcuggauucguuuugccaguauuuuauugaggauuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaucucugguagaauucggcugugaauccaucugguccuggacucuuuuugguugguaagcuguugauuauugccacaauuucagauccuguuauuggucuauucagagauucaacuucuuccugguuuagucuugggagaguguauguguccaggaaucccuuauccauuucuucuagauuuucuaguuuauuugcguagaggauuuuguaguauucucugaugguaguuuguauuucugugggaucggugaugauauccccuuuaucauuuuuuauugcgucuauuugauucuucucucuuuuuuucuuuauuagucuuguuagcggucuaucaauuuuguugauccuuucaaaaaaccagcuccuggauucauuaauuuuuugaaggguuuuuugugucucuauuuccuucaguucucugauuuuaguuauuucuugccuucugcuagcuuuugaauguguuugcucuugcuuuucuaguuccuuuaauuaugauguuagggugucaauuuuggaucuuuccugcuuccucuugugggcauuuagugcuauaaauuucccucuacacacugcuuugaaugugucccagagauucugguauguugcgucuuuguucucguugguuucaaagaacaucuuuauuucugccuucauuucauuguguacccaguagucauucaggagcagguuguucaguuuccauguaguugagugguuuugagugagauucuuaauccugaguucuaguuugauugcacuguggucugagagacaguuuguuauaauuucuguucuuuuacauuugcugaggagagcuuuacuuccaaguauguggucaauuuuggaauaggugugguguggugcugaaaaaaauguauauucuguugauuugggguggagaguucuguagaugucuauuagguccgcuuggugcagagcugaguucaauuccuggauauccuuguugacuuucugucuuguugaucugucugauguugacagugggguguuaaagucucccuuuauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuauaugcgucucugcacgugagauggguuuccugaacacagcacacugaugggucuugacucuuuacccaaugugccagucugugucuuuuaauuggagcauuuaguccauuuacauuuaaaguuaauauuguuaugugugaauuugguccugucauuaugauguuagcugguuauuuugcucguuaauugaugcaguuucuuccuagucucgauggucuuuacauuuuggcaugauuuugcaguggcugguaccgguuguuccuuuccauguuuagcacuuccuucaggagcucuuuuaggucaggccugguggugacaaaaucucucagcauuugcuugucuguaaaguauuuuauuucuccuucacuuaugaagcuuaguuuggcuggauaugaaauucuggguuggaaauucuuuucuuaaagaauguugaauauuggcccccacucucuucuggcuuguagaguuucugcugagagauccgcuguuagucugaugggcuucccuuugaggguaacccgaccuuucucucuggcugcccuuaacauuuuuuccuucauuucaacuuugguaaaucugacaauuaugugccuuggaguugcucuucucaaggaguaucuuuguggcguucucuguauuuccugaaucugaauguuggccugccuugcuagauuggggaaguucuccuggauaauauccugcagaguguuuuccaacuugguuccauucuccccaucacuuucagguacaccaaucagacguagauuuggucuuuucacauagucccauauuucuuggaggcuuuguucguuucuuuuuauucuuuuuucucuaaacuucccuucucgcuucacuucauuuauuucaucuuccaucgcugauacccuuucuuccaguugaucucaucggcuccugaggcuucugcauucuucacguaguucucgagccuugguuuucaucuccaucagcuccuuuaagcacuucucuguauugguuauucuaguuauacauucuucuaaauuuuuuucaaaguuuucaacuucuuugccuuugguuugaauguccucccguagcucagaguaauuugaucaucugaagccuucuucucucagcucgucaaagucauucuccauccagcuuuguuccguugcuggugaggaacuguguuucuuuggaggaggagaguugcucugcuuuuuagaguuuccaguuuuucugcucuguuuuuuccccaucuuugugguuuuaucgacuuuuggucuuugaugauggugauguacagauggguuuuugguguggauguccuuucuguuuguuaguuuuccuuuuaacagacaggacccucagcugcaggucuguuggaguaccaggcagugugaggugucagucugccccugcuguggggugccucccaguuaggcugcuggagggucaggggucagggacccacuugaggaggcagucugcccuuucucagaucuccagcugugugcugggagaaccacugcucucuucaaagcugucagacagggacauuuaagucugcagagguuacugcugucuuuuuguuugucugugcccugcccccagagguggagccuacagaggcaggcaggccuccuugagcuguggugggcuccacccaguuggagcuucuuggcugcuuuguuuaccuaagcaagccugggcaauggcgggcgccccucccccagccucgcugccgccuugcaguuugaucucagacugcugugcuagcaaucagcgagacuccaugagcguaggacccuccgagucaggugcaggauauaaucuccuggugugccguuuuuuaagcccgucagaaaagugcaguauucaggugggagugacccgauuuuccaggugccgucugucaccccuuucuuugacuaggaaagggaacucccugaccccuugcgcuucccgagugaggcaaugccucgcccugcuucagcucgcgcauggugcgcacacccacuguccugcucccacugucuggcacucccuagugagaugaacccgguaccucagauggaaaugcagaaaucacccgucuucuguguugcucacgcugggagcuguagaccggagcuguuccuauucagccaucuugccuccucccccccuacaguaauacuaaauuaauaacucauuaaaaaaaucaaaauucuguaagaagggaagaaaugaaaggaaaauuauuuucaacaauuuaccacugaagaaagacuauaucucaguccuuucuguggaacuucugguggccuagcaauaccagugccuuuuuauguggcuacuuucuuauagccauuuuaaugacagaggaggcacaacuguuuagggacauuuugauguaguauguaaacagacaucuucaccccaggaguggagaccgggaggagugagagauaguguuaggggaggauuccaucugguaggccaacuaaaaaucauugagagucauauguuaccacaccuauucguauccaaaagggccaacaaauuauccuaaacaaaguauauguucauucuuugaauauucacuaauagcuugaauguucugcuucucaaauuaccugauuuugcucuaaaagugaaagagaaaacuauaguuucugccugaauuucaauagcaggcuucacaaaaaaaucucgauuaaaugucaucuguucaggagguauuuucuuaguucucucaauaauaucuaaaaaugauaucaauauguuaacacucuucuucauaaugcugguuuccaaggacauuccccauggaggcccaaccagaacugacaaacuuaaagaaauauuugcuuauuucugguuauaguuggaauacaugcuaaaaaagcagauaauguaagaaugaauaaaguaaaaauuuaaagcuccuauaguuauauggaguauagugauagaauaaugauuaggacucuuguagcacauauauuuugauaauaagaaaaauaguaguuuggcucauuucagugcaacugcuuuaaaaugguuauuuuaggaugucuugauucauccucacguuagagaagcaaccucaauguguuauguaguucuauuugacaaugucuaauaagcucaucaggaggauauuuuuuuuucuagcucuaagagauuuuuucuuuucggaauagugaacaacguaguggaccuuaucuucaaacacuguaguauauagaauuauggaggccuuccauauauguuguuuuuauauuggcccuauuuuucuuuuucaaacucaaauuuuaccucacuccuccuauugucuggaaaugaucuugccuuuuguauucaauuauccagugagugggcuaaggccuuucaacaguagucagucuuuuuuuuuccuucccuucaccucucuguaauguaugcauuuguuaagcccuucuguauuuuuuuguuuuguuuuguuuucauaccuguaguuuuuucuucuaucucuuuguagguucauccccuuccaccuggccacugaauguaggaguuccucaaagacccagcccuaggcccucuuucuucacauauucguauaugcauucucuuuugagcccagaguuuuaauagccaucagcauaccauaauccccaaauuuguaucuccaacucagacuucuuugaugcauuuucauguaaauauguuaaaggcacaucaguuaucagucauaauaucucaacugaauucaugcucuuccacugaucucucucucucaugauuaguaccauccaccauaugcuugauacauaggccggaaaucuagacauuuuucuugauaggccuccuauaucucuuucuucuccacaaaaaagacuuuucuaccacuacccuaggcaaagguauuugucuuggacuagccaccuagauagucucuguacauauucuuucuauacuuucugucuccauucucucucuuaccauuccuacuugagccuacuccagucagauuuuugcccccaccacugacauugcucuugucaaggacacugaugacuuucauauugcuaaauucaauagucaagccucagcucucaucuuccuuaaccagucagcugaauuuaacccaauugagcucuucuuugaaauacuuucuucucuugucccccacgacacuacacuucauuuuucuuuugucccacugacuguucuucuuagucuccugcugguugcucaucaucuuccugacuucuaaauguuggagugccaagaacucaguuuuugacaucuuuuaaaaguauucucuuccucauagugguccagccucauggacauuuaucucugaugacuuuuaaauuuauaaaccucuucucugaccuuuaaaccaauauguacaacagccuacgcugugucuccacgugacucucugauaggcauuuuggagguaacauauucaauacuaugcuucugaugaucugccuaaaccugcuauccucauguucuuccccaucccaguuaacugacucagcauggaguuaacuucauucuucuguuuccucaggccaaaaaucuuggagucauccuugauucuacucuuucuuuuacacacauccacuucgggagcaaauauuaucguuuccacuuucaaaauaaaucccguaucuaaccacuucugaaaacugccacugcuaucagguugggucaugccacagccauucucauuuguauuauuacaguagccucccaacuuguguucuacgucuguccucaccccauuuguucuguucugaguguggcagugauucucuuaaaauguacaacagauugcaucauugucucuucagaauccuguagugucuuccuaugugagaaugagaaccaaaagccuuagaaggaccuacaaaguccccaucagaacuggcugucaucaccucucugaccuuuuguucuacuaguuguuucacucuaauccagugacacuggccugcuuauuguuccucagacauuccaggcacagucaaaucucaguaccucuucacuugcuguuuccucauaacuacagcucucuucacuucagcaccuacauagcccacuuccccaucaccuucagagcuucauucccugguaagccuacuuaaaacuguaaauucaauucccaaccauagacuuacucccaauagcccccaauucuuugauuguauuguuugccccuuuaugcccaauuucuagaacugugcuuggcauacaguauguguucaaaaauauugguugaauguaaauacaggagucagauuggggacaaauuauuaagaaccuucauaucaugcuguggaggagaugagaaaccaaggaauaauuuuagauuaagaaaguauucugauaagauauuuuuauaaggguacuaagggucaugaaacaaauacaaaaauccucaacuuuguggaauauggguuagaagaaggagagaauggagauaagacuaauuaguuguugaaauauuccagccagcaauagggaauaugguugaauugacaagcuuugguaccaguaagagaauagauacaguaauggcagagaaauauggaaaaaugauuauuucggacuauuuuuuuuuaagagucucuuugguagcccacacuggagugcagugaugccaucuuggcucucugcagccucugccuccuggguucaagcaauucuucugccucagcuucccgaguagcugggacuacaggcaugugccaccacgcccagcuaauuuuuguauuuuuaguagagacgggguuucaccauguugaccaggcuggugucaaacucgugaccucauaugaucugccugccucagccucccaaagugcuaggauuacaggugugagccaccaggccuggccuauuucagacuuuuuaucuaagagauuaggugaaugaaagaccauuaaccagaacagagaaggcaggaagaagguauagaacuaguaggacaaagggaauccaaugacuguugagaauaagagcugagcuggagaaagauuucuaagucauuagcauauaauuuaaaaauuuagacaccuagcacaguacuuguccaguaaauuuuaaugcauuuuaaucuuuaucugccucucuugcaauucaccuuccauaauuauccagaggaaaaagguuuucuuaaaaaaaaaaaggacauuuuuuaaaaagaccucuucuucauaauucuuauuuucacuuaauuucauaaccuuuuuguauuggauaucuuuucuguuuuuuucuuacccagaggaucuuccccucuuuuuuaagagccauuuguuucaugcuuuucaucuaucuuuuucucaugccauauuacuuugaacuauauuuuguuaccuauuguuuuuaaggauucuuauguugcucuucucucucuguagcuaauauuucucuacccuuuuuuauuguuuguuuuuuuaagaauucuacaguauucacuuacuuuuuaaaaguacugugagaugggaacuguuaguauccacccaccuuuuauggaugaggaaacuaggucccaggaucucaguuaguaagugaugaagcaacauucuaccucauuuagaaugagguagaaucucacuuagugagagacucacuuaguuaaaauuuuuuguuggaguucucucaccuuuuucagaugcacauauuagguacaaaacuuguauagaacuauuuagagcauuugauguaaauagaugaauauauaaauuaggaaaacagagauuaauguagaccauaaaaccuuguuuccuaauuuaaauacauauguuuguguauuucacauaguaauguuaaaaaagcagguacucugauuuuuuacauuugguaugguccagcauacauucaucaugcacaaaauuaugaacacauuguucaucagauauguauagcugauuuauauaaaugauugucuuucuccuuuccuuagcuguuugaauuggguccugauggaggagaucaugaaacugauggugaccuucuugcagagacugauguauuggcuuaugacugugcugcuagguaaauaauuugugcauuauucauuguaacucuugcauacuuaauauuaaaaauuuauuauaaaugaauaaacauacuuuaaaaggaaguuuuaaaucugcuaugaauaucaaauacuugagaaauuaaauuauauauuaagcaauauaaguauugcuuucaaaaaugcugaauuaaaacuaauauacuucauaaauuuauuucauaagucaacuguuucaauauugaagauaaaaauggaaauaugcauauauuuuauacaccuuuacuuucaugcaucucuuacggaauaccuaguuugcugguguucuaguaauaauacaguuauuuauuacuccuagcauuacagguaauaaauaauuagcgucaaguggucauguuugaccauaauucagauuacccauguacucugacaucaugcugcuagaauauauuugauaauaacacacuuggggaggugacuagcuuuacugaaaccuuuugggaguuuauaaaaauuaguauguuuauuuaugaagguucauuaaguaagaggauacuuacacuuuaucaguccucucuacguaauccuaagaauuaucucaauauuguguuaugaucaguguucccugguuugaagcagggaauauuauuauaagaaaaauuauaaacugagcuucauaguaguaauagugugcuauguuucccaacaauaacuauguuaggaaaaccuuguagguuuucuugcuagugaaaauguauauuuucagaaacaaggaugaucguaagauacugacuuugcuuguacaagauauaaauacuuuugaaaacaaaagaguaaaucuaaagaaaauuuugacuauuucuuaggcauuaacuaauaucgcaagauuuuuuuaguaaccuuuaguguuuuauacaaaugaauauuagggaaaauuuuaagaaagcuaauugauuaauuuucagcaaagccuuaaggugccauugucauuugccguauuuauuuauuucuuuauuuauucauuuauuaauuuuuauuuuugagacagagucucacuccaucaccuaggcuggagugcaguggugugaucucaacucacugcaaccucugccucccggauuuaagcgauucucaugccucagccuccugaguaguugggacuacagucgcaugccaccaggcccggcuaauguuuguauuuuuaguagagaugggguuuuaccaugcugaccaggcuggccuugaacuccugaccucaagugauccuccugccuuggccucugaaagugcugggauuacaggaaugagccacugugccuggcugccauuuguuuuugaccauaugaguuugagucgaaaauauaaagcacaguuucauuuauagagaaucgucuaggauuucuucauuagcuuauauacaaagcccagacuccuaaggcauugggagcauugaaggauuuccauaacauccagcaucuuuuuugacuuucuaccacuacucuucuacagcugucuuaaugcauuaaugaaauuaauaaugaacaccuugucauuuccugaccucuuuuguacuuccauaccucuacagauuuuuucaugacauucuccugcuucuuuaaaugcccuuuauucuucuuucaauuccagcuacaaccaauaaacauuccuuccacucuguuaccuaguacuuuguaacuuguuuauauccuuuagaagaugcccuuauuuauugucuuuuuucuucuucuaaauuaauaauguuuguauagauauuaugugacagacuccaaacaccuaucugacuuaauucauucuaaaggacaacucuaugagcaggauauuauuuucaccacaguuuucaggugaagaagcuaagguacugagaggauagaguaacuugcccugcguugcccugcuagcaggucacagagcugggccuugaacccaggcugccugacuccagggccauuuucuuaauaugcugccuuucaaaacuauuuagcugaaugaaugagcuuuaaaacuaaaguucagauuuuuauuuuccagcaaaauuugaauguuuuuuaauaucaguuuaaaacauucuaauuuuaauaugaaaguuuuauaacauuuaaggauauuguagaauucaagaagaggaggaagaaauguaauucuaucaccauaacauaaauaacuauauuugcuugcauucuuguccagacuucuuagaguguuuuuaauguuguuugauaagaauuuuauaauacaguuaguuucauguuuuuguucacaagggauuuugaaaaaauaaauauaugugacagagaaguaagaaaauauuguuuuugacucacuaauuuuuucucagagaaaaauaugcaaugauguuugaugagccuguucuccugcaagcuggguggugguauguggcaugggcccgagugucaggacccagcagugacuguggaucucauggacaggcaucuauuaccacagaugauggguaaguaaaugcccaaguguuacuuaagcaauacuuauuuuuguuagaggaauauuguuuugaaaauucagaguacuuucagcaggauucaaaagcuuaggaagacuagagcauaauauaacugcuaaaaauuaaauucauguaaccucaugccaaauugaggucuagacagaacaaggagauaauaagaccacuguacuuugcuccugucagaugguauuuguauauauuucuggguauuacauuguuuacgagcuugauuaccaaauuagaaauuauauagaggaaggugacaaggaaaaugaggaguuuggaaccauaaaaaagaaguagauaugugauauuaaauuugauagugcaugagaaaacaguuuaaaauuucaaagcuucagcaauguguguuauuuuaauaaaauauagggaaaauuuugcuguuuuaaaauaacuuucacguauagaguacuuuucaguucauauucuuauauuuuaucugauuugaugcccucaauagcuuugugaagcaguuauuagccccauuuuauacuccagggacuagagaaauaaaaaggugaaauuauuugcuauuuccugagagucaugugguuaaaaccaaggucagaccuguaaccuguugacucuaaauccaacauuucaauauucuauuacuaugauuuauguauucuaaaggacuaucauuuguaagauaaauucaguuuauucuugauuacuccugagcauaaacuauuugaaaucaguugaaguuauauaacaguauauauuccagugcaggucaauucauaacaaagcugaccaaaaaaagaaauagacuuauuugugaggugaauuuccuguugcugaauauucaaggagacuacuguagaaaaaucacaucuguuguuaugugcaucaacuuaagaaugucuuuagaacuaagugacuacuuugacccuggacuguaugauuuucauagacaguucauucagacuuggaaugucauggcacacugaggcuaaagcuuaucaugcagcuagucaagcagauauuauacuacuuaguuguaaguagaaauuuuagaaguuuacugcugugguuaaagcugaguuggagagcuaggagggacaggacagcuacucauuuaggaguccuaaucacguucaguucuuucauuuuacugacuaacccauucagagcuagaaugaaaaucuagaaaauaccuuuuugcuuuucuuuauguaaaagagugaaucauuuucauugacauaagauuugaaaacauguuucuuaaauuucuuauuuccuguaaugaucauguuguuuuugguaucauuguuuucucuucuuaggguuguuuuccaguucaagaguucaaagaaaucaaauaaugguacagauguuaaugcgggucagauaccucaguuauuauacagguauuuagcauauuuauacugaauuaguaugguuuauuauuuugcuauaaugaaguagaaucauuacaaaacguggcauaauagggagaaauuauuugaagcauucagcaaauuauaauaugcugguagaacuauaaauauauuuaacaaaaacaguuaauauuuuguauauuuuuaaacauuuuccauacaggcuuaacuuuaaacuuugccugauuacucagauuaucuguauuauaccaauaacaauauuuuacugacuuuaaaaaaaaucuauccauugauuuucuuacuaauuucaaauguuguaaaagaauaaaauuugucuuggagaagugagauugcagggaagauggggaggacuauagaugcaggccugguugauauauuguagucucauaagacugauaaaaugaguuggaaaauucccuacuguugguaaauuuucaccuuuagcuaaaauaccaaauaauaacuugcucauauaauauuuacuauauuuuuaacauuauugaaaaauuuuaacuuacaauaauuuaagcauguauaaaggcauaugccuguguuuaccuuauuuauuucuagacuacugcaauacuuuuagaauaaagaauucaaauggauauaaaccguuacugaaaaauguugucauucguuaagcaguaaaaaaucaaaggaaauggucuagaacugugauucuaucucccuaucuuucuuucugguaaucacuuugugguuacaaacauuauuuuuccccaaaagguuuuuucguuuguuugguuuuuaugcaccgugcaaucuguuauaguuacuguuuguaauauguagcucuacaaacauaacguguugcauuggacuacucccagguacucacugguugaauaacuuuuaaauaacagcauuaauaguagcauuacuagagaauauaaguuauauguuauauacauuauauauguucucuaagaagaggaaaaagccucuacuacucggucuugcgaagguaggauuuaaaggaagugcccauaugcuaaaaacuuuguuuagcuuggaaaaauguuucaaaaaagcccuguauuggcauuaccuggcaaaaaaauuuaaauauauaauuuauuuucccauucaaaaauguauaauauacuuuaaaaagaaaaaaugacauuggacuuucuaacauaauuuuauaugugucuacugccuuuagacuuccaaccagugauggcagugcuucaaaaggcaaacagcaaaccagugaaccuguacacauuuuaaagaggucuuuugcaagaacugucucagugguaagccauguuuuaaaaaauuucagcuuuucucuucaguccucagauacauuuugauguuuagaguuuagcugcucuuguaaguuuaucuuagccuagauuuauaaacucagauuugguuuuguauucacauuuauauucuagaccacagauaaaguauacuuuaaaucauagaaaaauggagguguuggccuaugauuuuaacaugaccagaugaauuggccuugcuguuuuugaaacaaauaacgauuugcuuuucuaguaaaucauauaugaaugcauaugcugaaugaauuagaaaaugaaggaaaaguuaaggauggugcuggcccaaaaaagcgugauuacuacuugaggaacuagguggaagaguugcauaucuaacuaggaaguuuguugaaccacuugccauccccauuguacacaugaagaagcacagugccauugagguuaacagugcagaauggaaagucaacaugauguaaauaaaugaaaguauaaauuaaggucuugaucucucauguauuaauugaggauucuuacguauguuaccuaaguaaauuacaucauagcauuuugaauuucuaaugagauaagggguguaagauguuuuuggaacuguaaggcaccaucugaaugugauuuauuaauauagcuaguagucuuucauauuaguaaaaugcauaggaagaauguuucuuucccuuuuaaauuuauuuuucaacccaccaagugaauauauauuccugguaggaaugagauaaaaguauccuaaaaguauaugaaagauuuuucucccauucucaugaucaccauauauaccuacuauuuacauuuugguguguaucuucccagaccuuuuuuuuuuuuuuuuuuuggugaggcagagucucgcucugucgcccaggcuggagugcaguggcacgaucuuggcucacugcaaccuccgcguccugaguucaagcaauucuccugccucagccuccugaguagcugggauuacaggcgccugccaccacgcccagcuaauuuuuguauuuuuaguagagaggggguuucaccauguuggugguggucucgaaccccugaccucgaacaggcuggucucgaaccccugaccucaugacccacccgccucggccucccaaagugcugggauuacaggugugagccaccgcacccggccuucccagaccauuuuuauaugcaaaaaaacuuauuaguacguaucaaauacaggaugcucuacaacaugcuugcuuguuucuuacgauacuuacaguuuucaucuuuuuuagaaaauuucguauuauauaucauggacauccuucccuggcaguacauuuggcucugucagucuucuccguuugcguaccauuauucuaauuuauucaaucugauaucuaucaaagaaccacuuugauucucauuuuuuguuauuucaucuugcuucaugagcaucuauacacauacaucuuuaaauacuuguguacuuaugugcauacuucuacuggaaauaugcccauuuaaaguuugguauauccucucaaaguugaccuuccaaaagagccauggcaguuuguagagcuugugcuuugaauaaaagacuaugagaacuuuggcuucuugguaacuuugcauccuauuagucuuaaguugaguuugguaucuuuugauucaaauaaggaucuuugacucuguuaugcuuucuuuagugaucucacuuuucugugcuugguaaccccuuuguauuuauguuuaagugguuuuguggccauuagguaauuguagacuuuauauacaaaacuuauucagucauuucuuuaaaagguaaacuauagggcuuagcacauuggcucacgccuauaaucccagcacuuuuggaggccgaggcaggaggauugcuugagcucaggaguucaagaccagccagggcaauauagugaaacccccaucuaaaaaaacuuaaaaauuagcuggguaugguggugcgcacuuguagucccagcugcuugggaggcugaggggguggugagaggauagcuugaguccaggagguugagguugcagugacccgugaucacaccauugcauuccagucugggugauagaggaagacucuaucucaaaaaaaaaaaaaaaaaaaaauugaaucuauaaacucguuuucaggagcucugggauuuggugggaauggggcaguaagugcucugcuuugagauucaggugguaucuguugucauuuaaccaugauaaaaccagaagacuagaacugcaaagaaaaucuaccaucuuaaacucauaugcuagaauuuuaaauaaucaaaauaggaauuuuuuaguauuuucuagucaauuuuuaucuucuauuaauguauuuaucaaaaauugacuguaguuuguauugcaaauuuuaauauauagacauaaaauaaguuauuugauacuguuacugauaucuaacacuaaaacucuauuuuauuuuuuacuacagugacuguaaaaagcuuuauuuuucuuucaaguaaacaugcauuguuuuauaagugcuucucauuuuucccuuguuuauaugauaagcuagauagcuggguagcaggaacacugaaaaauuuauuuuuaaauagguaaauauugaagaauguuguuuuuagaaaugcuuaacuacuuuaccuuuuuuguaacaaacuucaaaguuacuguugaggguaauuuaauaaaugaacuauaaaagugucuugggcucaguaaaaaaaauucaauuaaaaaacucaguaaaaaaauucaaaagaaaguuuugaaguugucuaccauugccuuuccauuugauuccguuuaugguaucauuugaauuaauuguugucuguuuuuucauauucuggauuaggaauguuuugagucauuguugaguauucuucacuggagcuggaccaccuuagucuuaggaguugaagaacuuagaggauuaaaaggauuccaguucacagcuacacuccuagauuuagagagacugcgcuuuguggguaccuguugucugagguuauugcgugucuauaccugugaaauuuacccagugucagguaugaugcauuuuuuuuaaaugacuauagggagaaaauauuagagacauugagaagauuuacuuugagauaacugagaguuuaugccccccagcugcauuuaagcugcuucuaaaaugaggggagaaagucagcuugcuaugaugcuuauguauuugcuuauaaagaguaaaauagauuacaugucauucugauacaaaaaguaauagugggccaaaguuaaauaaucuaauaaaguuuaauuuuaaacaaauucugucaaauagaaauauuuugaacaagcaauuuggacuuaaaugcugaaacuagguuuuuauucccccuuccauuuagauuaaaaauugggacuacacuuaaucucuaaguuguuucauuucuaagauauuaguacuugugauacuuagcuguauagggaauuacugaauuauauugauuguuuucaugcauauuuaauauuuugcuuaauuaccaaucugcuuuuucccccucaaagcuacaggaaaagcaguuguagaagaaacuagcaaauuagcagaguguauuggaaaaaccagaacuuuguuaagaaaaauuuuaucagaaggaguugaucacugcauggugaaauuggauaaugauccucaaggauaucucagucaacccuugagucuucuagaagcuguccuucaggaaugucauaauacuuucacugccugcuuucauucuuucuacccaacuccugccuuacagugggcuugccuuugugaucugcugaauuguuuggaucagguaauuuaaguuuguaaaauguuaguugaaaaucugauauauugcuuaauacucuucaagaaaauaaauugcaguugccauaucuucuuaacuuguauaaaagauaaauuaggaaaucauucgguguacaugacuuauauaagcaaaguuuaaaauuuuuuaaaucugcuucaucaucuuuuaguuacaaaauugguaggcacauugugcaguugcugauugguuuuugaauuggagugagugauucugagagagggagagaggaaaagaaccauagugaccaggggagagcagggauagcaccaggaggcccccgccacccucaucugugagaacaggaaggagagagagcugagagaacagucauacuagcauuguucauucauucaugaggaagccacaaccuuuguaaaccuuuaugcaccaagucacagaguuucacaacaccugaggcaaaacacugacagaacuacagggagaaauagauucacauugacagcuggggacuuuaacacuccucuuucaguaauuaauagaggaacuaggccaaaaacaucagcgaugcagauuugaacaguacugucaaccaucuugaucugacauuuacaaaacaggauaugaaacugcaaaauacauauucuuuucaaguacacaugauuuuuaaaagaaauauuugggaccauucacuaagguagaucauaugcuagaccauaaaaugucuuaauaaauuucaaaagauuaaaaugugaaagaauauauuuucagaccacaguagaauuacaguaaaaaucaauagcaaaggauauccagaaaaagcaccaaacauuuggaaaaugacagcacuucuaaguaagcaguugaucaaagaagaaguuauaaaggaaauuuuaaaauguuucacauagaaagauaaaaacauaauaucagaauuugugggauuuagcuaaagcauugcuuaaaagagcucuuuauacccuuaaaugcuuauaugaagaagaaagguuuaaaaucagugaccuaagcugcuauguuaagaaucuagaaggaaaagcaaaucuaacccaaaguuagaaggaaggaaggaaauaauaaagauaagagcagaaaucaaugaaauagaaaguagagaaaauuaacacagcuaaaaguugguuuuuugaagaaaaaaaguugguaaacuccuagcaaaccugacugggagagaagagagaaagaaaaaacaugaaauaccauaaucaaaagugaaauagggguucaccgggcacgguggcucaugccuguaaucccagcacuuugggaggcugagguggguggaucacuugaggucaggaguucgagaccagccuaacauggcaaaacucagucucuaccaaaaauacaaaaauuagccaggcaugguggugcacagcuguaaucucagcuacucgggaggcugaggcacgagaauugcuugaaggcgggaggugaagguugcauugaggcaagauugugccacugcacuccagccuggugacagaaugauacuccaucucaaaaaaaaaaaaaaaaaaaaaaaaaaaaagaaauagggacuaucacuauaaacaacuuuauacuggugaauuuuucagccuuagaggaaguugacaaauuccuugaaaaauauaauuuuaucaaaacuaacacauuaagaaauagaaaaaucugaauugccucauauccauuuaaaaauuaucaaaaacuuucccacaaagaaaauuucaaguccaaauauugucauuuaugaauucuguuaaacauuuaagaaagaaauaaugucaaccuuuuacaaagucuuuuggaaaauacaggaggcaacacuucccaacuaauuuuaugaguuuagcuuuauccuauaccaaaaccuaacuaagauacuacaaggaaaaauuacagaugaauaucacucagaaacauagaugcucuuaaaaauauuaucaaaccaaauugaacauguaaacaauauaucauaaccaagugggauuuaucuuagaaauacuuaguuaaauaauugaaaaucgauguaauuuaccauguuaacugaaaaaagaaggcaaauugaugauuuccuccauauagcuacaggaacagugguugaugaaacuagcaguuacucaaugaugaaaaccucucaggaaaguaggauauaaggaaacuccuaaaucugauaaaaagauauuuacaaaaaaaucuucacuaacaacaucccacuuacuggugaaaucugaauaugccccuaaguuuggaaacaagacacgugguaucuacacucaccacuuauauucagcagugcacuggaaguccuaggccuccccgcccuccuucgugaaaaaaaucauugucaucacuaaugcaucccaggcaacuuugcauccauguagcagaguaguauguuuuaccacucaauuuccaggggcaagauuauugccuggacuagugcacaacuuaauuacucucucacucugaaccuucccagucugauaugguucuuuucuucuuugcuacagaacaggcuagauuuagcaaauguugguuuaacauauggaauguuacucugcuuuuaugcuuaacuuuguaacacagauguuugaaggacuagguaauguguacacaauuuugugaauuaggauaucauguguuggcuuuaaugcuuuuuuaugaaauuuuguaaguaugcuacuaauuuuucuugguaaauuauggaaugugauaauauaauuuugugaccuuagugaaaugugcuuguaauagcacagauuuauaauuugcaucauuuauuauuugagaaaaauagucucaguccuuauugaaaauaccuuagauacauucuaauuggggccuuuuuggcaucucccuuugaaacagugcuagagaguacugugauugugaggauaugaaaauauaaaaaugcucauuuacuagaggacaggagccugauuuuucuugaccagacuuaauuuuucaucuucauugaauagaaacuuaaacaauuuuuuaaauauauagauguaguauuauucuauaacaagacaauuuaaaugacagagugacagaaaauuuugguauaauuuaaaagaugguuuaccuuuuauguauucagaaacuuagauuauacugaugcuauauuuuuugguuggggggccauauuuuuguuuuuaaaaggauauccaagaagcaaacuucaagacaucaaguagccgacuccuugcagcuguuaugucagcucugugucacacgucuguuaagcugacuuccaucuucccgauugcguaugauggagaaguauuacuacgaucaauuguuaaacaaguuaguacagagaacgacucaacacuaguucaucguuuuccccuuuugguggcacauauggaaaaacucagccagguaggucugucucugaaaucuuuuauacagaggcacuaaaacucuaaaugguuuuauuuauugccucuuuuauacagaggcaauaaaacuauaaacacaccaagcuaagcguauuuagcuuggugcuuauucuucucuauuuuuaaguauauuuacaaaaugauuauuuuaaauauuuuugaaaaauguucauauuuaccuauaaaaugaaguuuuuuugcucuaacgguuuaaucacacaccuuuaaaaaaauuugagaguuauacaaugaauaccuacauauuuguuuuuccugaaccauuugaagguaaguugcagauacuuuacauucuaauauaauauuuuagauuucuaagauagaacaauaagaaaauaaaggauuuuuaaaauaucuacuuaauaacacuuugguauauuaaaauaagcacuguaaauaauagguauaggaaacauucacauaaaucauuuucaugcuggaaaucagcuaaauuaaucaucuuuucccuuuuuucugaaaaauaaaguauuuuuccuuuauugagacucugugacuucuugaaauuuuucuaccgguagggguuggaauuuucuuaucuccacuuaggaaaacaaauacaguagaaauuauaaaacuacauaggaaucauauguguguacaaaaagaauuuuguuaaaaaagugauuuacacagacuacaguugcauuacagcuaaauauacuagaauuuauuaucucagauuaagaccuuguccuauagaaaaagcuuuuuauuuuuguuuuuuaagacuagcucauucugucacccagucuacagugcaguugugccaucgcaguuuacugcaaccucaaccuccuggacucaaacgaucuucccaccucagccucccaaguagcuggggcuguaggcacauaccaccacacccagcuaacuuuuuaaaaaaacauuuuguagagacaaagucuuacuauguugcccaagcuggucucaaacuccuggccucaagugauccucccaucucagccucccaaagugcugguauugcugacaccacgcccagccaaaaaagcuuuuuaaauggaaagaaguuuucugucugucauauagaauuguaaauugaaaguuaaauaagagaauaaaauaggacucaaagcuaauaaaaacauuucguaaauguaugguacuuugauacgcagagacagauaauucaaaaaagaacuucuaagugaaaaguggcuccacauauaaccagaaagauuuguagaaauugacccugauucaagucugaauuuuaagaguaucagaaagacaagguuuucaaauugaguacuccuaugaaggaaaauaaaacaauaccuuagaacuuuuucuuauguaucgcagagugaagagaauaucucagggaugacaagcuuccgugaaguucuggagaaaaugcuggucauuguugugcuaccagucaggaacagccugaggagagaaaaugaacucuucuccucccaccucgucucuaacaccuguggauuacuggccagcauugucagugaacugacagcgucagcccugggaucugagguaauacauuauauuuugacacuggauaaaaagcacauguguaaguuuuuuacacaguuucuuuuuucaacuauuuuggcuuuguggaagcuaauuucagauuggauuagcaaccccaaugcauuguuuuucuuuuuugccuuucucuccaccuccuacuuucucugauuuguuacuucucucucaccaguuuacccagcauccacaggaauauaaaguauacauuuuccucauagagcaggucgucaucugccccauugcacaagcccaccaccaugccccgugaaaagcaaagauaguucucacugcuggaagaugaguaacauugcugaagucaggcccuacucauagugcacacauagugugggaaagguaaugagguuuagacuucagcucugcccacucaaccgacccuagagaaauacauacuuaaaauuggaauaauaauuuuuauuucaccucuaucacagguuuuuugaaauuauaguaaaauauacauaauauaaaauuugccauucuaaucauuuuuacguguacaguucaguggcauuaaaugcauucacuuuguuguacuuaguuguacauuaucacaaaguuuucaaagucucaaauauuauguuugagaaaaucacuuugaaagugccuuuacauuuuguaaaguaacauuauuccauuucacugccuuacucuuucuuauaacuuaacugaauguuuugacugaauuuggggaauguuucuguuuuuuccuccuaaaaaacagacaguagauugguuuggaaaaucauguccuaauaugaaauaucuuacaucauucaaaugaauguuuaauaaucagcauauauucaguggcccuagcucccaaguucuugucaaggaacuucuuuucucuauuuuacuuuuauaauuccuaaucuuugcuuuuuuuaaaaaauuuauuuuaacaccuauucugaauuaacccauccaauauauacacauuauugauuaauugugacaguuuagccuuuagaauuucauuguaugaaauucauacguaagaaauucgcauacauaugguucaucgcauacacuugagcuaauuuuagucucucauccugggaagcacuuucuaaguuucuugguuaacuuugaguuuggccucagagacgauugaagcccuugucagaaauuuuuuaacuuuuuacauuuacucauuuagucuauaauaccuuccuuugauaguauacucugcaggaugcaggaaagucuauaauguguagauccccuuccaaaguuuacuaaagaguucuccccuuuaaacuuaccuuuccaaugaaaaggaauaccaaaaguuacagggugccugguauacaacuuugggaguucccacagguccuggcuuagagaugaauauuucuuucucagagaaguuugcaauuuuuguuagaaucauaaacuuccauuuuuguaucuauuuagucucccaaaauucuguagccaaguuagauuagaaguaggcuuuguaaauaaaaagagcgauuucaacccaaaguaaguucucuaauucucucuagugaaagucuauaauuaguauaguugcacauguguauguguacguauucaaauacugaaugcuguuacaaaaauaucacuguauauauucguaguauucaaucuuaggguauagaccauuuucuucaaaugaaguuuuacuugcaaauucacagguaagaggagagaggacauagucugguugaagaggggaaccauaaauuuaccucuuccuugcacaccuaucucugcagaauuucuagagcucuguguugcauaguuugaaaacuguugaucuauagaauuucgaugaaauuuuuagcaucucuuuucaaagucugaugauuuauucauacauuaugacugauaagacaagcuuguacuucugacauuauaaauuaaguggaaaguauaguuucauauggcuaaaggaagaaaauacugucaagugacauugauuugugaauuuagaaugauaaaaucugguuuuauugugaguuaaucucucaguagaacauaccuuuaggaauguuuauauccacuuauuaaauaaagguuauuuuauuagacuucuuagaaaccuuuggaugguuuuguuaaagguauaccaacuacugauacaauugcuuuuauuguucacagguugauggacuuaauucucuucacucuguaaaagcuagugcuaaccgauuuacaaaaacaagucagggcagaaguuggaacacugggaacggguccccugaugcaaucuguuuuucaguagacaaaccuggaauaguugugguugguuucucugucuauggaggagguggaauucaugaauaugaauuagagguguugguugaugauguaaguaucacccuuuuaguauuuauccugauuaguggguuguguaucaggauuuaccauugucauaguauguucagggguuuacuagaucaaucacugaugaaugacacuaaagaaauugaaaaagacuggccacaguggcucacaccuguaaucucagcucuuugagaggcugaggcaguuggaugacuugagcacaggaguucaaggccagccuaggcaauauggcaaaacccuaucucuacgaaaaauacaacgcacgccuguaaucccagcuacucuggaggcuggggugggaggaucacuugagcccgggagguugaggcugcagugagccauaaucaugccacugcacucaagccugggcagcagagugagacccgacccugucucaaaaaaaaaaaaaaaaaaaagaaagaaaagaaauugaaaaauaaugauuuuaccugauuguuuguguuccaucuuuccaccuugggucacuacugcuucauauuuuuuguacuuucagaaagagaaagauuuaaaguagaauuaaagacuaaaaguguuuagcuaagucccugaugacaagucuugaguaguuuuuuuuuuuuuuuauauugucauuuuucaagaaacacaauguugagauggacuaugucauagaguacuaaugggugauucuuagugaagacacuauuuguugacugauugagcuauaucuuucuauauucucuaaaauuaaaguaccugaguuuuauuaaaaugggacagaugggguagcauguaaaucauugccuauuaaauagcaagucuaucucuaucucuaacuugauuccuuucacuaguuaauuugaauuuauucccuacuucauuaggcuuuauaaaugugaagaaguagaaauaguuuaagucaucagaugagaaaagcuuauuuauguuguagucuucucaagaaaucacauaaaaauguauauaguacccccaacuuuuucuuucauauguaugggaaaauacuaauggcuaauuuuauauucaagaaaauaaauuuuaaaaauaauaauuauaaaucaaaauuguucauacaauaaaauuaagagucuguuggaauuuuuguguuucauuuuuuuuuuuuagagugaacaugcaggagauucaacucauucccacagauggacaucucuggaauuagugaaaggaacguacacaacggaugacucacccagugauauagcugagaucagacuugacaaagugguuccuuuaaagguaguuucaacugaauguuucuauugugaauaagagguauuauuauguaguuaaaauagugaagaguauuccaugaauuuuguuuguuaccuauagcuauuuguaaguuauccuuuauaugguacuuaaauauuuauggaguaccuacuacguaccuaauguuguaccacauuauauuauauuuuugcauaauguuucuuaaagucaggaguaguaggaaguuuuguagucaaacagacuuagcuuuggauaccugcuguuccacaugcugacuuuaagacacuggcagaucauuauuuaaccacuuugagacuuaucuguagauugggaagaauaauaccugcauuguaguaguauugagauuaaauaauggaaauaaaacaccugccuuagugucuagcacaauaugaaaaauaaauauuagcuccugucuuuucuucucuuauugugcccuaacucauuuaaaaaaaaaaaaaaguguuuuuguuuuguuuuguuuuguuucuuuauuuuuuuuuaauuauuauuauuauuuuuuuuuagauggagucucacucugucgcccaggcuggagugcaguggugugaucuuggcucacugcaaccucugccucccggguuuaaaugauucuccugugucagccucccgaguagcuggaauuacagccacgugccacuaugcccagcuaauuuuguauuuuuaguagagggguuucacuguguugaccaggcuggucucgaacuccugcccucaagugauccacuccgcuuggccucccaaaguucugggauuacaagcgugagccaccgcgcccagccuauuuccuaacaauauuuggcaaaauagagaaauuuuaccacaucaaaguaauuauagauguuaaaauaaaauuaaaguauuucugaauucaacugaaauaaauuucauuauagagcagaauuuuggauaagaucgguacacgagagguuucaucaggaagaauuuagauacugaaaaaccaaaaagcuuuuauugugaaauuuauaucaugggucauaaagcauuaguuucuauagcucacauuuuaaaaguacagugcauuauauuuuggacagcuuuuuuccuauggguuuuuuuucucaugucuguuugccuauauauuucuaucucugaguuuuucuuaaaaauauaauagacucaccauuuuuuuccucacaucuaaaauuauuuuaaaaguuaaacuagucaaggaaaaguaucagcuuaugcaauuaaaaucccuuauugccgggcacaguagcgcacaccuguaauuccaguacuuuugagacaccagggagggaggaucacuugagcuugggaguuugaggcuaggcugggcaauauagucagaccuuaucucuacagaaacacccuaaaaaauuaacugagugugauggaacacaccggugggaggauugcuugagcccaggaagaggaggccacauugaaccaaaauugcaccacugcacuccaggcugggugacagagcaagauccugucucagaaaaaaauauauauauauaauauauaaaauauauauauauuauauauauauaauauauauuauauauauauaguauggcuaauauucuagcaguaaaauuaagagcaggcacuaguuacauugguuguguucagaccuaguuccaucacuuacuagcugcgugacuuugaacaaguuacuuaacuucucugaaccucagauuccucaucuguaaaauagggauaguaaugauacuuaccuuaugaggucauuuuaaggauuaauuaaauuccauaaaguaguuaggacaguugcuuuuaugcaacagguguucaguaaauguuagccgucaucguguuugauucauuaaaaacuuauuuaauuauaucaucuguaaauaugacaaagaauuucaguauauuugccuauuuuacugcuagaguucuuuuuauauauccucuguacauugugaauaaaagauguuuuacaucuuuauaaugaaggaaaauguuaaauaugcugugcgcuugaggaacuauggaagccguacagccaauggagauggaggaaugaccacaguucagugcccugauggugugacauucacauucagcacgugcagcuugagcaguaacggcacaaaccaaaccagaggacagaucccacagauacucuacuauaggugggugaauguauagagauaacggaaauacuuuacagugguagaacauacacagucuacuaccagguaaaauugcuaacuggauacuuauaauuaaauuguacaguguaucuucuuagcacauacuuguacaaauucauauaaagaaaucucuuuuuaauauauaaauucaauguuugcuacaaaaguuaaugcuuuaaaauauuuuugcuguuauuucuucaauaucauugaaauguuuguguacugggcauaugugcuguugcugucacucuauaauuucuggucugcaauuucaaauuuaaaggauauucauuucuuuuuauaaaauaccucaaacuaaugaucagauagacuguacucagauagugguguugccuugaucuuguuaucuagucacagaauauuuugaugucugugaaucuuggaccugcccccuggggcccuagaauauauaauaguguguuucuuauaauguuuuuaacaaaaaccauuccuuauguaaaccuuggaaaauaaaagaaugauaacaacccuuggguuaaaaaaaucuuuuaaauaaacauuucucacugagucugaauuuuucuuguagcggcaaagcuggcgucuuagguagucaugaguaccauuuaccacauuuguccucagccugacuuggcauuaaaucacugaauuuccaugucacuuucagaggcuugcugcuuccucucuuuccuucaugaagagucuagggauggugccuacguagauaguauaaaauaauuucccuagauauagauuuucugcuuccucuuuccaucagaaauagaauagaaauagcaggcagcaaauagcuauguaguucauuguugcugcugaaauacaaaagcugucuagucuuuugccccagucaagaaaagcuuucuguuacauaagcacuacaauaaauaguacauuauucucuuucuuaaacuauggauuaaaaacucuguuaugcguaagaguuacguguuucagaaagcuggagagccacuaagagcaucugccauccaaacuuuauaucuuauacaaaauacaguguuuugaguauuuucauguuuucuauuaagcuuuaaauacccuuagcuuuacauuuuuuauaaaugaaaaauguuaaaguccuuuaguuuuaaauaccauccugcucugauagcucccaaguuuacaucccuagccuucaugaccucugagcccuggacuccgggucucucuucugacaucuucauuuggaugacacuaguggagaugguguuaguuacugugugccaggacaugcuuugaguauguuaccuguguuauuucaccuuguccucacaguaaccccaggagguagguacuuuccuuaucccuguuucacagaugauggaacugagacgcugaauugucuagagucacaccucuguuaaguuacgcuacugcgacuuguaggcaggaagucagauuucaggugauacacccuuaaccagaaugcugcacuuucucuuuaaggauguucguuauaguuggcuaguagacaucugagguuucauguggcuagaauauucaucucccuuccacaguuacagccagacaccuuggagucauucuggacuucucuuucccucauacuuuacaccuaguucaucaagaaguccugucagcuguacuucuaaaauguccuaaaugugaccuuuucuucuacuuccauauuuaauagucuagaccaagccacugcaaccucuaccugcuaacuguaauaagccucuaaacuagucucccuccuuucacuauuggucuccuacaaucaguucucuacagcacagccagagugaucugauaaaaauauaaaucauaccaaguuccacccuugcuccaaacccagcuucccauucucauaccaguauaaaauguaaagucauuauguggccuacaaaccuuacacaauuugacucuuguuucccuucccacccaucacgcuucacucuuucuccuuuucuuccagccauacaugucuucauucuguuccuuuaauucaccaguauguuccuuuugcccugacaguuuucccucagcucuucgcgugggucuuuaaaaaaaaaaaaaaauucaggucagcugggugcgcggcucacuccuauaaucccagcacuuugggaguccaagauggguggaucacgaggucaggaguuugagaccagccuggccaacguggugaaaccccaucucuacuaaaaacagaaaaauuagcugggcgugguggugcaugccuauaaucccagcuauuugggaggccgagggaggagaaucgcuugaaccugggaggcggagguugcagugagccgagaucaugccacugcacuccagccugggcgacagagcaagacucugucucaaauaaguaaauaauuuaauuaauuaauucaggucuuuguuaaauaugaguuccucggagaacugaucuuauuuaaaauaacacccuucacuuuaugcccuaugcugcuuuguuuuucuucaaagcccuuaucauucccuauuauuguauaguugcauguuuacuuuuuuaacuuuuaaaaagcuauaaauuaaaugaggaucucagaucuagauaugauuucuggcacuggaucauguuuuacuuaccauuguaaaauaaucucauguuugcucaugcuacaggagugaauuugauggagauuuacaaucccaacuucugaguaaagccaaugaagaagauaaaaacuguagcagagcauugucuguuguaagcacugucguucgagccucuaaggaccuccugcacagagcucuugcuguggaugguaauauuuuuucuuucucaguagucauauuuuagauucuuuauucacuaaauuuuugcauagaauuauugaagaggagccuucuauuauacaauuuuauagaaucuaaguguuauuuauagauccacccauggauuaauuuuggauaggucacacucuccauacuguaaugcagaauuauuuagaaugcucaaaaggaguuaccauauauucuuauuuucuuaguuaauuuaguaaaagaaaaauuguauuugaguuaaacugggucuuuauucuucuuuuaguaaucaaaaagcuuuuucuuccucucuguucuuuuuccaguaauguaucgcuauccacccaaaacucugggguacccuaaccaucuccucagaggcacuugucuaaauucagcucuaugaguuuuuccauuggaaucucucuaguuuguauucuccucucuuucacuucuucuccugcugucauuuagacugccauggugcaaguacauuucauuuuuuaauauaggguuaauaucccgauaaucucacugcugccuuucccccauucuccaucuaguuguuuaguuauucuucacacuggcagcagaguuaucauuaugaaaacaugguuauggccggacaugguggcucaugccuguaaucccagcacuuugggaggccgaggaaggcagaucaugaggucaggaguuugagacgagccugagcaacauggugaaagcccaucucuacuaaaaauaaaaaaauuagccaggcgugguggcaggugccuguaauccuagcuacucagaaggcugaggcaggagaaucgcuugaacccaggaggcggaggcugcagugagccgagaucgcaccacugcacuccagccuggaugucagagugacacuccaucucaaaaaaaaaaaaaaaaaguuaccuccaccuccuuauuguauaacauuaauuccuaaaccuaguuuaacaucagaaccaccuggaaagcuugcugaaaauaaagacuauuagauuuauccccagguccugaagcuaggcuaaaaaacuauuuuuuaaauaagugugcagccuguuuugauauaacagcagaccuaggaaucaguauuugggagaauaauuggcuuauaaaauaaaggucuucacaguauaggcucagcuuaucuuuccagcaccauguucauggauaacugacuaaaauguuaaucagcaaagugcuuuucuuggaaaaacagaaagcaauguagcuuaauaacaguaaacauuuuuggagugcugaauauguguagguguuguucuaaguguuuuacauauauuaccucguuuaaucuucccaacauccaaaugagaggaauacuguugugaaccuaaguuacagaguaaguaauuugccuaaugucacugauacagccauguuuggugccagaaugguaauuuaaaauaaagacuccauuacccuagguucugauuccagcucuauuauuuuacagguacauguacuuauguauuaaguauuuuggguaagauacuuaaacccuaugugccaugguuuuccuuucugaaaauuggggauaauaaaaguaucuuauugugaguauuaguugagauaaggcauguauucucaaaagccuuuagaauaguaccaggcccuugacaagcacccaauuggugucaacuauaguuucgcucaaaagagcagaauauagauuuaguacagcauguaugcaguacaaugaaauuaccuucugacuauaguuuuaaugccuuuuaugccuuuuuuuagcugaugacauuccagaacugcugaguucuuccagucuguuuuccaugcugcucccccuuauuauagccuacauaggaccaguagcugcugcuauucccaagguguguaauuuaauucuauaacuuugaauguuuuuuuuaaauaucuuuuuuaaaaaaagacuuugugucuugucuuuacaaaaacuugcaucuuugaggcaucugggauauagguaacaagcagagauagaucugcuaauuauuaaacuucucucuucuuaguauuguuuacuggauugcugugcuuauuuguuggcuuuuuuuuuuuuuuuuuuuuugagacggagucuuguucugucacccaggcgggagugcuguggcgcgaucuccgcucacugcaagcuccgccuuccggguucacgccauucuccugccucagccucccgaguugcugggacuacaggcgcccgccacugcgcccggcuaauuuuuuguauuuuuaguagagacgggguuucaccguggucucgaucuccugaccucgugauccgcccgccucgcccucccaaagugcugggauuacaggcgugagccaccgcgcccggccuguuggcuuuacauuugaagaaucugugaaugggaaauagauuuuagcaauuuuaggaauaugauauguaaggaaagauuauguuaacugagguuuuucacauuuaugagguugaugccaaauggucuucauuaauaacaauagcaauguuaaaggauaagaguguuuuaaaauagugacauauucaagagauggaagaaaugauaaacuauugauucuuuggcauaauuaaguaaaaccugauuuacuucagaucaugaaaaaacaaguuuuuaaaaauauagauuuagauauugucauguaacaucuaagauaaaucuuuuuuuaaucaauugaaagauuucucuuuggacaaaaacuuaacuaguggaaaauuuagauggaaauuguuauuagaguaaccaacaauuauuguaaugcauaauuuuagaaccacuuucacguguaucucauuuaaccauauuuuuauauguguacuagguggcuguagaagucuuuggccuuguccaacaauugcuuccgucaguugccauuuugaaucagaaguaugcaccgccugccuucaacccuaaucagucgacagauagcaccacaggaaaccagccugaacagggccucucugcuuguacaaccuccagucacuaugcugucauagagagugagcacccguauaaaccugccugugugaugcauuacaagguaggcaccgguucuuagugugauucgaauguaaaacuuggcaugagguucucugaugauaucuuaaagaaugccuggccuguauuuacaaguguauuuucuuuuauaguauuuacauauagagaaucagcaggugauuaggcacuguuggauauauaaaauaauuuaagauggaauuuuuaucucaaagaugauaaaauuuuauugguuuaugagaguuguucuuaaaucuuccuacaaguauagugugguauauaaugcuaaacuucaugcugugauuugcaauaguaguagauauaagcauuaacaauuuuaaauuguauuuuuugaacuaacauuauuuguaccacagccugagcucugaaaauuuacaaccccaauguaagauuuaaaguagucuauacauaauguuaaaaaaacuauguauaaaauguuuauaaauuuaauguuauuagagaguauucaaaauccguauucuuuguuuuuucauuguaucaugcaaauuaaggaagagaaggauaaacuuguauuuugugugcuuguaaaauauuccacuuuucaugguagaaacuauuaagcauauagaaguaaacaagcuaguacagugcacuuguuuauccaucaucccagauucagcaguuucaacuguuagucagaccugucuuauuuauucccaaccuacuuccuaaccuccuauauuguuuuaaagcacauuuaugauauuuauugauacaaugucuccaaaauauaaagacccuuaaauauaaccauaguauuaucacauugaagaaaacaauuuaaugucugcaaacaucauguaaauuuuuaauaauuugaguuagaauccauauaaaauccauauauugugauuaguaugucucuuaaguccccuuuaaucuuaagucccuuuaaaucuauaagucucccucugucucucucucuuuuuguucccuugaguucuauuuguugaagaaacuggauccuauguauuuguuagaugggagccucuucagcuuaccugcugguucuuucagacaccccucuugcagucauuccuagcuuccuugcuuucugguaggauaagauguuccaggcucccuuuauauguuugaugccucagacuuggaacuaaccauuuuuucaaaguguccugauuucuguuauacauacacacacauguuauauuuauauauguauauacauaaauguauauauguuuauguacagauagauuuauguguauaguuuuuuaaagauaaaauaccucaugaguuuauacuguugauacuaauucaaacaaggaccacagacacaccucagucuccuuucucuuauaucuaaaauuccuauuagugacacugggaauaucagaauuagaaaaucauuaaauuauuucauuugguguguguguguguguguguguguguguguguguguguguguguguguguauguguguguuuugucuuugaaguauaucccaucuaaguguaugucaaauuacuguguuuaaaguaaguuggaaugcucccucugcaugauuaugcauucauuggauauacacuuagagagucauuuauuuuaucuuagauuuuaggaauugcuuuuuaaauuuggauuuuguuuuauaauucuuuacauaauuacauacuuugaagucaaauuuaugaaacaaaucuagcuuuuaucucuguccucuuuacucuguuccuccuucucugucauagguaacauuuuauucuauuuuaauuuuguacuuuauccuguugugucauuuaauaaaagcauagacacacacacacauacagaugcagauguguauguuuguguauauauauaucuguauucaugucacuuugccuguugaccucaggugacauucccagaaugugugagguggaugacaaucgaauuugacccucagugugguacugcacagucagaagauguccuucguuuguugauuccugucagaacuguucagaauucaggauauggaccaaaauugacaucuguucaugaaaaucuuaauucauggauagaauuaaagaaauuuucaggauccucuggguggccuacuaugguuuugguguugccagguaaguuuuuuuuuucuucuguuuuaugugguaaaauaagugcauuuauguauauuuaguaaggguguaucauugaaaauguuuaucuaauuuuuagagaaauuuauuaaagaccuacuauguaucuggauugcauucgaggaauaaauaagguacccugggcaaggggcacagccugaucugaguuuuggagaagacaauguuuuaaggauuuugugaaaaaaagauuagcuugagcaaagcagaguguuaacguugaggaguagcuagcugucuguguaguuggguccaaauuauagaaaacaauggauuagaucuuuuauuuucccaggaagugcuaaauuuucagaacuuaccuaaggacugaaguccuucauuguaagagaauucguaaaccacuuucuugugugaagagaaacuauguuuuaaaacuuaugguuuguugcauucuuaaccaguuaaccaggacuacucuugugauccuucaaacuaauaggcaauuucauuucagaaacuucuucuuuccacucugaccugccuauuuguuuguuuguuugggaaaagaucagaaaaagccacacuccaggguagaggauugcccacuuugaaaaauaaaaaggcuaaccucaguauuugacaaauaauugaaaaaugauugcccauguaacugaaguacuuuauuaagcaggggaguuugauuaugaaaaaaaguaacaauucauuugcgauagaccuguuguuucuaguguuauuuuugguacaguuuccucaaguagauauaggaacgcuccccgccgcaagucuauuuaaguuauguaguauaugauuuguguuuuuaccuaucuugugauaaaagagaaaguccauuggauaaaagacagggaaauuuuuauaaaauuguuuuagaguuugaacucaauucuggcauuuuuauuaggaaaugaggcccuuuuuucauuggagacugcaucagauuaugugaaagaugacaaagcuucuuucuaugguuuuaaguguuuugcaauuggauaugaauuuagcccuggaccugaugagguaagaaugaauuaucuuuucauucuuuuaaggaagauuguguuucuaagggcuagugaguugugcuucuaacugacuuaaauuguacuguugccucuauucgaaaaauuggggccuggugcaguggcucacaccuguaauugcagcacuuugagaggugagagaaucccuugagacaguuugagaccagccuaggcaauauaucgaaauccuuucucuacaaaaaaaauaaaaagaaauuaauuuuaaccuaggggugugcaauucuaaauuuuuguaguuuaugugcaguggucuguuuugcuacuuuuaauacaugaagaggauggaguuugugcaacaugacccagccuuugaaguauaguuauaccugcccugaaccugcucaguuggcuauaccuuucugaguaaacaguagaaccuguuuucaaaaaggggcuaucaucuugucuaaauguuuuaaaucauacaauaagauaaaaccaaggacaaagugggccaaagucaugaaugaacaguuauuugaacaaugaaccuuuaaaccugaaccuuauaaccagccugagccacaacauugaguacugaaucucaucuacucucaauuuaaccauuagcuucacgugcuuccuucucauuucaaaaguaaugcuugaauucaaaucacauuuuguugauaauccguauuaucauucaaacauuuuuaaagcagcaaauuuuaugcaauuccauagggagucauccaauuggaaaaagaauuagccaaucuuggugggguuugugcagcagcucugaugaagaaggaccuagcacuuccuauugguaaguguggccaauacuggauguuuuuugauaggguuuuguuuuguuuuguauguauuauaaaagggccaaaaauagauuugcaaaaugaauuuuguaaucucauauauucaugagcaauaacugcuucauguacugguaauuugaguuuguuuagagacugaaggguauccucugaccuuuuuuaauuuacacacgcacauggacacccuuuuuaugcauauacaugcuuugagccaggcaguggguauaguguguauauucagccaagcacugaauauauaguauuaaaccaaaaguucuagauauuucuuaaauauucuaguggaaauaucaaguagacaacugaauacucauugucuagaucagagaacaggucgauagaaauguaauugaauaugaucguuauuuaaagacaugggacuguaugaaagauauucuacagcaaguagauaagaaagagaagauagcuuaggauuaaagcugugacuuaucaaaauuucaaagaugcacagaacaggaagaggaggcugcagaugagacugugaaggaacagucagugaagaggagagaaaccaggagaggggaugcuccugggauuuuugcaugcucugagaagugaauuaaaaucuaucauuggacuugaagacuuguugguugcuuguauaugcaauaagaaauauguuagcaaaaugagagaacuguaaguacuuucagaguagagagggagaauggaaaguaaggaagggcgguccauuugaauauagguagcucuuuagaagaauuuuucauugaagcagaacagagaugaggcaguggcagaaaugguacuuuuuuauauggagcaaauuuguaugauauauagauuaaucuauaaucaagggaguaaaguugaaaguaaaaaugcuuacugauucucuaauauuuauacaugguuuaaaguuuuauuuucuuacccccccaaaauccaucuuuacuccuucauugaagauuacucuucccacuguuauuuuuuuccucccuuuucuuccucugccuuuccuucuuuauucccuuuucucuuccuggucccuuuuauucuucuccaucccuuuucucccacuuaauauugguauauauguauggaaaugagaccuuguauucuagccacaugaggaaaauugcuagcaaccuauuuuugucaauagcuguuaaauuuuacauuauauauacuuuuugacauagaaaauuuuuauacauacuugcacaaauacucaaaaaguguauguugaaggguggauuaauauagcagugcuugugauuguaaaaccuagaaacaaccaaaaugucuuucaguugggaacugguuaaauaaguaauggcauagccauucaaugguaguauaugcagcucuuugaaaaaguagaccuauacagccuaacaaggaaagcuguccaaauuauauugagaaaagcaaguugcagaagaaggucccauuuuugcauacauuacucuguauauuacaaaaaaguaugaucaugccuguaaucccagcacuuugugaggccaagguggguggaucacaaggucaggaaauugagaccauccuggcuaacacagugaaaccccgucucuacuaaaaauacaaaaauuagccgggcaugguggcacaugccuguagucccagcuacucgggaggcuggggcaggagaaucacuuaaacccaugagguggagguugcagugagccgagaucgcaccacugcacuccagccugggcaacagagugagacuccaucucaaaagaaaaaaaaagaguauguuuaugugugguugaaacacauauaccuuuuugguuuguuugcacaccaaguuucuagaacaacacauaggcuguugacacuggauaguuuuaagggagcacggcacugguuagagguuuagaauuuuuuguucuacacuccuauacaauuugaguauuucccauugaacaaguauuacuuuauuaguaacauuuaauaauuaaacuaucaaagaaagaucaauaaauaaaauauguucuauauuaacuaauaaaggagaaaauggcuaggggaugcagucacugccuuauauuuuucugugagucccuguuguuuacuaaagucauagcucuucuguaaggcaaccaaaauauaaaggcccagaucugaaauaauuuguucccucuuuuuuuagacaaaacgaauacacuaaguucagaaaguauacauuuauauucauaaauguaggauauaucuuuggcaaaucacccauggaugcuucuugaguauugccuugagaauuguaguauauucccacuggaaguaucuuauauauuaaacuguaugccacuaggauuuuuuccagaaucacaaaucuuuucaaucuggaauagcagaauuauuuuuuuaaaaaaaguguaaugaaugcaaaggacuagaaaauuaaacuaaacuaaauauugacauauuuuaguaaaacucuuuauuuacacaacagguaaugaauuagaagaagaccuugaaauucuugaggaggcugcauugcagguauugucccaaauguuuuaaggauaaacuuuguacauuaauuuaaaaaguauugucacucagaucagccuauuugucuugaccauuggguucauucauuaaguacuucacuuuauucauuggcauuauagagauaaauaacuuaucauugcucccuuuggugggagaaacccaugugagcccuauguauuugguggguaauugacucuggaguuagacaaaaauccuucgggagaaaaaaacaaaucaagugccaagggugcggaggauggcuugcagaacuguggccauuuaaauugcaucuugaaagaauuuguuuuucuuuuuuugccugcuagagaaaggggaaagacauuucacaaaggauguauaguuguguuauaagaagcagcaaaaggugagguugguacaguuggugagcucagucugugacaaaccaguaugucauauuaagugguuagggcuaguugccuguagacaauugggagccaucauuuguuguuuuuauuauuguuugcuuuaccuuuuuugcucguuuaggcauuaacuagcacauuuggcacugaauggaaauacaugaguacuauauuucagugcaauacccccuuuggaucuguuacgucaaccuaauauuucucaaaauugccuagagaugacuacauuguuuucuuacuucauuagucugacuucagcuagcuaguaaucuguaauaggauggaaauaucagaaucuguagacagcauuugucaaauuguaauaccuacuuaggccaaaccagaguuucugauguacugcuaagugagccccauuggauaccacacacugagaacaucagugauggggaaaauuuugcaucuagcaauggugugaagauagaagaaaaguugagagucucucaacuggaucaguguuacucagacccuaggaugugauagauuuguaaaauuuuccaaaaauauuuuuccugagaacuuauuaaguaaaaacacucuuuaaaaauguacuacuuuuuaucagcaaugucuuauaaaauaaaagacauuuuaauagccccagauggaaaggucuuagaauggaagacucuguuauagccuuaguuuuucuaauucugccauggaucagagaacuuugggcccacauuuggaaaacaccaauuuagaucauacuuauuuucuauacuagguauauguaguuaguaauagugauuuaaauaauaucuguagagcacuucauagguuucagcaucuuuaauauuaucucucuguuuuuauaauuacacuucgaaaucaguauuaggucuugcaucuuacaauuauaauaacugaaguucaaagaaguuuugugacuucuugaagacucagaagggaaacaaaggcugguacccagaccuuguaauugugaaggcuagugcuuuacauuuuacuuauuuccugaggugaauuaaucaaagcgguaauaaugaaaacauuuauuucaucuuugucaagcacuauuuuaaacauuuugugcauuuuuaacuccccacagcaacccaaugaauuaaaaaguuuuaucuccauuuacaaaugaggcauagagcauuuaggcaguucgcccacgaucauacagcuagugagcaacugcacugggauuuguucgcuggcaguuuggugacaaaagaaaccccgucucauuagcugggcgugguggcgcaugccuguaaucccagcuacucaggaggcugaggcaggagaaucgcuugaacccgggagucggagguugaggugagccaagaucaugccauuguacuccagcccaggcaacaagagugaaacgccgucucaaaaaaaaaaaaaaaaaaguuugugauuuugaacacugucuucugaucauagggagcuguaguguugucaauaauguuaagaaacgucugaguuuuaaaaagccauuggcaucuuauguguauuccuuuuuuaaaguuaaaucuuuguaccuuaagauucaaaauaaaaauaaauucaacagauauauaauaaacaauaugugucaggcaacauucuaggugaaggagaacuaucaaagaguuucuauuaguccauuuucacacugcuauaaagaacuaccugaggcuggguaauuuauaaagaaaagagguuuaauugacucacaguucccuacauggcugaggaggccucaggaaacuuacaaucauggcagaaggcaaaagggaagcaaggcaagucuuacauggcagcaggagagagagaaggggaaaggccuacacacuuaucaaacaaccagauauuguaaggaaaacagcaagggggaagucugcccccaugauucagucaccucccgccaggucacucccccaacauguggagauuuauaauucgaguugagauuuggguggggacacagagccaaaccauaucagaguucauauaugguuuauaauuucagggauuauuaugguauauaaggugucaucuagaccagauauggagagaucuuuauuauguuauuguucaagaaaaaaaaaaauggugucccaaauugccucuuuuuggcauguaagguaguuauucugauaaucuaacauguauuaaacacuuacuauuuguuaggcaauguauuauauacuuuauaugcauuauuuaguuugaauuuuuuaacuguguaagagagauuauuugaugaccaguuuauacauuuuacagauucagggaugguaacuuuuuagcuuaagagcacacagcaaauaauuuguccaaagccaggauuugaauuuaagucuauuugauuccaaagaugauuauuuuugaaacuguauaauuucaaauuugauaguacuagaaauguaauuauuuucuaugaaaaaaucuuacuggaauuuauuuuauagucaguaaaaaguuuucagaguuccagcauuuaaaacaagucucuccaaaaacauaagacuugcuugucagauaggugaaaccuaaaauuuguuuuaucugccucuucuucuuaacuuuaguaaggcuuaggcaggcuaaugagaugugugugcugccacaaucaggcuuccacccacuuuuuacccaagucaagaccuuggugcccacccacccaagagaacagacacaccuuacucaugauagcugccuguaagggggacugaaaaagagggaagccggaugcaguggcucaggcuuauaaucccagcauuuugauagggcaaggugggaggauuacuugaggccaggaguucaagaccagccugggcaacauagcaagaccccaucucuacaaaaaguuuuaaaaaaaauuagccagccaugguggcauacgccuguaagucccagcuacuugggaggcugaggcagaaggaucgcuugagcccaggagguugaggcuacaaugagcuaugauggcaccacuguacuccuggguggcagaguaaggcccugucucaaaaagaaaaaagggggagacauccacaguugcugacagaagggagcucuggcccugaaaaaugaggacauaacauauagaggacuggcauggaaggagauacaccauuuuauccagcaugcagaucucugacaaggcauuuauuuuugagggaggaaagagacuggaaauauugucucauauuuuucucuccuaggaauuuccuauucuguggguuaaaagaaggaacagugggguacguggagaaaaugauuucuccguaaaggccuaucugaaaguaucugcauguugaaaaauuuuauguaauuaaaguuuuauuuuuaagaauauauaaauauucuuuuuuacuuaacaggugugcaaaacccauucuggaauucuuggaaagggucuagcucuuucucauucaccaacuauauuagaagcacuugagggaaauuuaccacuccaaauccaaagcaaugaacagucuuuucuggaugauuuuauugccugugucccaggaucaagugguggaaggcuugcaagguaaauguacuuuaaguuacuuacuuuauuuuagggcuuucaucuuucuucauuucugaaagaggggagucauuagaauauuaaaauacuacuuuaaaaaagucugguuuauguauguuuaacuugcugaaauauaaaaugauaguuaauauuuuuguuuggcgguuguuuguuuguuuguuuuugagagagagggucucacuguguugcccaggcuggagugcaguggcaugaucucagcucacugcaaccuccacuuccuggacucaagcgauucuugugccucagccucccagguagcugggauuacagauaugccaccacacccggcuauuuuucuuuuuuguauuuuuuguagaaacagaguuuccccauguugcccaggcuggaauaguuaugauaguauaugauaagaccaggugcaauggcucaugccuguaaucccagcacuuuaggaggcugagguaaguggauugcuagagcauaggaguugaagacaagucuggccaacauggugaaauccugugucuacaaaaaauacaaaaauuagccaggcaugguggcacacuccuguagucccagcuacuuggaggcugagguggaaggauugcucaaacccuggaggcagagguugcuuugauugugccagugcaauccauggugaaacccugucucugcaaaaaauacaaaaauuagccaagcaugguggcacacaccuguagucccagcuucuuggaggcugaggugggaggauugcucaaacccuagaggcggagguugcugugauugugccacugcaaccagcuugggcaacagagcaagacccuaucucaaaaaaaaauuaacuaauuaaauuaaauuuauuauaguuguuaauugauuauuuuuguugcuuuuuguuuuuaggaugaaaagggaaaaaaauaugcuggccugcaugauuuuacuaguaaaaaaaaaaucccaacuuuuuucugguuuuaauuuuaaaauugcagagauuacucuuuaguuuuuaaaaaucacaaaauagugauuggagaggaaugucaaaucacuuaagucagccucacuacuauacuaugcagacguuuuuauguaaugcaugguagaauuacuuauuacucagcucacaggacaacuugaauguguagaucacagaaugaauucaggaaugaacaucacaaauuacacaacauugaugcauuuuagguggaaagcaagguaaugaggaagauaguugagaaacugugaaaaaaagaugggcaguacaccuugaaccuggcugcugucaggcaaguagagggccauuucuaccccugcuuuuacagagacacugcuuuuuccaggcuugcaggauggcagaguaagguggagcuccuucagagagaaugagccugcucaggacuucaaauuaugcacaaccuacauucguguucuuggugauuuuaaauuagccauaguuaaaauuucaaguuuccugguuuuaaaaaguauuuuuauacuguauuuaaauaucagaaaucuccugugcuuaggcauguuuuuuaaaugaauuuguccuuaacaguuucugagggagacacucaugauuaucacugaguuggaaaugaagauaauguuuuagcauuuuguuugauacaaguuuuguucauuuggcuuaauuuuauauuaauuguugaagaugcugaucaguguuugggguuuuguuuauuuguuuuucauuacuguuagguggcuucagccagauucauaugcggauccucagaaaacaucuuugauccugaauaaggaugauauucguugugguuggccuaccaccauaacuguucaaacaaaagaccaguauggggaugugguacauguucccaauaugaagguaauuauaacuggauuaaauuagcagacaucuauauacuggcugcaaugacugauaaaauuuuagaaaugccaagugcugagaguccauuuguucuacccucuuuauauaaagggugaugcugaaaguuuguuuaaaugacuuguuuauauuaauuaguccccaaguguccaaguuacaccuguuuuuuuugugaguuuguucuuuacauuuugcuaccuguuacggggacucaaaggagggauaagaaaguauccaucuaaagagugcuagacacauacagugaagccccucaauauguauugauugaauaaaugcaugaaagaauacauuuuuaaauuuuguguauaguuuugaaagacucaaguacguucuguguuugguauuacugaaaccacauuuuaaaaauaacacucauuaaguuagaaauauaugaguuuagauuguaaaagaaugaggaauugaaauaguuguauaccauauugaugaauauagaguuuuuaggauaccucuuaccugaaauauuaauaauaauguuucagagcauauuauacauaauuauuugugauuuaaucuguuaauaugaauaucucauuuaaaacuuuuauuucugaaaaaauuauauugaauaaaauuuuauauaggcaguccccagcccuuuccuccuucaaaguugucuuauagagugauugguuguuugaagcuuagagcugauuaagccacaaaauccuuuuugcucauuggguagcuaauuuugccucaauauuauuuucaguagaacuauuucaacuacuucaugcauucuuucauuuauagcgugaagaaguacaaugccaauguagcaucuuaccuaaguaaaaaauaagaacacauugcuuacaugacuuaagaccaguaaauaaaacuguauggaaaagguuucaacccugauacuaaaucaaaaucagucuuuuagcaguaucuuucaaauauuuggccaugauccauagucagaauuuuuauuauaacccaaagauauaaauauaauauaugauggaauagugucuauguaauagcauauguuaaguacauauaauauacuuuauauauacauacacacauacauacauaauaugcuauacucugaugcuuucucuaucuuauuuuuuaaggcaagucauacccuucacaaacugaguucaugccuacuuggaauuauucuauacaaugcaaaaagcaucacaaauuauaagaaaaaaagauuuaaaaauaaaguuauccugauagugauaugaaaaaaauuacuacucaaggacagauuuuugaucacaguacaauacacguuaagauguugaagggcuuguauauuguguauucacugaugaauuucucaauguagugaguuguuaaauccaaucuuugaacccucaagauuaaguuuuuuauucaugugacaacauucuaauaccauguucauacuguuacgcuucugauauuucuuuaguuguauuuucuuucuuguguuuucuccuuugcaccuuuuauuaucucuuuugauaucugguauguuuauaucuugcauuugaaagucagacuucaucuuuuuuucuuuucaucuuagaguucuuuuuuuaaccauaugauggaucugcuuuuuuuuuuccucucuucuucccucuccucuuucccuuucaccuccuucuccuuuuuccuucuuuucuuccucuucuuucuccuccauauauuugcuucuccuacuaucuuuccuugacuuaaaccucuuacucagugugcucuaaauucaugucagauuuauccaauuuagaaacuuucuagaaaaccacucuaaauacuaucuagaagaagugauuugugcuccuacugauguuuaauguauuaauaucauauuauauuagcuggaaacaaaauuaauuuaaccuauuuuacuuucagccuauuaguauaugaagucuuaggagcacuuuagacuguucauaaauuguuaaaaucuuuaugcaguaauagcuaauuauuugaagcauaaaaguugauuugcagcuaauauuucaaugaguuccaaaaugcuuucaaaagcaacaaguguuauuguuauaauuuuuuacuuauaaaaugacuguucccuaccugugauaaaaugaguuagaacuaaacacacauauuguaccaaugucaauuuccugguuuugguucaguaccaucagugucugacaguguuggauaaaauguagccauugggggaaccugagugaaggguacauaggacauuucaucuauuuuugaaacuuccugugaauuaaaaaaaaaaguuuauuuuaaggaaaucuuauuuauugacaagagaaagucacauaggaaauacaagaauaacuuuuuuuuuaaguaacacaguuuguaaaagaaagcagaaugguuauucuauaaugucucaguuuucuuaaaguauaaaauuauucagugauuuacuucaagguucauggugcauacacacauagacucuaaugauaauuuauuaaauacuuaggguaaauauaguugcuuacagaaagguuaaauugaaauaguauguauaaaaauagugucuguaauuuaauaucaaauauguuugagacaggagaguucccuugaccccuuugugggacuugggacgugggugucguguggcucauuuacuugacugcugcacucaaaccccuugcaggauggcgagcacugaggcaagcaggugccagggcccaggcaagcaccucugggcuccagccccacagcagcaucuaggagugugucacaauuaaugcuuuuuuagcuuuguugucuguggauggcuaaguguuaaacagcucagugaagaaucagcaugacagccuuuuuggguuccugcacccaguguguccugaauucuugucuggcauucaggaagaaucaggucauaugaaugguuugaaacgcgaugaaugcgugaauacagcagauuuuuuuuuuuuuuuuuuuuuuuugagacagagucucgcucugucgcccaggcuggaguacaguggcacgauuucagcucacugcaagcuccgcuuccuggguucacuccauucuccugccucagccucccgaguagcugagacuacaggcacccgccaccacgccuggcuaauuuuuuguauuuuuaguagagacgggguuucaccguguuagccaggauggucucgaucuccugaccuugugauucgcccgccucagacuccaaaagugcugggauuacaggcgugagccaccgcgcccagccacggcggauuuuaucaaacgguggaaguggcucucagcagaaggggagcuagaaagggcauggugugagaagaaggugauauuucccugaagcccagccgucuccagccaugcuccucuccuaaguggugccaucugagguuaagccgcgcgucucaucaguugcugcuucuccucuugguauucgccacuugucucuuugcuagcugaagucugggauuuauaggggcauaggguaggggggcagggcuggccaaaaaggcaacauuuaggcggaauacaaggauaaacuguucucauuuagggucaugguuuccaggcuugagaguggggccuuugccagggaaccaccuucuccuauccaguauaucccugacuccugucuguaucaucuucagauuuuuuaauuguuuaaaguuuaaagcuuuuuaugcuggcacauguguuugaguugaaauuuuaaccauauaccuguaaacugccauuuuuuaaauauaagaauggguuuuuaauauuuccagggguuugugucaguccaaauacugaucucuuguaaccucaccugaagauaguggucacuuaauggaacauauuugucaccugugccuaacauuauauaaauagcgaaagucucaaacuacugauuccauagaaucgcguuguuaagaacaauaaacauaaagacagucuguaguucugagguagcucucaauuacuuaaaaauacuaucacuuuuaucucugcacuuuuucuauuucugugacaauucuguugaauuaccuguucuugccaaccacaaaacuauugucuguagggagcagcagaaacuuugaguaaagcucagaauggugauaccugcugaagaacuaaagugguauucaaauuguguguacauuugugguugccuaggggucaaguguuuuucugccaaugcauaaacaaauaaaaacaauguuuucuuauaauuucugggaaauauuucuaaaaaguauuuuucagaaauaguaguuaguagaugaaauaguagaguuaguagaucaaagauagucccguuuuguugaagaaauugaguugcaaaguuauaauuccuggaaaauauaucuaaaagguauuuuuauaagacaauuuguauuuucaguauauuaacauccauuaacgaaucuguuuuuugcaucuauacuguagaguuaguggacgaaagauagucccauuuuauucuuaaagaaagugaguugcaaaguuuaauuauuuaauagauugcuuaaaucaaauguugauguuggugauagggcugucuaauaauauucuuucuucacccgaguaaagaaacauauuugggcuuuagguauaagauuuguuuuauuaaguguuaauuuuugaaacuucuauaaauagaguacauuuucuucuguagaacagugcagcucaaacugacauuagugcuuuaaaaugugcugagauugugggaaagcauuuacacuugcauuaccugauaaaauaauuuguuagucccugcaauaacuuaauguagauucauuccacuaucuuuuccuguacuuuauuaguggugcauuuguuuuuauguuuugauaucucugauuauguauuccaaaacuaugaggccuuguuuuuacaccguguucaugguucauauugucaacccaucuugaggucauuugaacucuuuucaauaagccuuugaagggaaugccagagacagaccaaugcuaacauaaaguauacauaauuaugaguuuauaauaguaaguugcuuauuuugaugucagugacaauuaaauaauaaugguauuugguuucuauaauaccauguuuagguggaagugaaagcugucccuguuucucagaaaaaaaugucuuuacaacaagaucaagcaaagaaaccucaaaggauuccuggcaguccugcaguaacagcugcaucuucuaauacugacaugacuuauggagggcuggcaucaccaaagcuagauguuucauaugaaccaaugauagugaaggaagcucgauauauugccauaacaaugaugaagguaauuuauuuuacuuaucagaaaaauuuuaguuuucagcauuuguuuauuuaaccaacauuucagugauucagaugcagacaugaaauuguaaguccaaagagcauuugauggauauuaaauuugcagcaacacuuauuaagaugauguuauccugucuucagagaggauuuucauugguuuuuggcagauguccagaggggaucaccaauuacagaucaaguuaaucgaaucagagauacagauggauuaggcugaguuucaguuccugugaaaguacuugucuacuucugaccaggaacaguggcccacaccuauaaucccagggcuuugggaggccaaggagggaacaucacuugaggccaagaguucgagaccagccucaguaauguagugagaccccaucucuacaaaaaaauaaaaauaaaauaaaauuucuaaguacuugucuauuugcaguuuacuauucuugcuagaauguaucucuucaggguuuugggguuuaccuaugcccccuucaauuuuggguucucucaaaugccagauguaucuccuagaacucuuugggauuuuuagcucucuaauaccuuuagacauuuaaaaaauauauauuuuggauguuuuaguuaucuucagaggcaauguuaauccgaauuaucaagguagucauuauuugaagcugaaguuuguaauuuuggcauuuucagagagcaguggugagccauugaaggcuuuuggguagaggaauggcuugauuagauuuguguuuuguaacgauugugguggaauauggacaguguaauugggcagaugaucaagaaacaugacuugguuuuagucucuuuaggggacuauugacuuaauuuggugagauaugcugaucaguuggacuagugaguugucaaugaggauagauucaauagaaucaguagaaccugguagcuaguggagguggaguaaagaagaaagguaggaaauaaaagaugaaauucacauauugagcuuguguccaauugauaauggaagaggggcagguuuugguugagaaagauagcagauucaguuuuggaugaggugaguuuuagauacuucugaaauaccuacgugaagauguauaaaacaaaguuagauguacagaccugagugaucacagucugaccucaagaaaaggauucaggaaucauuagcacuuacauuacuuaugaagucaugggaauagaugauaccuucuauggugaaugaagacagaaguuccaggauaggauccuaagaaacaccaauaucacugagucucagacucuucucuacaucagaagcaucuggagcacuuacuuaaaaaaaaaaaaagauuuccaagcacccagagauuuagauucaguggguuuggagagagguucaggaauuuaccugaaacaaauaugcagugauucaaauucaaaaccuaaacuuugagaaauacugauuuacaagguagauaagagaaaaagaaaggaaaaggaaaaacgauucacauugguaagaauacuagccaaagaagcaacacauaauuaagggaauggcugaagugaguguagauaagccuuucaagauguuugacuauagaaagaaccagaggaaauggaauugagugaaggcuuuggaguauggggucuuauuaauagagauagaguuacauauuugagugcugauuaggagguaauugagagaaaaaacaauaaagauacuccgaauauaaaaauagaaucuagagcucaagugguagcauuggccuuaaauaggaggaggaguagugcuuguuucauucuaccagaagaaggaaaagaaagcuuaauacagaugcuaguaaauuuguagguuuugcagccaaaggaauuauuuaaaacaguaauuauguguuuugggauggaaauggaagugaugaaucuuagggucaagguuuugaaacaaagcggauaaaaugaaauuguuauucuagagauuaaaagaaagcaccgaucagaaaagauuuauuagaugccuuugaauaaucaguugaaauugaagauuauuugugaauaacagugugagucauaugagcauggauaaaacaaucauuuggauggaucuagcauuaaaauuuugcuagaccagcaaaagaacaguggaacaaggaaguuaaguauaugguagcuaaagagaggacaguggaaccuaauuuaguuuggaagggaagaaauuucagagucaaggaaguaagagggacuagacgucaaaguagauauaagaauaguuauugagguaaaaaacugaacaggccauuuuauuuugauuucagagacagaacaauucugaguaaugucacaggucugugacuuuuggugugaguggcuggaaaaaaaguugaaguuauugagguuaaagaaaucagggaaugagaaacuagaguucuaggugaauuguccacuggcuguuaaagaauucucuucucucacuuuuuacucaccaaauuaauaaucucauuaugaauucuauauccgaaauaaauauuugucucauuuuuuaaaaaauccaucuuacacauuuggcuauuuuaguaucaaauuuuaaaauuauuucuacuauuaaaaaaaaaagcaaggcuaaaaauucuucucuauuccaacacuugcuuaaggaauuuaguuucuagucuccuuaccucccuaaucuuuuaguuuccuaugaacaugcuucaguuuguauaauuucuuuugcaaauuuuguuaccacaacggaaugcaauauuucaaacauguucugaguagccuagguuuagagcagguauggaauaccauucccaaacaguaucugugaaauguuaauucaggucccaggaaaggaaauuuuccuuaucaaccauucacagauacuauguauucacucaguagugagccaaguauuguagaggauggaaagaugaaauauggucucuucuuucauuacuaaguguguuaauaauaugaauuugagggagagugaugaaauagaaaauacauuguacugaaagucuagaaacauggauuuccuuuucucaccuuuguauggcuaaagacucagccuuaacuugcguuuuucucauguguaacuuuugaguagguaaagucagcuagaucauuucuaauucauuuuuaugaaaacaaaaaggguagagagaaggaagggggcuuugaguuugcuuccuuuuacuguaaguacaggaggaguuagaaguagaugagcaguuggacaucuugaccugaaccuugaaagauaaugauuucuuugcuaauguugcaggcauacagaaguauucagaauaaugugccaaguuucauguaccuacagcccauuuuugucuuuacauuuuaccauaauuguuucaggucauuuuguuauuuuuuuauuaagaaacagauugcuacagguacaauugaagccugccuaaacccuuccucagacccauuaccaccccuuccuuagagguaaccacugcccugaguguagugauucucauuccuguauauauuuuuaggcucuuacugaauacaaauuuauucauaagcaguauauuuuggguuguucaauacguuuuccagaaguuuauaaaauaauaucguauuguauguaucauuuugccagauuuuugcuuaauguuguuuuugagguucagccguguagcuauaggucauucauuuuaacugcuuuaaagcauuccauuggggaucuauuccauaaucuguccauucucccauugauggacgcuuauuauaaacuguacugaaauaaacauucuguauuugucuccuuuuguacaugagcaagaguuucuguaagauacauacuuagaaguggaauuguuaaguuguagggcaugcacaacuacaacuacauuaaguauugccaaaacucacacucccacgagcaauguaugaaaguagcaggugcugcauguucuccucugcgcuugguucuuaccaacacaauuugaugaccaugaugugauuuauuuuaguuuuguuuuaauucguauuuuccuccaaguuuaguuaaauaacuuuucuagucuuuauugaccuuucagauuucuucuucagagaauugucuugacugucuuuuuuuguuguuguuuaucucuuuuguauggauuuauucucuauauguuauggaugcauaucaccuuuggguuauacgaguuacaaaucuccuucuccaagguggaagcuuuuccuuucuguauaguauuuguuuuggaaaacuuuaaaauuuuaauguacucaaaagauguuaucuguuuuuuucuuuugcuuuuuuuuuuuaaguuuugguguuuacuuuuggaucuucaaaccuuguagaauuuaucuuuaauaaauggucuaaaguagguaauuuuuuuucuuuuucuccuauauguauaaccaguugucucacaaccauuuauugaauaauauauuacucuguuaauugagaauguuuuuaaaugauuuuacgauuguucagacuggucucuuucuuaaagguuuaugaaaauuauucauuugaagaacuacguuuugcaucaccaacuccuaagagguaaggaucguuuucucaaaguauaaccaaaacauguguugucagcugcuugcaacuaaaaucauccugcauuucaacuuuauuuucuauaaauaaauacuuuauagcauuuuucuagguugccgauagagaugucauauaauaauguauagauuugcagaaagaauguguuuacauucaacuguaauacugccaauauauuacauaauacuaccuacuagugaaaauagguauguaaaguagauaucuaguauguaaaaauguuuaaauugacuuguuuaggguugauuaguuuguuuuuuguuuguuugcuauuuaaaaauuguuccuuuucuccuuccaaugaauuguggagagauuucagcaugugguauacuuguauuugauuguacugucuuaauuuuucagcccguaaguaauucuguuaacuucagauuuaaggacuuuuuuugaguuaauauuuuauuuguuaggaacaguacuacuuaaaauagaaacuuggaaaaaauaauuagaugcauuauacuuuggagagaucaccuccauagaauuuagaaaaaucucugaagugaaucugagauagcagaauuauguauaggcuggaaauaccaguuugaaacucauggggaaaauaaauuugggaaucaucuauauugagauggcauuuaaaacugaggaaugguugucaccuagauagauggcauagguagaaaaaagaugacccagacccaaauccuggggcauuccuuaaauuaaacgguagucagaaaagggaaagcaacaaaacacugacaaagaauggccagugagauaagaaaaaagccaggaaaaugucacagaagcaaaaagaaggaaguauuucaagauaggaagaguugucagcuaucagaugcuacugagagauugcugaggaugaagugaccauugaacuuggggacgugguggucauuggugacuuugacaucagcaguuguaaggaaauguuggaaacaaaagccuaauaaggauaaauuguggaaaggaaguagaagugagagaauggaguuugauauaaaucggagaagagauguaagaccuuauuagaggggguuguaauaccaaagggagguguuagugaagauucuaaaguuugugugcuaaucgaaaugauucacuaaauugagaguaauugaugaugcaugagagagaacaaggugauugcagcauaaaaauguugagggaauaagauucacagcacaaggggagggacuagcuuuggaucagauccaggacacuuccuccauucuaccaugagagaaggcaggggaaaguagguuuauuaaucacauugcaacuuugagguuguaucugauugcuuauugucucacagaagaaagaggugaggucaugaucaccugagaguuaggaagagaggugaugcagguuugagguaagaaagaagugaaauucaagcauuuuggagaguaggcaagcguacuauggcagggugguaggauugccaggagguaugcaaacaaauuaaauguuugcugaacuaucguaaugauguugacugcuuaaccaaaaguaaaauuuccaauauccaucuuauuucuuuucagacccagugagaauaugcugauccgugucaauaaugaugggacuuauugugcaaauuggacuccaggggcuauuggacucuacacucuucauguuaccauugauggcauugaaaucgguauuuucuuuaaagccaugagcuacuacuuacuucaaauaacuagagucaaaauuauuuuuaucuucuaguuuugcccauuaacuugcacuagacauauggauagguuucauaacuuauuugaggccuuguuuucucuuucauaaugaguauuuaauuagugcauuaacauuuuguaauaauuucugguguccgcccaggcacuguagcccucaugacucucucccuccauuuccugauguuacuagucaggugugcucucuuccacgcugcuguuacccugucucuccccugugggugugucugugccucuccugacugugagcagaaagcauucauguuuggaucuuccaguguagcucagugccuggcacauaaugacagcaaauauggaugaaugaaugcauuuuuaaaucgaucauuguguuaaucuggguucuccagagagacagaaccaauaggauaucuauacagucauguaccucauagcauuuuggucagugacgaacagcguauauaauggugguccuauaagauuuuccuguaccuuuucuaugcuuagauauguuuagauaugcaaauccuuaccauuguguuacaguuaccugcaguauucaguaggguaacaugcuguacaggauuguagccuaagaccaauaggcuguaccauauaacccagguaaucuguaccaucuagguuugcuuaaguccacucugauguuugcacaaugaugaaauugccuggugauucauuucucagaacauuuccccauccuuaagcaaugcaugucuauauuagauauaugagaggauuuauuagggaaauuggcucgcacaauuauggagucugaaaagucccauuaugggccacaccugcaagcuggagauccugagaugcagguagccucagaaccagggaagcagaugauguaacucucagucugaggccaaaggucugagaauccaggagggccacuaauaauaaguccuggagucuaaaugcuggggacccuggaguucaaaugucaagggacaguagaggaaguguuuauccaagcuccaaaaaauagaaauacauucaccucuccucuguuuuuguuugcucuguguccccagcugauuggacagcgccuguccacauugaaagcagaucuucuccaccuacuccacucacacucacacgccagucuugucuggaaacacccucacagacgcaaaaguaaugccuuaccagguuucuagguauucuuuaauccagucaaguggacaccuagaaguaaucaucacaaccauuaacuuugaaaaacauauuucuuuuguuuuaggcauuaaucuuuucuuuacuuuuaaacugucuguauaauaggauaacaaggagaaaacucuaguacuuaucagugugaauuucuuguaacauuauuuuuccugaugcuccucaaggaaagggguuucugugaucagauaaauuucgaaaaccugguuugggaugaguaucuuuuaucugaaaugcuuggcaccagaaguauucuagauuuuggacuuuuucugauuuuggaauaguuguauuacaguuaccaguugagcaucccuaauucaaaauuucaaaauucagaaugcuccagugagcacuuuuuuugagcaucaugucagcacccaaagguuuuagauuuuagaucauuuuggauuugggguuuucagauuagagaugcucaacuuguauaugguagucucacuugagacauucacacaaucuacauuaacauauuagggauucugagaaguucugaaaucaagaaacuugucugacuauguuuaauccuuaucgugggaccccuugcaaguggagaagagagaaacaggguggagauaguaauaauaccaauuaauauuucaccaaaauauuugggaaacccugcuuuaaguaguuugcuuuggcaguggagguaaagagguacuuuacauugauguaauuguauguucucauacauuaauguaacuauauagacucagauauauccaguucaucuguaccauucuagagaccuucaccagcagccuuugcugcacucuucuuuauuucaauauauucauaaagccuuuaguucagcaaauguuuuuugguucugagcauacauuuuccuggguaagacaauuccugucaaguguuaacacuuuaaugaggauugugaaaauaaaacacgcaaacaaaaaucuuaugaaguagaauauaaguagugacacacaagacauacaaauuacaguaggaauucgaaaguagaaauagccaagaaugacauugugaaaauuuucuuuucucuaaaaauucugguaaaauuucaguagauagaguuuuuuucaucaucuuaucuaauaguggggaugaagaaaacugauacaaauuagauaagaaaaauccacuuauauuuguuuuuuggaaugaagcugaacaaaaauacuugcuuacuuagaaucauccauuuucuuccauacucaacuucccugcucuucuuccuaaguuuucuccgaugccaucaaugggcugcgaccuugcuugaccauagacaagcagagauaauaauucacuagaauaguuauaauaauaauagcuagcauuuauugugcauuuaauauauaucuaaauuuucucuauguauacuuuuuuuuuuuuuuuuuugagacagagucucacucuguugcacaggcuggaaugcaguggcgcgaucccugcccacugcaaccuccaccucacagguucaagcaauucucaugcuucagcuuccugaguaccuagaauuacaggugcgcgccaccaggcccggcuaauuuuuguauuuuuaguagagaugggguuucacuaugguggccaggcugaucuugaacucccgaccucaggugauccgccugccccggccucccaaagugcugggauuacaauugugaaccacugcgccuggccccuuguacauuuuacgucauuuauuuccuacaacagcucggugaguuagauacuguuauuuuucccauuuuauagaugaagaaauugaggcacagagagucaaacaguuagugcgagauauuggaguaaccaaagcagucuaacaugagaaccucagcuucucacaaccaugcuacauugucauagagaggacugguagagaugaugagugguauucugauuggauauugucagauaagauuuaauucucaaggguucuuuuuuuuauuauuuuccauuuuuucuguaucauuucauauguucuaguuaaagauagggagccccuucuuuuccuugacauccugagacauuccuuuagaaucucagggccauuuuuaaaauauuucucuuguuuagccuauuaaauauccaucaccuuaaaaggacagaaaucagauauuuguguuaauuuuuaaaaauagccuguggauguuuauaagauuagguuuaaggaucuuccuucucuuuuuuucucaaauguuacaguucucugauuuuucugacagaugcuggucuggaaguaaaaguaaaagacccaccaaaagggaugauaccaccaggaacucaguuggucaaaccaaagucugaaccucagccuaauaagguuagggcagaaugaauugagagccggaaucauucaauuuuuacguuugucacugaugcuucaaaauggccaguaaacaucuaacauuuuacuugauuucaggacuugaauucuaaauaucccuaaauaaauuuagagaguaguucaugguaauauuucuaaguuguagcauguguacuucuuuauuugguacauauuguauucuuccugcuguggaacauuuacaaugaacaaaagucuacugaaauuaaguguaaaguuugcaaggugaaaauguccucuacugucaaaagaaaaguuaauuucugaaaucuaaagaguaaguacaggcauuuugguaaacugcauguuaaaaaaaugaaauauugguaauugaauuuauuuuucuaacagaaagaaaugguuuuuauccuucuuaacacguaucuucaguauuuagaaaugaguuaaaauauauauaauugucuaagcuuuauuuucaguaauacacauuucagugcuuaaaaguucuguuguuaguguuguuauacuguuauuugcagagggagccucucuacaaauaauucuggaaccuuauuaagaauuacgauacuuucaaaccugcuuaauuuuacuucuugcuacuuguaagaucucuauucuauguucuuccuaccucacuguuuaucuuugccuuucucagguucgaaaauuuguggccaaggacagugcggggcuucgcauccguagccacccuucccuucagagugagcagauaggcauagugaaagucaauggaacuaucacuuuuauugaugagguaauugauaaaggagcuuuugguaguaaauuuuggacagaaaguuuuugcauuguuugcauaauaauaagguuacugaguuuuuugucagaauauguuuuaagcaguuugggaaauauuuuaaaacuauuuuauagaauguguucauugaguuucaaacauuucauuuauuuuaucauuaaaaaaugacuaaaauuauauuuugaacaugaaaagaacaauguucgacauaguauucagaaccuguacauguauucacugaaaauggguauaguucuucaugacauuuuaaaauguuguuuguuuugaaauguguuucuuacugcuuuaacuuuggacaguauauuuuucugguaauauaaccaaguaacuucuguuucuuaaaauauaaauauaagggaaggaagacucauauuccuuugggaaacaucugauuuuacuguuuauguaucuuaaagugugguuuccuuguguuuuuauuccuaagugaaauuguuuuuacagucuugccacaugaauuaccauauuguguuggcacucuuugcugcuuuuuuuuucccuggagggucucucagacuuacuuucugcaaaaacuagaugcuuaaucugcacaugcaccaucauuuuucugcuuugcagacuuucagaccuugcuagccucauaggacuuacaggaaggccuggcuuguuucuguugcuuuuuucuauagauccauaaugaugaugguguguggcugaggcugaaugaugagacaauaaagaaguaugucccuaacaugaaugguuacacugaagccuggugccucucuuuuaaucaacaucuuggcaagagucuucuggucccuguugacguaaguaaaaggugguuuuaaaaagcauuauagauacacgcuguuuguuuuacagagcuuucuuuaauuaaggcuuuucaguucugagguaacccacaacuaaguaaccuuuacuuuacaauuucuugaauucuuaagggcuucuguguaaugaaagugaaguuuggcaagguuaaggcccuuagugcagauuaugauccaucacagauaggcaggaaguaguaaauuuaauuaauugcuacuuaauuaaaacuacugaauuccuuucaaagagguagaaaaugagagugguuacauuuuuuucuuucuuauuuauacagcuguguggaaugaauuccaaacuaaaguuuaugaacucagaauuauacauucaaaaacauguauaaauguauguuauguucacauuuugcagauaguucuguguguucugucuaauuuugacucucuuccuucucggcuuauaauacuauuauuuagauuuguggugcuccguuguauucuaguugaaguuaaauccuagucuuugagagaauucauuguaccuccuuguugaguauaguagaauagagccaguguucacaagauugcuacuucaugaaguauaauaauaacccacacuucguuuuauauauuaaccaggaaagaaugauuuuuccuuuuuucauuaccaucaaaugugugugcucuuuaggauagagcuaauaaauagcacggguaaaauuuuauuuaaaaacuuaguauuuuaaacaguugaauuucuuaaaaauccguuuauaaaguuagcuuauuguaucaaaccauucaguauauuccauuugacuuucuccuugauuguccauaauaauguucuccaaagcaguaguuuauauaauacaagacaauucuuuggugaagaaaacauuggaauuucuauuucuauuuauugaucucauucuuuuuuauaugcuuuuguguauguuuuauaauagcacaguggagacuguauauagacagagagcaagaaagagaaggaagauaugugaucaagaagauuuagaguguuggcuuacugcuuuacggagguuaaguugaacaaugauacaucuauaaguaaaauacuaaauuuuaaauuaaaaaauuacaucaauuacgucuuauuaaauuuuccucagauuuauaccugcaguuaaaaauaaaaaggauuuugacccucuaugaaaguguauuuuaaagagauaauuauagcaaccacuuuuguacaguuuuuuuuuccaauauagacuuuuuuguugggcaagggggaguugguuuuuguuuuuuauacagaugggagagccaggcgagguggcucacgccuguaaucccagcacuuuuggaagccaaggccaguggaucaccugaggucaggagaccagccuggccaacauggugaaaccccgucucuacuaaaaaugcaaaaaauuagccaggugugguggcgggcaccuguaauccuagcuacucuggaggcugaagcgggagaaucgcuggaacucaggagguggagguugcagugauucaagaucacgccacugcacuccagccugggagacagagcgaaucucugucucaaaaaaaacacaaaaauauagagauggggucucacuauguugcccaggcuggucucaaacuccugagcucaagcgaucaucuuaccuuggccucacaaagugcucauauuacaggcaugagcuaccacaccuggccauuguguguuuuauuuaagaaaauuuucuuaagucccuaauaaaauguuauuccagauuauauuaucuuuucuaccuuccuaguccaaauuuucucugauuucuuugcucauuugaggagcugcuuuugggagagaaagauacucacacagauaaagcaagucaauaaacaaaaguagaaaggaagagcaagaaguaccaucugucacaauucugaaucccacgauuuuauuuuaaagcauuguguucuguuacuugaugcuuuugaaccccauccaagagacaaucuguaguagacagucuccuuaaggucagggaaagaagggaguaacaaagguuagaggagcgguaaggaguggagugaggcauacagauacuugugggugguuuucacuggaaugugagugcggagguuguuaauguaaacagcucaagagugucugguauuguuaggaagcuaggguuuuuuugguuucuucauuuuaagaguaguagugacuugagaguuuuauaaguuaaaagaaagauacuaguagaaaaagggagaaauuaaagauauagaugacaagacugaagacugagaaacaggaggaggaaauggaauuaagggcaccuuagagagcuugcuucuguaaaagagaggggaauaugcauggcaguaguuauguuuuagaggagggagggacgaagggaagagguugagggagacuacaaguucccuuaaaauagaagauaggaaaacgaucaguucagaaucaaaagaaugaguuaaguuaggggguugagaaaugcaaugaauauuugaaauauuguuugaaggauuacugggccacuaaagacucaaugagaccacuguauagacccaacuggaauccccugccuaguccuuuauugcccuaagugucuggaauuaaaagagccaagaaagagccaagaaagcaaauuauaguacuaguugcugagcugcugugacagaaauagcaauuaagauuaucaguucugggaauguggacucagaccuaaguuagaaaugugaaaggacaaauggaagguccaagggauuuagaagauuuaauaaaauccuagaacaauauagugaaugcacuauaguuaaagaguuggaaaaaugcaggcaauaaaguagaauauuuguauuugauaucauagguagggcacuuuaacaaaugagauacucuauuacauugccaugggaggguggcugaagugcagugcacguggaagucacuacaagugccuaagucuaggaacuaagaaguuaggcagguggaagaucaucugcauggacuugaagacacacagaugaugugacucacaaaguuaaagauaaaaacaggcugggcacgguggcucacgccuauuaugccagcacuuugggaggccaagacggguggaucacaagguuagcaguucaagauggugaaauccugucucuacuaaaaauacaaaaauuagccaggcguggugguggacgccuauagucccagcuacucaggaggcugaggcagagaauugcuugaacccaggaggcagagguugcagugagcugagaucacaccacugcacuccagccugggugacagagugagacuccgucucaaaaaaaaaaaagaaaaaaaagauaaaaacaauguguuuaccauuggaggaagggguccauaagacacaauuuaaagucauggggggaugggaauaguuuggaucaggaagaaacagagcaguuugguauaaaaaugaaagaacagguagaugacauaaggauuuauguuuuggguggugaucaaagaugacagaugggguacaguauggcaaaauuaauuggcauagggcucuaaacagaucugggauaaaguuacuucaguacagguauuaacugaggacucauacagagucagaggccuggcauaggcagggacagguaugauuuucuguagggacuagggcagaccccuuacgcagucaguacauuuuuuuuaugaguaucugacugugcagggcuaaacaugguaggacauagaauaaugauucccucucaucuucucaaggaaauaacacaccuaaauaguugcaucuugcugccucuucuuuuguaugucuuauacauuuacugcuggaaaaacuaucuuucucccuucuuacuucaguucguuuaaaguaaaugaacuuuaaucauggcuguuaauuguaaaacaugacucaauaaaaaaaugaaagcugggagauaugaaaucaaauuagaaguauucaaacaccaaugcugcuaacuuaaaaagaagugaaaguacugaaaaguugccuucagcacuguuugugucuaucucuucaaccuuuucuaguuaaaacaauuuuguauugacaucaaugugugcacguuauuuggaucccaacucaaacaaacuauagagagaggaaugggggcagagauuggaaguuugaacacugacugaauguuggaugaauuauuuuuaaaaauaagauuacuauaauuacccauuuuagauaauccuuaaagugaucuugucaugcugucuuguuuacucauguuuuagaauucguguauucaucguuaaguaugaacuuuagcucaauuuggaucuaucagucuuucuauuuaaacaccauauuugacugaaaaauauucauauccuaauuuaguucaaagugacuuuaacuguuuuuaguaaugcucuaguugagagacaaaauaacauuagacauucauauuaugacuguaucguuuccaaaauaauuuuuaagucaaugggaaagauagagcuaaauagaugaaggguucagauccucugugaggcauucauuaucaauuauguagaacuuuuugcccuuuuuagaacacuuuuccuuuuuuuuuuuguuauuuuuguuguuguuuuuuguuuuguuuuuuguuuguuuguuuguuuuuacagcaccuugcccugccacccaagcuggaguucaguggcacgaucuuggcucacugcaaccuccaccucccagguucaagcgauucuuaugucucagccucccaaguagcugguauuacaggcauacaccaccacacccagcuaauuuuuguauuuuuaguagagacgggcaggguuuuaccauguuggccaggcugcucucgaacuccuggccucaagugauccaccuaccuuggcuucccacagugcugggauuacagacugggauuaaagacgugagccacugcacccggcugagaacaugcuuuccaguuuuaugucuuaagagucuuuguuuuguugucuaauuuaucuagaaugguuucacuuccauuuuuuucuaaucuuaaguuguccagacucaaaaauugguuggugaucuucucuuuauuuuccauuuuugcuauagucauuaauucauuaauugcucauuuaguaaauauuugaguucuuauucguagaauucuuauuugcauucuuguuaguaauaaauacuaagcuggaaaguaggcauuggguggagaugcagaggggagggauacagaguaaauaacauggggugaaguucugauccuuggaguacucaccauguaaugugguagacauaccauauucacauaauuaaauugcauugugauaaguuguggaauggcuucacuuaagugacauuugaggaggacuugaagaaaaguugccaggaaacaguaaaggaauuucuagacagagaaucaaauguucagaguuauggggacaugcuauguaugugaacuaaugaauaguugauauagguaaagcagagaauugaggguggaaaacagauauguacuggggagaauagcuuucucucuuccuucucaggcagcacuuaaucuguagaaguagagaaggcuuacuucuuucuccagcuacccauaauauuuguuuuucuugccuucagcccauuuguguuuauguaccucuuauuucuguuuuuaagcuacuuaaggauaaggacucauucaggaucccuucucacucacauuuguuucuuccuaagcauuaaaaauuacacuuugcucauaguagguuuucacaguuuguugaugcuuuacacauuuguggaugcuuaauuuuaguucuuugcauuugauaugaucauucuguuuaaaauaauuucuaacauauauaugcuccuugccuuaauuaucucauuuaauccucauugugacccugugauguuaagcauauuauaauucucauuuuugcaaugaguaaagauagccacucacccaggaucacaaguagaaaguaguggagcugguauuggaacaccaguugauaugauuccaaagcccaugcauuuauguuccguaugcauuaaucuaguggagagauaaggauaaauauaguuauaaaaggaugaagcaacuauagcuguaauaauccuguuacuuugacuagaacugccaaacuacagaaagauaaauacuuauaaccuuaaugguugaaugaggaugaauaccauauguauugaagaugacaugaguuauucuuugauugcauaccuggggaacauugauugauuuuaaauuaaaauucugaagauguggaaucugcaaaaugugagcuaguagaauguuucaaauaucagggacaaugcaaguaaaaagaugaagagagaauuuauuaugcaccuaccaaggaagacauuagacucuggaaucacaagcuuaauuuuuuggaaaacaaguguacuucuaugauaggagauguuaaugguuucaaacuuacacacccaauucuuuggguacucugucaaaaaugagaucuuuuaacauugugagggggguugaguggaagagaaaguuuauaucaagggaaguagaugauagacaaauggaaguauucugagguaucuuuauaguucccauauaaucugaauucuuacagaauugaguuucuguauaucuccaugcauuuauacagauuacuucuuauuuuaggcugauggguguucacauauagaaaguauacugauuuuccaaauuuuggaaccugaaagauuugaaguagaguugaagagaaaguaucauuuguuaaucuuguuuguauagcuucaccuggguuaauugauaaaauuggcaaauguuucuugcauuuuaaauccaauuucauuccuuuuuaccuaauaacauuaaauccaauuucauuccuuuuugccuaauaacacuuagcagucacagcuuuaacauaccccagauuuccugauuuuguuaauagcuuuguguguauguguauacauaacccguguuuuaaucucaauaauauuaacuuaauacaacauuaguaaaugugcuguucuuauaugguuaagaacagcuuuauuucauucuuuagcuuaguguuaaaguuucguaaacagaaugagauuaaaacaguuaaauuaagauuguaauaauauauauacgcuauucuuaauuuuccugagucauuucaucauuuugcuuuaacaauggcaauucuuagcuuugugcuuaucuaacacaaggaaagauuuuuuucuuuuauuugcaugagcauuuggcaugguuggucacuuauuuucacugugauaauuauucacuuguuggucucuuuucuacgccaugaaagauuaucagcuuagaguugcaauuugguguucauuaauuuaguuagauucccaguaugcuuuaauuuucuaauuuucuugacagaacuuuucugccuuuaaaauaguauuugagaaugaaauguuauuuuauauauauguguguucguauauacacaugcacacacaagcugugcuuauaauaaucugugaaauuauacuauaugaaagcuaacauauuuuaauagugagaaauuggggcuuuggaaaaauuaacauuuuccugaauguucauaucuuuagacuaaaacauuucuaaauuuccaaagaacacuauucaaguguguguguguguguguguguguuuguuuguguguguguguguguguguguguuugagaugaagucuuguuguugcccaagcuggacuugaacuucugggcucaaggaguccugccuucucagcuucccacguagcugugacuacaggcauguacuaccaugccgagcuauauuuuuaaauuauuuuguagagacgaggucucucugucuuauccaggcuggucucgaacuccuggauucaagcaauccuccugucucagccuucugaauagcuacgaguauaggcaugcacuacucacccagcuauucaaguauauuuuauuuuuaaacuccagcuuucuguuagucaaauuucugcuucuugauaaaugcaguuuuauuaggacauugcauuuugaaaauaaucuuaggguaaaccagugugaauuaagaauuuucuacaacugcagaacaaaagcaaaaaaguauaaaguuucaauuuacauggaagcauauacagaauugauuuuauuggcaauuuauuaccacaguuagcaguuaacaucauuuuaaaauaucauuguacauguuguugacugagaaagcacuuauguuugcacauugacuuaaaagagagacauaagcuuuaaauauugucaaccagucaucacauugcuucuuuaucacuaacuuuaccugcauuacuuuuaacaauugccuuucauguuacuuuaauacuagaauaauuuaugcuaaaaaauagaauacgcuaaaaaaaagugauauuguuuuaugucaaaaagucugucccacuaugcuuuguaagggagaaaaacccauugaccaaguacucuacaaauucuuauauacguggaugaaccaguauagacauuuuuccccuaaaacauagcacuucaaaaugcucugcaauauguuuuucacuuuaccuaaagagaaaggacguauucccuauccacuuuuaauuagggggcaguuggcuuugguuuugguuuacauuuauuuguaggcauauuauuagacacuuuguuuagaguuuuauaugucuuauauuuaugaauuaguauauauuuauguagauggguguguacccacauucaucuguacauauauauguauauauccauauauauauauggauauggaaaauauagaacuagaaaacaguaaauaaagucucauuaucuaaaaugagauaaugagaaaaguuucauuaucuaaaaugagauaaugagaaaaguuucauuaucuaaaaugacuuauaauugauaaggaauuuugauguuucuuuuuuguugaagucuuaguugaucuuuuuuauuaauauuuugaauguccucuuuuuugguucaaaauaaccguuuaucauaauauuuacauaagcaauaaaauugugcaauugcuacucacuagaaagauuuuaauuucaaaucagauaaauauagauugauagcaugagauaacuacgaaaauguauaucauuuaaauuaucaguaaaacauuuugugaagauguuaauuuuucuaggauaacguuucugugaauuaauuguuccuuaacaaaacauuuuuagacuuaaacuuagagauccuaaaugcucugcauuuccuaaacuuugagauagagaaaaguaggccugucuuuugauaaaauugauuacauuuuuaucuuuugauaaaaaauugauuguauguauuauguuuuucuuaucaaauuuguuaguagcauucagaaacauuuccaaaugaauuuuuuccuacuuauaaagggaaggaaaauugaaaaaaaugacucagacuuuuuauuuuuuacuuuuuuaguuuuuauuuuuauuuuuguacuucaaaaagugauaaguucacguaaacuacaugccauuauuauucauaaugauaauugcauuuucuauacaaucgauaucauuuccauuuuuauuauaaaacagcagacugguuucugucauaaaacaaaucuggcuuguauuagaacaaauacauccucauuuaaagaauuuuaagguuucuuucuugcauugaguaucuuaagcuuuauaacaacgucuggcucuuaauuuuaguaaauggcaugacacacuauauccauggagagcuucugacaaaaacuuacuuaucagacagaauuucuucgguguguuguuuacucagauggcuucaguuucucuuuaguaaaauaauauuuccauguuggugcuagaguacagaaaaauguuguuacugugcacgcaucuucugcagaugauauccuguucccuuucuuuguugauauuuuucuuucuuaaacuuuguugcucagaauaucuuuaaugcuagccaaggagucagggauuuggacguauuuucauggacuuccaaagcuuuuuucccccaggugaguuaacuguaaggaacaauaauauuuuauucagguauuucagcauguauaacaaauuuugugucuuuaaaaccuuugcuuaagauuaauaaaaccuuuuaaccaaaaaaagaucuauaugaagugcugcaauugaguuuucucacuccugccaaaaagaauguauuauuaguuuaagugauacuuccacaugacuucaaauuugcuauauuuaguuuuaugaguagcuuuuccaaugacuauaucuaagauuaguguuuucacaacuaacuuauuuaggugacaguguccuggccuuauggcucuuuuauuuuuucugcugccaacacuuucacauucccucuuugaauguucaucugagaaugggaugggaauggagggagaaaauaauaauauugaaauucaugaauuuaauaugcugguaccugggucuuacauuucuguauugaauaaagcauguauuuuacuauugcuugagcaugauaggcacaguucuaugacuuuaugucugucaguguuuuauacuguuuagcacaagaauuggauaaacuuuguuuuauacuuauuaauauaguuuuauuaccuuuucaauaaaauauuauuuuaaauuuuuaacaaguuuucauaauugccuuucagugacuaguuugcaauuauaauuaguugugccaaggcuuaacucccaguguuacccugaaugaucaaaaguuagaauuauuguuauaauuaauuaaaugcacuaggaauauuauuaaauaccagugaaguuggguuuuuuugcuaaaucuauggauauuugcuuuuuuauguugccauguaauuuuuaagaaucaguugugagugggauuaaaacuugccccuuccaacuaugaaauggcaugauguauuuauuuauuaaccauuuacaaacagacauuuuaaaauguuuacagaaaaucuugugaguguaauagcaaguacuauguaaaguuuagaccuguguuacucucaauuuuuaucuugagugcucucuguguauucauguagguuugcauauauauaaauucuuacaaauauauaugaugaguauauaaaaugcguauuuuacauuuauuuucgguuguaaaucuaaguuuuuugaguguuuaaaauucucauuuccguuaaauuuccaauauguaaccaaagaauauugguaaauaaaauauaauuacaguaaauguaaauuaauuuuucuuaguacauauuuguauaaguaaaaauugguuauucaucacuauagugagauucacaaaauauuaugugaaaguuaauggugacuuuaacauuuucccugaccagucauguauggaauuaacaaaguagcagguauacagaauucuugaaucuacauauuuuuaaaccugaggauucuauuuuuaauauucuacuguguuacuguguguaugaacauguauacauaucucuucauuaugaggcuacugguagggauagaacuauuuaauacaauucuaucuugcauaauguuaguuguuaaauuuuuauucuauuuauaacauuauuaaauaucaguuuuaaccuaauguuugcaugugugucucuuuaugguuaucuauuacucuaucugaauaugaaauaaauuauagaguucauauuacuguauuuaaaaaugcaguuuuaaaucucuuuuaaaggaguaaugaugacaaugagaacacccaguguggacccuuuauuuacauuuaguugggaaaaagagaaaauauggaaagguuauuauuucucuuuauuacauucacauaggaaacaauuuuaucacagcauuacaauuuaacagaaaauuuagggaagguucuuucauuuuagaagugacucuuuucaauaauaaauuuacguuauauuuacuuaaauccauguuuaauuucuccuuucuacuaaaaauauagucuguuuuucuguuacuagcauuaauguaucacugcauaguaauggcuuaacaaaucuagcaagacguuuuuauuuguacaauauuagagaguauaaguuguuaaaauauuguaagcaucaauauuucauucauaacuaacaaauagcaagauauagcuauauuuuuaaugcauauuuuucaucaucucugcuuauggaucaguuuucagauucuucauaccuguuuucucuauuuauaaauaauuauuucaacaugggaagaaaugaauauuuagacuuuuuuuuacccauaacaauauacaguaaugcaguaauaaugauucaaaauuauucccuugugguucacauaguauaguauuuuuauuuuuccaacuuuaaauauugcauuaaagauaaaaguaaaaucaaggaugauuauauuucucaaauuauggugggcagaagccagagguugacugguuuccugcuauauuuucuugccuucaacuuuauuuuaaauagcauuguugaaaaacugagauucuuuaauuagugcuaaugacuaauucuucaguuaucuuuaguuauguguuuuuuuuauauugacaguacuguagacuugcuauaaaagcuauuaauaggaaggcuuugaaagugauaauagauuguauuuuguuuauuuuucuuuccuauucaaauuuucaggaaucuaaaacuaauacugaugacuuuuucaaagacauaaacuccugcugcccacaggaagcaacaaugcaagaacaagauaugccauucuugcgaggagggccaggcauguacaagguagugaagacgggaccuucaggucacaacaucagaagcugcccuaaccuuagagguaucccaauuggaauguuaguucugggaaacaaagucaaagcagugggagagguauggauucuuguagcuucaugacuucuaagauacucauuuuuaauguaauacaaccaaagcaucucuucuaaagguugccauuucuaccacagguuuuucaauguuaauguauuuuaucuuuacuuguauugcaaauacauaauuuuucugugcuucugucuaaugauuugcauaauuauccuuguguaaacaauauauuaacaaaugauuuguauuguauauauaaauguuugguauuugcacauauuuuuucauuauuacaaauguacuauaccaucauggauuaucaucacuuaaaauauucuaugugaucgguauggagauguggucauaugcaaaagguuucauuucuuuguucccauucauaggucucacugaaguccugagcaaauaaaauuacucuuuaggcuacuguggcauuugccucagcugauaagcuugaagauguagugugucaugcuauuucucaguaagggucauuuucaaguuacacuauggauacucucaaccuaaauaauagcaagucggcuguguuaggacauuuuagaugcagaaaaaagaaaaugagccauguguucuuggguaauucuuaaaauuauuuagguguuaucuuugugcuuugaaaguuauuauuuuaaccaaauucauaaauaagcaguauuuuacagaacuuuuuauugacuucugucuuaccucaggcuguggccuuaauuucagaaacuaauuucuuaguagaaauguauuggaaugauuacacuauucagacacguaagauuuuuacugguuuucagacugaguucccugaaagaaucaagccaaucaaucaugcuuuuuguuauguaccagguaaccaauucugaagggacaugggugcaacuggaucagaacagcaugguagaguucugugagagugaugaaggagaggcaugguccuuagcuagagacagaggcggaaaccaguaccuccgacaugaagauggcaaguuggcuuaaauuugugauuuauuccaauuaagcuuucaaauacagaaguuuaaugccuauuguauugcuuuuguuuuaaagaguuuuuuguguguuugcuuuuuaacaagcaaaacuaaaaguuaaaaaaucuugcaacuguuaaaauugguuuguaaaauacgugaguacuuaaugcacauuaaagaagaaaauuaaaagaaaauucgaaacauauagacucaucuuuauaaaacaggcuuuuaauuucauuaauauaaauuuauauaccucuuucuucuguaccaguccaggacugaacguucuaucccuucuauaauaaaaugaaacuucgguauuccaacuaccaaucucaguacuucucccaggcaacuucauuugauugcauuuugucuuagggaaagagcauugaauaaaugcauagugucuuuaggguuuccuguuguuagauuuucaacuuuaaauuuuauuuuaccuuuuucaacauggcuaucacuuaauaaaauauauuccuuuuugucccccucucuuugauaucuugguggcaaaaauuuguucuucgaaguugagaccacauuaucacuugugugaugcuuuaacugaucacaacagagcaaagaauuucuuguguuccuaaagaauugugcucaccacuagaacaauagugucauagugaaguucauguuuauuucuucauacccaguuaugagucccuuguggacaggcacaugguuuuuaucuuuccauuccuaguacugaaacaguuuugacacauacuaguugcucaugaaguuuuguaauacaacuugaauuauaaaaauaauagcacaucaaaauaaguauguaagcaaacauggacuugucugccaaaucccaaaauuuauaggaugaaguuagguaaauaagagaacaugcaucuuuauucaaaagauaauaaauuuauaauacuuauuauuccaagaggcaauuuggccauaaauauggauucagaaaagguuugaaauuugcaauaaugauggaguaucuuuggagauaucucccuuuuuccccccacaacacaccuuugagguaggugauauaaucuuaaauuuauagguaggaaacucaagcucuagaauuuaaacuaacgugucuaugguuguacagcuggugacauagcagauguaagacuucagccagaaucuucauucguguuuuaaaugcuguacucauuacaccaugcuguacacauugagcacaacuugagaaccuaccuccucuccuuguuuuucccagauagacuuuuuuuagucuaagaugauauggucauaaaauaauguccugaaacaguagaacuguucauuugaaaaagauaaggguuccgcuugauguaaaucagacauuuacuaaaugacuuuuucacuuacuaugugcuuauuauauauugcuguauauuuacuucauauucauaaauuuuuaaacauuuuucuuuauauaggaauauucagauauaaaugaaaauaccuaaggggagaucagcuuuauuuaagauaaguuaaauaugagaacagcuuaggugacuucuaaaggacuuuucuagcuuaauccuuaauaauuuuuuaacuggcaguacaaaaaauauguaagaguggauucugaagcaggacugccaggguacugaucccagcugugcaacuuuuuacucaugugaccuugaccaaguuaaccuaauaucucugugccucaguuuucccauuuauaaaaugaccuuauaggucauaaccacauaaauuugauaugaagacuaaaugagcaaauaacagauaaagcuaauggaugguaaguuaggucuuauuguuaaaaugcaaaaugccuuccaugcuaaggaucaaguuuuaaccugggaaauuuuauucuuauaaacuuagaagauagaagcuucuuucaagauaaaaugccucuuaaauuagaguaucauuuaagaaaaguuuaaauuuuucucuguaauuaguuaaucaucuuuuacucuugauguauagauacagacauaaauauggauauuuggugaucaugugaaucuuacuauuuuaauauaaaaccuggagugauaaggaaagaaaugauaugaaguuagugccuuuaaaucacuaagauuaguugaugugcugcccaaauagucuguucauuggugauaauauuuaauauggaaguacaaagauuuggcacuaugguaauuuauaugaagucaugugaguaaaacaaaagcuuuccucuuuguaaaaauucucuauuggucuuugaaaucuguaguaggcaaaguuacugcugugguaaaaacagacuucacucugggugcuagaccauucuuagucuagagaggaagcagugcuaucuuuuccguucaguuuacuguucauggguguuuuucugaagaaacauucuacugcugaaauauugcaugcugaagaguauugccuaagggaagugcuaagauugguuuuuuaaaucaagucuacaaaugcugguaaagggauagauuauacaguaccacugguuuagcagaauugcaauuuacagguaggaaggaaacacucuaccacacccugucuguaguucccuguucuguuuaaaggacuauugacuuuuuuuuuuuuuuuuuuuugagauggagucucgcucugucacccaggcuggggugcaguggcgcgaucucggcucacugcaagcuccgccucccagguucaugccauucuccugccucagccucucugaguagcugggacuacaggcgccggccaccacgcccggcuaauuuuuuguauuuuuaguacagaagggguuucaccguggucucgaucuccugaccucgugauccgccugccuuggccucccaaagugcugggauuacaagcguaagccaccgcgaccggccaaggacuauugacuuuuaaaaaagauauuuaagauacuuaaagauauuuuaaaaauaagauauuuaaaaauauacuugagauauuuuauuuuucauaagguuauuuuaauggaauaaauaccuuuuccccccaauuuuacuugacagacuuuauuuugccuuuuuuggcuggcauuaauauggauauuuaacuaagguauuguuuuauaucagacagagucuuggagccaguugauuguucauaggggauuaauuuaguuugcauauuuuauaggucacaucuugccauuuguaaauggauaaaacauuugccauuuucugcuugaaauaagaauucugauacauuuauagacucugauuauguaacaugguuuauuauuauccuucuauuugggaaaaauaucuuuaugugauaaaauaaguuaaaaguuaaguuuuccauaauuuucacauucauaacuuagaacaguuaacaaaugaaaauuccuuuugguacuagauacuuaguuuuuuucucuauucuaauacuaauaugcaaaauacuuuuauuucugguuuauagguuauccauuuuguuuugcaaaauacucuuguauaaauuuguugcaaauacaaagaguuccugguccagaaauauuaguaugcauucaguaauguauccugccacaauaaaaguaaauuggcuucauaagagccuaucucauuucuaaauuucacuguguauuugauaaauaaaaacaaagauuugucaggugcuuuguuaauguuaagaugaccugacugguauuuaaauugaucaaaucuagaugugagcuuauuuuaaaaucuaaccaucauaaaaucuuuugcaauuuucucucuuuguuguaugaauagggaauagcacguaagaaacuaauguuacagcuauggcuuuuauuguagaacaagcucuucuggaucagaauucucaaacuccuccuccaagcccuuucucagugcaagcuuuuaauaaaggggcaaguugcagugcccaaggauuugauuauggacucggaaauagcaaagguagguauuuaaaaguaagucuuuuacuuaccuaacuucaauauuuuuuauuaccuucucuuuuauacacuuuuuauuuguguucacccagaaaucuuuauuaaauuaaaauuuguucauggaaagcuaauaaaaaauguuuacaaagguguucuuuucauaguauuguuuuuugcuguuguuuuuuguuuuuaaccaguuuuggcuuaaguuuaugagagugcuugcuuauuuuuuuucuauuuaaaaaacacucauuuugauuucauauccuaaagauucuauuucacuaaaucuaguaaaauuugauuuuuaucauccacuuauuaggaugguaauguuaaugagaaacagagaacuugcucaaaugauccauuuaaaaucaaacuauuacuucuaaauaauauuuuuaaguaauauuacacaugagcuuuauaaaauuuaugugguuuugaauuucuaacccaguaaucuuaguuaauuuagaauuaugugaaaugaucuguuugguuuuaauaucuauaauaaaaccagaaaguuguaaaaagaagaaaacccuaagucauaugaauauaauauauauacagcuguuuuggcugcauuaauggaagagaccagcaucauggacuguccaaacaauaguuaauuuugaaacaauuuaugcuggagguucaucagaaauugcauuuuuaugugaauucacacacucuuguucuuuccuauguaccugaucuagacuccuucaaaaucagcccuauuguccacagguaacauacagcugggucaugaguaaaagggagcagauagcuuacguggaaauaauuuuacuuuaauuuuauuuaaauuaauucacaggacuugauuccaagggacaaauacagugucauuauaccugacuugaagaacaagugaaaaaauaaaacagugaacaaaauguauaaggaauauucuguuuaaaauaaaacuacuucuauugaauagcuucauuacuuuccacaaaguauuuuuaugaaggaaaccuagccacaagauuuuuuuuuacucccuuggacuagccuaucucauaggauuggguaucaucugcucgcuuacuucggguaccugauuuccauuaacuuaagcuagaucuuuguacuuacauaguguaaaugcuuggugguguuuucuuuaugucccuuucucuuuaccuuugucaacucuuaaaaucucagcauuugcuuaccgcuacuauaucucuauauaguaauguuuuaaagccuuguuuaacacaaauuguaugcuuucagucuuuaaacugucugucauuguacuaauagcuaucacaguaaaucagucauuauaauuuauuaaaauaucauuaaaauaaauauaaauguuugagacacaaacauugccgagaaaauuuguuauuauguacaaauaauaaaguauuacuuuuuaaacaugagauuuugugaauaucguucaaaaauagcaugcaccaugccaggcauaguggcucaugccuauagucccagcuaccugggaagcugaggcaacaggaucacuugaggccaggaguuuaaggauguagucugcuauagucgugccugugaauagccacacgcuccauccugggcaacagagcaggauccuguuuccuuaaaaaaauauuaauaauaagccuacucuuguuaacaagcuuuuaaaauauuuagaaggagcaaagaaauaauaagaaacuuaaacuugaugaaauauaucuaacuuuauuaucuguaacaguaguucccauuuuaacucuuaauacuguccaagaucgaagagcuguuuuuuguaaguuuuuuuuucuuaaaacaguauuuuagaaaauucuucaugaucucuaaauuuuuuccuauaaucuacagcauuuauuuauuauuucaaaaaaagauauauggcucguguacacaguucuuuccacauaaaucuaucccguguagguacuucaguugaaauuuucacauaugaaacuuuauuauauuucagaaauaugacuagaaagauacuauuuuccaguuucugcaucaccuagucuggauguaguucccucuccccaccuccagcaucauuuaaacuauuuaauguauacucacaaauaaggaguuauuauccaucacauaauuucauuaucuuaaaaaaaauuuuuguaaaaccuuuugguacaaggaaaaauguuagaaucgauauuuuagauacuauucaaauuagguagcucauaauccuuuuugucauauaggacuuacagauuuuuaaauuauucaucuaagcaaaauauuucaugcuuuuaaaguagaauuucuuuggcaguaacaacuuaaaaaagaaaguauuaauuuauaacuauaauguaaacacauugcuauguuaauaacauacuuugccccauucugcuuuuugaagaaaaacuguuaauugcuuauuuucugcaugaaauauacugccgaugaggcagggugguauuagucauuguugggaacuauggaaaaggcaucauuuacuuaaaucuucauuuauauauguucaauauugaagcaauuuaucacugauucuucauagagucuucguucucccauacauaaugagagauguuauauaugaauuuaaauggauuuguuuuuauaggugggcuucuauauaagauuugguggggcgcuuccauuaaaaaaaaaagcuugcaaaauucggucccuaaucugaggaugauuaacagucaccaauuuucacucauuucugaauuggcaugguuuuauuuaguguucaacucuaucugaaugucauaaagcaccauuuacuuugccauuuuggauguuaaugaauaacgaguuguaguuuugacuguuuuacccacugcaggugaccaacugagugccauauugaauuccauucagucacgacccaaucucccagcuccuuccaucuuugaucaagcugcaaaaccucccucuucccuaguacacagcccauuuguguucggacagccccuuuccuuccagcagccucagcuucagaguaagucugucagccuuaccugccucaucaagcauuucugaagcuuuguucugaguugcuuaucaguuacuaauuaguuaucaacucaccugacugguuuuuuuuaauuaggauguuauccccucccacauuuuugaaauaucuaagcuauucugagcuaagacauucugcagcuaagacauuuaaaguugauuuaaaguucauaugcaugacuaugguaagcaucacauacagggacaacuuucaguggauuuuucuuacuucaagaugucccaaaaggauaaagccauuucacucuuaucaguggguagaagagagacuguacuuguuuggacagguuuguuuguuuuuucuaagugaauuugguaucuaugaaauguaugacaauuuaguuuucccgguuuucucaaauuguuguuuccugucuuuauuuuuauuuuuuuguuguuguuccuaauauguuaaauugaucauuugauuccaguucugucuuuuaggauugcucuaguccuucauucaugauaguaauucacauugguuuggaaaagauacccaaaaaaauuauacuuaacugaguguucuuuuuucuuaauaaccuccugaaccuuccaccuaaacuuuucaaagcucuguccaguaugacaacaguguguucuucuuggcauucaguucucauguuggcuauacaauauauaaacacauuaauugaaugagcuaguuuaugaaaguuucagcuuguauaccauuuuucggauucaaaugcacaaccucuuugcuuugguaaaguacauucacacuuaggucuaaguuauuuguuuacaaaaauacuuuaauaacuguuauuagggucauguaaaagaaugcuagcugguuuaguuuuuauuaaaaacuagguuaguauguagcuagcaaaugauauuauucauuacuuuauccaccuuagguaaaggguacacaagaguauaaacuuuucuggguuuccacuauccauuaggaaaguuuaauugaugaaauuaauuaguuuggaaauauaaguacuaucaauuucuagcuuaucauguucguucauguauaauauuaauuugaaugucuauuaagagaagaauuucaaagaaacaaaauagugucacaugugcgaaauaguuuuuuccuucuaugauaaauauuauuuuagaagaaugaaacagaagugaggaguuaguuuauuaauuuuguguugcaucagacuuuuuacauuuagaaguacuacuuagguuucaagaaguuuuaaagguaaggacaaagggaaaaacaaaggaaaaauaucaggaucagucagguagaaaauuuauacuagaaaauuuaaauucauucauauucaaauucaguuuuaaaugaaaaauugccugugucauagcaguagcagacaaaagaacuaaggagaaaggagaaccuuuuuguucuagcuaaagaaucauugcaagucuuuacaaaaacaagcauaauuaccauuuuaauuuuaccaaauuuaauuaauaaaauauuucaaaacaauaaacaguaauaaaaguugauuugucucuuccagggaauaacaguuucuaggugacauugugucaauauaauuuuaugcauauguguuaucaguaccaccacuuuauuuaccacuaucuugaagcaaauuugaaaucauggcuuagcuauguuucaauuagcaauuuucugaaucauuacuugccuauaguccagcaauggaaauuacuuaggucuuguuuuaaacuucuuauucgcaacaggacgucucuaaauuuugacuuccaaauuccagaaaauggaagucuuaaucuuuagcaucacaaaaaaaaguauggaaucugaaaauaguuuuaauuuuuuaaaauaauucagaauuguauuuuuuauaccguguugggaaagguaaauguggcaaagugccaacauuuaagacuccccaagcaagguauucuucccugaaccucacuaccauguaucccacuaguauaucaccuaugcuuuagaagauggcuuauucuuagugaacuucccuaugcuauuuaguaaaaugagauuuauuuuuguuuuauaccuuugugauacuaaauaaaucauuauguagaagaccauauuuacucaacuuuguuuauacugauagucgccacuauguaguaaacacuguacuuaagcacuuugauacagccucauuugagauacugucucuuaugucuguuuuacagagaaggaaacauaggcuuagagaggauaaaugauuugccccagaaacauacauaguaaaaugguagagccagaacuugaggucaauucuguugacuacaaaggcuauuuuaaauauucagccuuaccucgguaaauaaugcaaaaucuacuuuaauauauauauauuuuuaauuuauauuuaaacuaggucuggcaucuagaguauuagcuuuguucagauugauuauuuuucuuuuuauaguuugacuuuuuuuaauguaacaguaguuugaauggaaaaaaagauuuccugaaugucauaacucaagauccugguuaacuagaaaaauucuacaaagacacacaucaaccggugcaugguuuaacuucaucuagcauuucuaugagcauuauuaucuguaauucuuugguuuuuuuuuuccgaaucauaguuuuuacaccuaucuuuggaaauuugaaaauaaucuggcacauuaaguuaauuuuugauaccuuuucuuuagaaucaggcaacauuuuauuccauaaaauagaauauuugguaauuuuuaaauuagcaaaauuauuugauuuuauauacguagaaauuauuucaaguguuauucuagugaaguagaauguuauagaaguaaaaguuaacaaauuucccuugucuuaugugugugcacacagagacaugaaaaagaaaaguauguauauagaauuuucuuuacuguucuacaauuuacuuuuuaauuuaaaaacuaauuauauaguuuuuagaauugguaagcaauuuggcaaaaaaauuuuagugaaccaaaguggagaaugauaucuguaucugcuuucuuuaagaauauuacauuccuuauuuucauuaucaccauuucucuugaaagcuucauuuuauguccuguaccuucugacagugucuuacacaucacaggcauucaaggaguguuuauugacuguagguauuuaagauuaccauuucaucaauuuaagaucuuguguuuucuauuaugauauuccauuguuuacucagagaacaucuucaaagaagagaauuuauuucuuucucuuaguaauuaaagccaacuauacugugacaauaugauguaugauaauuguggguuuauacugauugaauucuaagcaagauuauccaacugaaaaacuauauugcaaauggcuucauuuaacauagcauuuuaucacuuucuaccuacuguuccagaggcugaauaguucauuuuucaacuuuuauuuauuuguuugugguagaaaaauggcaaauaaaacugaagacaauuugcuuuucucccagaaacuuuuuaauacuuuuuuuauuuuauaauguuuuauuuuuaauuuugauggguacauaguagacaucuuccagcaauuucaaacaugaaauauaugauauaugucaaaagacaguacuuucaagcacagauaucauagcucuagguuaccuugcaacaagaguuuuucuauuauacucauaagucacauucuuaugugggacaaaaaaaauuaaaugugaccccaaaauucauuuggauaucugcaugacuauuuauuuacauuugagaauaugaacacacuaaaguacuauguuuacuuagcuuguagaaacauagucauggaaagacuuucagcucagauuucccuuccagcuacuuacuagcucucuaaguuaucugacaggucugaauuuuuguuaccucauuauaaaaugggauucccaauaaauguuaucuuuugauguuauuauugccuuuugaugcaaauacuuaauaccucucaugcuuugaggaaaauauagaaaaaguccuucucuaaaagagagcaaucuauucuugguguggaaugaguugcaggaaggaauuuagaaagggacaaaugagcuuuccuaguuccuuuugggucuauuuuugcaauguaauucaguuaccuauuuuaagauucuuaauguauuuagacugcauucagauguuagugugaauguuagcauaaaagccagguuuguuuguaaggcuuagacugagucauuucuaccccggauuauaaucucagcacuguauuugucaguuuguuguuugccugcuuugaagguauguggaugaagcacuugauuuaggaaugaggaccugugggauuuaaucccuguuuuagaagauuagagucagcauugguucacauaucaaaguuuaauaaaacuuuuccacuugacuuuauaacaucugucacaacaaccaacauauuuauuuuaguuuuggggcuaacaucuccagcaucccuacaaauacaaaucauuuuaggcaugggcuugaauuuaucuucacugagcugagccaucuucucagugaccuaaaagcuuugacccagguauuuuguuuugcugcuucaucagugauuuauucauccacccuuuacuucauccuaggaauucaaaccacaaagaaugcugauguugcuuacaagacauuuugucccagugcauuuguuugcuuucuccuggcuugauuugaccuuuuaucucucccucuucccccaccucuuuguuugcuacuguguuuauuucacccuucauuaccaucuuucuuuagaugacuuauucauucuuccauuuauucaccugcuuuuguuaaguaucuacucugugcuagguuauggugaugagcaagguuaaaaaaaaaacaaaaaaccaugaucacugaucuugaaggcuucuagaauauuuuaagagauacaaccuaguuaaagaaaaaauaauggcauguuuuaagugcaacaagagcaguagucacaggaugcaauggaaacauaggaaagcuucuggcucagcuaggagagguuagagaaacauucaaaaaagaggcagguccuacucagaguguugaaggacuugugagaauuuaucaggcaaggaggaguggagaugaggaaggagguuaauggagcauuccaacuauaaggauaacaugaguuacauuacagagauccaaugaaucacaaaguauuuuauugaguccaccuacgugucaggcaguguacuaagcacuguucaugcagagggccaguuuggaguaaugaaacuccaaaguuugauuagaauaggcuuaggagaaaacggggaaggagaaauuggagacaaugaguauagagaagugugucaagauuugaucuaaagagaagauacuaagagagaagauacaagaucuggagagguuuuuguucuauuuuguuuguuaauggaaaaaaaaguauaucaagguuguuuucuaaugagaguaauucaguugaaagaaauauuaauaaugcaggagggugaggagaauuacuggcacaauauucuuuuauagaagaggggaugcagaccaggcguaguggcucacaccuauauucccagcauuuggcaaggccaagguagaaggauggcuugaggccaggaguuugagaccagccaagacaacauagcaaguccuuguuucuauaaaaauuaagaaaaauuuuuuuaaagaucagcugggcauagugaugcacaccuguaauccuagcuacuugagaggcugaagcaggcaaaucacuuaagcccaggaguucgaggcugcagucagccauaauugcaugccaccccacucuagccugagcaacagagugagaccuugucucuaauauguauauauacagauauaauauauaauauauaaaauacauucuauauaaaauauauauuauauauuauauaaauaaaauauuauauauaaaauauauauuauauaaauaaaacauuauauauaaaauauauauuuuauauauauauaauauaaagaagaggggauacaguccagugcaaaguggaaagguuggcuaagugggaucauaaauaguuauccaucauaacaagcaagaaagaaguauguauauuauugggagcucuuuuuucuaaguaaaauaggaagcacuuaucagcucggaguuaccauggagagacugcauugauaguuugaggaaagagaagauaugagauuuuaaaagcuaacauaugucaaauauuuaucacaugccaggcaccauucaugggaaucaacuuuuaucccuguccaagaacaugguucacuugagaaacuucaugcaugugcagcuuuaagugaccuagugucagugucuuagacuagagagguuggggcuggaucaugaagggucuuguaagccauacuuaguuuagacuuuaugugcagugaauaaauggagggagcacauggaggaaauuguucugcagaauuuuaaauaaaaagagugauaugaucaguuuuacauuugggacagauaacugaaaauauuaugaaaaagguccuggagaaagggagaauguuggaggcaaagaauccagagaaaagcugaguaggguuuaagcuaagguuaauugcagggagaauguagaagaaauauuuaggcaguaaaaugcuuaggaccagucuggacaacaaagcgagacccugucucuacuuaaaagaaaaaaaaaaaaaauuagccaagcauugagggcugcaccuauauuccuggcuacuugggaggcugaagcaggaggauuccuugagcccaggaguuugaggcugcagugagcagccugggcgaaaagagcaagacccugccucuuaaaaaaaaaaaaaaaaaggaagugacaugcugauuaaaguuaggagccagucucaaaugacaucuacuuuuaugcucuguuuugaaagguaauaucuuaucuaguaccaagaauaaaacacaaaaccaccuuuuaaggaaaaaugaguucgguuggaugacuuagcuccaguuggcuauaauauaacuugaaauugagaaauauauuuagcauucucauaauuaaagauggcauuguugacugacaaguugaaaauagaaaauuauucauauauuacauuuuauuaaaaaauauuauuaaagcauucucaugauuuugcacucaauuuaggaaggauuaggucugcuauaucucccacuuuguuauucucucaaacuucuguaccuguaguauaucucauuacuuaagcugaacaaaacguucauuuuuuguaaucagacuucucauccuuaucaucagauugucuuuccuccuuugguuuauuuaagaagugugcaucagcagcagccguuaugucuuaugauggcauaauuucaaguguucuaggggccuaagaaguuauccagcucucauuuugagaugagagaauucuugcugacuugcccaaagucauagcuggcaaaucuaggacuugaacaugagagucuguauugggggaacccgcccccaauauuucaacguagguucuuucuauuuucccuaagcauuggccagucugagaaaaaaagagaaagaguacaaagaggaauuuuacagcugggccucuggcggugacaucacauauugguaggaccgugauguccucugagccacaaaaccagcagguuuuuauuaagcagguuuuuaucaaaaagggaggggaugcaagaacagggaguaggucacaaagaucacaugccuuaaagggcaaaaagaucacaaggcaaagggcaaagcaaagaucacaaggcagagggcaaaauuaaaauuacugaugagggucuauguucagcugugcacguauugucuugauaaacaucuuaacagaaaacaggguucaagagcagagaaccgaucugaccucaauuucaccagggugggguuuuuuccccgccuucugagccugaggguacugcaggagaccagggcguauuucaguccuuaucucaaccgaauaagacagacacucccagagcagccguuuauagaccuccccccaggaaugcaauucuuuucuuagggucuuaauauuuaauauuccuugcuaggagaagaauuuagugauaucucuccuacuugcacaucuguuuauaggcucucuguaagaagaaaaauguggcucuauucugccuaaccccgcaggcagucagaccuuaugguugucuucccuuguuccuugaaaaucgcuguuguucuguucauuuucaaggugcacugauuucauguuguucaaacacacauguuuuacaaucaauuuguacaauaaugguccugaggugacguacauucucagcuuacaaagauaacaggauuaagagauuaaaguaaagacaggcauaagaaacuguaagaguauuauuugggaacugauaaauguccaugaaaucuucacaauuuauguucagagauugcaguaaaaacagguguaagaaauuauaaaaguauuaauuuggggaacugauaaauguccaugaaaucuucacaauuuauguuccucugccacgguuccagccagucccuccauucaggaucucugacuuuccgcaacaagucugcuaacucauuccagugguuuuuuccaacugcaucucaguuaucuuacauagacugcaagaagugagaaagacaagagguuaucuaguccagccuugcuauuuuauaguuuaaaucccucaaccacaucccugaugaacuuuugccaggccgguaauuaacaauaucacaaggcuguucugauugucuguauuucucaguguuuguuagagcagggauguccaacccccaggccacagaccaauacugguccaaggccuguuaggaacccagcuguacagcaggaggagagcauuacugucucagcucuacuuccugucagaucagcugcggcauuagauucucauaagagugcaaacccuaguaugaacugugcaugcaagggaucuagguugagagcuccucaugagaaucuaaugccugaugaucugagguggagcaguuccaucuugagacuauuuccccaaccccccaucauauggaaaaauugucucccaagaaaccagucccuggucccagaaaguuaggggaccauuguguuagagaacuaaggaaaccguccucuaccugccacauaagaauaaaggaaacaauggaacaguuucccuacuuucccuaauuaacacguauucccauuuugaggcagugaguugcugguaccugcuuucuccuucuuucuccaaauaguacuuuaaaaguaucuuauccuggcugggcacaguggcucaugccuguaaucccagcacuuugggaggaugaggcgggugaaucacgaggucgaccauccuggcuaacacagugaaaccccgucucuacuaaaaauacaaaaaauuagcugggugugguggcaggcaccuguagucccagcuacucaggaagcugaggcgggagaaugguguaaaccugggaggcagagcuugcagugagcugagaucgugccucugcacuuuagccugggcaacagagcaagacuccaucucaaaaaaaaaaaaaaaauaaaguaucuuauccuaaaagcacuucuguuuuugguuuagguuuuagcugucuuugugcugcguaagcguugucucuuucucaggaugucacuucuggaggcaggaaaggguuaugguuaaugcuaaucacuuuaucaaaaugucugauuucucugauguauaauuaauauuuuucccuugcaacuaauaagcaacuugugggaguaagauuuuuacuuuuaaaagcauauccaaccuucuugugucucaaguuaaugcucgggaagcaauaccugucucuuauauuuugaaguuauucuuucuaaggccuaagauauauacccaucaaauuaugcucagaauuuuugucucagccaucacaaacccugaaaugauacgcuuuuccuaaguguuauuuuccuuaaccauauuuacuagagauuuggaauauauucaauaauaugcuaugaguauguuuucuucaaguucaauuauguguagaugucauuuagagaaacaguauauuuuggggggaauccacuuuaugugucccaucuucuuuccacauucagaucauguggauuaaugucauagucuaguaaaaagcuuguuucuauuuuauccuuaaguuuaaaauguuguucuuucauucuauuagcaugauucuuuuaguauacuaacauuuauguaaauaagucuuacauaaauacaguuauauaaacaaaucuuuagucuaauucuuuuaguauaccaacauuuauguaaauaaaucuuaguuucuguuccacguccuaagcugcuuuaccauucacauaauuccauauuccuccuaaguuuacuacaaagaagaauauuagauguauugauuaugcagugauacugcaucuaaagcugucagucaagaauggcugccauagcuaagaguauauacaaaucaucacuguuacuuuauuuuauuuuuuuaauuuuauguauuuauuuauuuuuuugagacaauuucacucugucgcccacacuggaguacaguggugcaaucuaggcucacugcaaccucccucucccaggcucuagugauccucccaccucugccuccugaguagugaggacuggaggcgaguguccccacaccugccuaauuuuuguauuuuuuuguggaaaugggguuucaccauguugccuaagcuggucucaaacuccugggcucaagcaauuugauugccuuggccuaccaaagugcuaggauaacggacuugagccacugugccuaguccugucacuuucugaaaaauccuaugaagcauuaauagaaguaaaaucacacuuaauuaugccuguuuuuaaaucugcauauuguuugauuaaucacaucuuuuggccaaguugaaggcauaauuuauauauugucuauaagaaucaauaaacuaguuucuaaauauguuuuaaauaaauaauuuaaaaauuaauuucucaaauauccucaacuauaaaguuagaccuauuuacuguuucuuguaggagccuauugcugucaaaaauaucugaaguucuauucagagaaaaauagaaaugcacaaugacugggacuuaagcugaggaaagucagcaacacuguucccaucauucuaccauaaauguggcaaaaucuuauuguuugugacagaucuauagaauuagauuuucuuauaucuaaagaaauauauauaaauacauaaacguagguauguauagcaugaacagaauacagugcuauuugaccauugucacaagacuuauuuauaaaaccuccucaagcucuugccaauaucuuaguuaagauugcaucuaaggugggaggaggaugaagauugaagaacugucagguaaugcuugauuaccugggugacaaaauuauguuuacaccaaacccccaugacacacaguuuacccauguaacaaaccuacacaugucccccuugaaccuaaaauaaaaguuggaaagaaaaaaauuggaaagaaaaaaaaggaacuuaaagagaagaaaaagauuguaucuaguaguuuuacuaagacuauaaaauuucugacggcuccacuaccuccucaagauugagaacuaaacaacaugagaagcacaauuacaugccaaagauucuuuuugcugucuucauuuguagcaucccaguggaaugucuuugaaaaaaauuuuuuuuaucuguauuaucucaccugcucugaguauuggugacagugauauaugcauugugauuagacgccuagccuccugaauauaauguauuuccaguauauuguccuucugaauagccuguuuacaauucuuugaacauugccugccaauaauuuagcaaauuguuauugaaugucacagcuugauuauagaacauaguaagaaaucaacaaauugaacaccaaacugaauuuaaugcuaaaaauuauccuuuuaaaaaauaauguauuacuaauuuuuacucaugaaauuuaacauuuccaaucauugcuuaguuguugacucaacacucaaaaauaauauaugcuacuuuuaaaaucccaaaaccuccagauuuguguacugccaccagguguugacaggugccuugauucuucuaguuugugguuccagagauaaggucaggguccugauacagcaaaaccaccauuugucuuuguuaaacugaaaugagaaugcguuccuuauuggaaagaaaaguuacacgguuuuauuauuaucaucaguacuuagagaagacuuaaaaaguacaacuuaaaaugaacucaaaguuucugugacuaggaaaugauaugacucagggaauuuaauacuugggauccaaaacaaagaaaacaaaaugacccauaaagaaccauguuguuuaugagggcaaacuauaguaagcaaacaauauuaacuucaaaugagcacuggagaaaaauccugauucuuuaaaauuguuuuuaauauuauucucuuaaacuuagugauacccaaaaaagaaucaaaauuuuguggagaggaauauaauaacugguugucuuaucuguauuaacaggauuuuguaaaagcauuauuauuucugucaauugauuuuuaaaacaucuaucaacuuuuuuucuuuuguguauagauaucaauguaucucauagauugcuucccuuuuuuaaauuaaaaaguauaaaucuuuauaaaaauuaacuauaacuuuaugaaaguauguuuaaacuugagcagauuuuguaaaaauuuaauguguagaacauguguuguuuucagcaacagcuuaauuucuuuagucacuuaaccuuuuuuagacuuuuguuuuuaaaaauauuucuuuuuuucacucugaaucauaccuaggaaucaagucucucuagccuuuguaauauauugaaaagacuugaaggccauuuugccuucaaacuuuuuuccaggaguuuguccuuaaaccucuaacaucuuauaaguuuccucauaguuuuucacauuucuguuuuaugugugcuuccaauuaagaugguauucuucugauuuccuauuccugugucuuccugcuauguggagucuucacagauuuuuagcagccaggccaggagauuguauuccuuccuauauuggcagguuggauucccccugaauuaacucuuccauucagaggcugccaccguucuaguucgugucuugaagaauuguaucacccuccuaacugauauuuuaacaauagcugcaaacuccuuauuauaugacacuuaaauagcauaagagcuccuuuugcagcaccugacaucuuuugagguuuauagauuuguucaaaaugaaggauguacaaaaauauuaaaaauuuaacuuuuuaaaacuuagauuaagauggcuuuaugccaugguauguugcuaucuacuccucccauugucucuugagcccacugcauuccagcuuuagucccuauccucggaaacugcuguagucagucugugacuuuuguguugccaaauucaguugucgguucuaaggugucaguuuuacuuaaucugucagcaguauuugacagaguuggucuuucuuccuagaaacacauucauuugccugccggauauuuccugccuuacuggcugcugaauucuagucuccuuucuacauccucaucuauuuggucaucuagaaauguccuagggcuuuggccucuucuaggcgucacucccaaagugguauucugcagucauggagaaugacacaucuguaggcauaugacucccaaguuucucagcaccugaugugauguauacuuauuuguucauucccucucuccuuucuccuaaauauaaacucugugagaauagggacuuuguuccuguucaccacugugucugcaaugcauagaacaguaucuaacacguaauauauacucauacuuuacauugaaugauuucuuaauuuaugggucauucaucauuaaucuugaucauaauaaugaaucagccgaaaacagcacuuuuuuuaagaaaaguguguguuaugucuaguuuauuucaauaauacuaagacaacuaucuccuuacuaccugaauuuauuucagcacaaccgauuaauuuuaauugcuaugaguuaaaaacuuuaaauacagugaguuuuuuuaaauucagauagagauguuuuuuagcuuacugcuuuuaaaagacugcaauuuaaagguucuguuaauucuucaaaaaaagauaaauuaagugcuucauuuuccugcauaguaaaucauugacguuccuaacauuuuuucaauaacuuauaaauuuucuuugcuuuguuuguguugugacacguuguguaaaugagauuugauaucagaaguaggaucuacaaaacaaacacuaaauacugggguuaguacuaacguuuucacugaagauggacccagaaaaguagccaaacacagugucaccccgaguccauucugagauacauacuggaaaauuauaguaaucgguucauucaggaaaccaagugacaauagguuaagccaugaguaauauaaguaauauaaguaacauuucuuuaucuuccacuauuaaaaaaaaacuuguaaaucuuuauuuaaaugaacaccaaauuaaagaaaacugagccaaagaaauguaagucuaaaaugaaaugcucaauuuugauuuaucagagauauaagccuuacuaaguuuuaaguuaacaaauuuggaccuuaacacauauuaaucuaaauuaauuaauucgaccuuuguuuucaguuuuagagaaauguaaacuuguucaaaaauauagcagaauauaaacuauuuaaaauaacaguuuauacuugcauaccauuugaaaugcuuuguuuuugcuuguguucucugcuaaauuuuuuuuccauugaaucugugcugcuucuuugccaauguuuuccacuguagaaucuccaucucgcaaccuugcuucucgugagcgcauuuacaaaaauuaugguguagcugggccugccucugcucucucaucucugucucacaaacugaaggguggguauacaugcauucauggaugggccauucuuaaugaacauaaggagugucauuaaagauguuuccguucgucucagucauguucaugccauuccauuuuuuuaauuaaaguuuaucauuuuauuuacauuuauauauguuugaguaauuuaugaugcuccuauucaguauuauaauauagauuaucccaguagcuaugcauguuuauuacaucuauagguuaaacauuacucuuacuuaauuuuaaaacuuuaugagaucauuaaaauuaaaauagguauaaggaaagaauuaccuaauugggggaauuuuugaaaucauuuuuaucagaaaaagaugauauaugugcaaggcauaaagcacauuuuuuagucuuaaacuuauuguuauauaauauaaaaaucauuuuacuauuuuagucuuuuaugagaaacacugauaaugaacuuaaaguuuuuaaguuuaaauuaguuauuaggacucaugugucuauuuauauuuauauguaaaccuaccuguccuaucuggcauaaauuuuucuaauauuguuuuccuagugacuaaguuuuaauauuuuaaacuuagaaauguuuaaacuauugacaauugacaaaauuucagacaauuuaaaaauauguuuuugguuuuuugaaacacuacagaugccuacuuaaauauuuugucuuaaaguauuauuuaauuaaauuuaaaucuuguaaaucuuuuaaaaucuuguauuuaaauaaaauuuuaucaaaaagaacuuuuacagcaaugccuaacauauuguauaaguuuuucaacuaauuacugauuuucuuuuuuucuuagaaauagauaaaacagcuauauguuucucauuauacaauugacaguauaaacauauaaauaggaaauauaaaaauauacuaaauaguauuguacaaccugugcuauauaguauauaguauuguguguaauagcauauaguaucauguaaccugauauaugcuauauaucaugccaugugauauaugcauauaguauuaugauauaguaugauccugauaauuuaagauuugggcaugaaaaaauguaugggucauuuagugaaugaaugcuuaccauuuaacauguuuaguaacauuuaacuugcuugcccuaaguuucuauccugucauuauuauuucuucagguuuccuuuaaaguuagaaaaauguuugcauauuaucauuuaaauguaaaaguacagucauuaaauaaauuaggagaugaaugugaaaguauuacguauagucugaagauuuuuagcaaacuguuuauauuuguugguauuuugagcagccacaacauacaauuuuuaguaauauuuaauaacaugcugcaaaacauuugaaacacaaaugaagcagauaaacauaaauuagcacaggggcuuaccccacuuaacaagcauaguuuuuuuuaauauauaaaauacguuuuggaaaaauaaauuuuucaaaaagauuuaguuaucauuugagaaauacaucugaaaaagaaauauuucugccauuauuuguaugccuaaacuucaacagguauuuagcugucaccacuuacagaucuuaagaaaauauucaccacuauuagagauauaauaagauauacaaaugccuauucuuucuaacacuauguaauaaacuuuuuugcucacauaugacaagugguguuccugguauuuggcagauuccauuuuucaggcaaccacagagguuguuuucaugaugaguaaauaaccuaccauuguaaguucauaugcauuccuagaauagagguagcaucagcagguauucaccauuccuuugcaugcagcuguugugcaggucaaccacuaagacacaucugacacagggaguagguaaucuuugucacgaacccuuccuauuuguuagaaauccuacacaaguuguccuuuuuuauaaauuagagagaaaaccucuuucaguuuacagauggauuuuuuggagaaagggauaccaaauauaaaagacuuacuaauuguuugucuagauucccauuaugugugguucaguuucugaaauaaaugugaugauaaaggugauaaacaugucuccagcugucagauuaauaacaaaaaacaaguauuccaaacaucacauacucaaaauuaauggccaugacuacugauuuaaucuaccaaauauaauuuguuuaccaaauuugccauaugcuguuacuaggucaguaagauuagauggguagcaauuuuuugaacuacuuuugaacaguuuaaggguacuuauucauagaucacaucuguuuaucugugcucucccaagacagcauugauaguuagaauucuaaauugggauuuuuuuaacccuuuuuucaaaacuuagccccaucuguuaauacuguauuuauaaaacagagcacauaauaugauaaaggagguuaaugauugaauaaugaagcuuugcaagaaacuaaaaagcauuauguuuuaguuacuuuuauucauccaaagaacaggaaaaauuaucuuaaauauuggcauguugcaauuaaacauuuaguucaucagugugcccuguauaaaguacuugccauacucuauuauuucaccauguaauuacucaguuugcaagcaucuaacccuugcacaucaauaacuaaugucaccucuguccuguggccuugggagccuuaauuguaaaaaguagacuucuggagaagcugaauacuugggaguagcagaagaaaaaaaucaagaaaauuggaauauauuacucauucaacacauauuuauugaauaccuacuguauuccuggauucauucuugguauuacaucagugaagaguaacagacaaaaauaccugcccuugacaaagacuggggcagauucuccagcacuacuguccugagccauagagaaauagagcgugacuauacacacuuaacacaugcacggaagcauaaaaaacauuuuccuacaucaucugaauuuguucacauccuuuuuucuuuuaaaaaauaauaacaugcaguuauagccaguuaacaaaucuaccuuaauuuccuaggaacugucuuugaaaaaauauaaauacuuccagauagguuuauggauuuucaguuuuuuauaccacuugaaacccuucagucagauugcuuuucuccuaacaacuaacugguaucacuugcacuaagaguagaaguuuuuauuuuaaggaggaaaggugauguugaaguuuguaccauuuacuugggucacagacagccuggcucuaaugccucaaagaaaagcauaaaauagaaugaaggagagacacugaaugaaggcagggugcuaaaaacaauuaauguccaugcagaaacaucuaaugcuuugccuuagaaaagggaggugauucuucuuuucauccuguuuuucugucauucuccugacuccuuguuuugaggguccacaguucagacuuuuaccacucauucugaggauccaccguuucugugguuuccaagggaacacaggcucugaguucuaagcagcuaagcuuccugaacuuuuggaguguaaccuguuuauaaauaauuaaauaacagcuucagggcauucaugugcucauuguaaacuagucuaaucugaucauaaaacagagugccucuuaagcaacucuuuguuagccuaauuguaugcauacacuuaaaaauuauaauugugucuaugcauaaauucaguucucuaauucaacaaaacccauaccguugcccuaaggaugcgagguaucacucugcuggaaauuuagcucuacucuacauuuaaaauacaaguuuucacauuaaauaauuucuuauuccccaaaagauuaauuucugucucuuucuagucccucacugaauuuaaauucuaacuaguuauugcacuagggcagagguugagauaucacugauaguucacacuggauuuguucaaccuguuguuuugcguccaugaaaauaguuuuuggugguaauguuguguaaugauguguagaaauuuuauuagaaauauuucccccuucuuuccuuuauucuucaaguauuuuaguauguaugacaaacaauauaaauuuuguagcuauguuuuuuuauuucaguguuuaguggcuaaauuaucaguaaguuauaauuuuauuaauaaguuucacuguaaaauggaccauacaggugaucgaggaaacaucucaacaucuucuaaaccagccucuacaucaggaaaaucagagcuguccucuaaacacagcagaucgcuuaaaccugauggacguaugagccggacuacugcugaucagaagaagccaaggggcacagaaaguuuaucugcuagugaaucccucaucuuaaaaucugaugcugcaaaguugaggucagauucccacaguaggucauuaucccccaaccauaacaccuugcagacauugaaaucugaugggaggaugccuucuagcuccagagcugaauccccaggaccagguucucgguugucaucuccuaagccaaagacucucccagccaauaggucuagcccaucgggugcuaguucuccacgcuccuccucaccacaugauaaaaaucuaccucaaaaaaguacugcuccuguuaagacaaagcuugauccuccucgggaacguucuaaaucagacucuuacacacuugauccagauacccuccgcaagaagaaaaugccccucacagaaccuuugagaggacggucaacgucaccaaaaccaaaaucaguaccaaaggauucuacagauuccccuggaucugaaaauagagcucccucuccccaugugguacaggaaaaccuccacagugagguggucgaagucugcaccucaaguacuuuaaaaacaaauagucuaacagacagcaccugcgaugacagcagugaauuuaagaguguggaugaagguucaaauaaaguucauuuuagcauuggaaaagcaccacugaaagaugaacaggaaaugagagcaucucccaaaauaagucgaaaaugugcuaauagacacaccaggcccaaaaaagaaaaaucgaguuuucuuuucaaaggagauggauccaagccuuuagagccagccaagcaagccaugucuccuucuguggccgaaugugccagagcuguguuugcuuccuuccucuggcaugaaggcauaguacaugaugcaauggcuuguucuucuuuccuaaaguuucauccugaacuuuccaaagaacaugcuccuauaaggaguaguuuaaauagccaacaaccuacagaggaaaaagaaaccaaguuaaaaaauagacauucauuagaaauaucaucugcacugaauauguuuaauauugcaccccauggaccagauauaucuaagauggguagcaucaacaaaaacaagguauugucuaugcuuaaggaaccaccucugcaugaaaaaugugaggaugggaaaaccgagaccacuuuugaaauguccaugcauaacacaaugaagucuaagucuccucuucccuuaacuuuacaacauuuaguggcuuuuugggaagacaucucuuuggcuacuaucaaagcugcuucccagaauaugauuuuuccaaguccugguuccugugcaguucuuaaaaagaaagagugugagaaagagaauaagaaguccaaaaaggaaaaaaagaaaaaagaaaaggcagaaguuaggcccagggguaauuuguuuggagagauggcccagcuggcaguaggaggaccagagaaagauaccaucugugaacuguguggggagucacauccauacccggugaccuaucacaugagacaagcucacccagguaaaugauacuguugaauguacguauaagugcuuuuuucuuuaaugaaccagaucacuuuauuugagcuguucuaugaauuuugucaaaggauagggaauuuauaguaucuuagaaugucauuuuuaaaguacauuaucaguacaggguuuugugaaaaacagauaaauucuaauauuaugauggccaggucauuuagugcuauuucacuuucauguagcauguuuuaaaaaauauuauguguuacccaaagggugugccauuaaugugucugucucacacagcagaaacaguggcaugcccauacacacagggcaucuccuuugauuuuacuauuuuccuguucagaauugcaaauuaaauuagauuagauugauuucuauaggcuuuuuccuacggaagugauauuguuuuaucagaagacugcauuuucaguaaauguaaugauuucuguaacauugacuaauauuccaaauucaccuaauacaaauuugguuaauuuuuuucuuugucuacauauuauaccucaaaugucuuaugaauaugugauuucugaaaauauaucauuguuauagaacuuuuauacuuguauugucuaauuuuauugacauaauuaaguauaucuaaauauaccuauauucuaucucucuuuuaauaugccugauuagaaacuaaguaucucucauauuuggggcaucauuuaauugauugcuuuuugaucaaguaagcuauuuuucugauauaguuaauagccugaaaaauaagauaucuacuucaguauuuugcuuucuuugagaagguaaaucugucauuaauguaugaguaauaaggaucaaacuauuaaggacacuuggaguguuaaauauuuauuuuugguauuguuucaagguuguggccgauaugcugguggacaagguuacaauagcauugggcauuuuuguggaggaugggcugguaacuguggugaugguggcauaggaggaagcacuugguaucugguaugugaucgcuguagagaaaaauaccuccgcgaaaaacaggcugcugcaagggagaagguauuuuauuccauuuggagcuauacuuuuaaugauauggauacacuguauaaaaauaccuuguuauaaucuuacuacaucagauaauuccacauaguugauauuaaaagaucagcuuuuauaauggaaaucauauacaaauuuaauauuuguacuaagucaaaugcuuuuaauuuuaaaaauuaacuauauauuggaauaacacuagauaaccucugcuacauaugccuuauugacaaauauuuguuguguaacucuuuauuauuaauugucuguuauucucucuauggagagcuuuccuuuucaccuucuuucucuuuuccucuuuuuuuggcuccuuuguuuuccuauuccauaucuacucucucuuuucuuuauucacucuaguggcaccuaacuaaaaaauuucacugaauacacgcacugaaaugauuuacuuuuuaaaaaaaugaauuacauuuagauuuaacuaguuagguguuaaauuuuucugaagaaggaaaggaaguauaguuuguguuugauacaaaauugucuuggucagcccaggaugaauaugaaaugaauguuguuuuuuauaaucuuauuaucuuaaaauagcuuuacaaguguuuaauaauuuuuauuggaaacucaaaauacuuagcuuaagaaacuaaggauuuuaauguaagucagaaaagauuaguuugauuuuuuucuucgccaggucaaacaaucuaggagaaaaccaaugcaagucaagaccccucgugccuugcccaccauggaagcucaccaggugauuaaagccaaugcacucuuccugcugucccugagcagugcagcagaaccgagcauucuguguuaccauccugcaaagccauuccaaucucaguugcccaguguaaaagaaggcauuucugaggaucuuccugugaaaaugccuugucucuaccugcagacauuagcuagguaauaaaauuuugcuguuguuuuuuaaucaccuuuggauuaacagcgauuguuuauugauaucuaggguaguucgguauuugaccuacacuuuauuagcuauuguguacuauaaacaaacuuccaggcauuuauuuuuugaguugccuugacugacauaaugacuuuaugguaauagguauuuaaaaaacuauaaaaaugcuucaucaauuugcauuguauuaauacacaacaugucuuagaaaauaagacuauagcuaucuuuuacucuuugguaggcugacuucacucuguuagugcgaaaugcugaaguguaaagaaaguguguuuccuuagcagucuuuuauuucguaaauuauucauucuguuagcauuuaaaugaauaccaacugggcaccuaccagccuugugcuaggcccugaauguaugaauauaacaaaauccuggcuucuauguacucauacucggaugucaagucagacauguuagugaaacauuugaaaugccaugugaggagugcuacaauagaaguauguauguaagaugcuguuagagcauaaaagauggagaguaucugaaucuuccccaggaaaucagaaaaggcuucccagagggucugagccuuuaguagagucucaaaggauaaauagaaaucugucaggcaagcgacaggaagaaagcgacucuuggaagaauaacccaggugaguaaagacacaaaugaaaucucauuacacauuucaggaaucacggguuguuaaaggacuggcuacuggaggaaauaugugaaagcccguucaaagugauugguucacccaaguaaugucgggcucuguagcccagguuaagauugcauuuuaucccaugagcagaggaaacaguggaagaauuuuaaacagagaaauacaugaacugguuugcaauuaaaaaaucacuguggaauguggaagcuaauguggagacuagauaaaagugcauuacuggagauagaaaccuguuaguauucuguuuucauauauuggaccucaguggugcagccuguacuuucacacaucaugcacugacacuccaaaagagccuuucauauaccaaaaccaaauuuuuuucaucagcugacaaaugaagguaaucuagauauugcccacugacauggcuugccgaccaacaguuccauuuuggaaauuguccucuuuguguagcagaguuguaugguuuuuaaaauuuugugcuuacuauuacaauaaaaugaauaagcaacaaaaaugaaaauaucagacuaaguacauuugagacugagguggaaaucaucaguaugccaaaauacaauagaucuuuagugugaaucacaccacucaguggacuuagguuagcaacuauuuguucauuuugaaaaggaaagaaucaaauuguaaaacgugaaaaaugcuaacacagcauaauuauagauuuuuuucuuuuuagcugucuggggaaugggcaccccuuccacccugaaccacagaaaauuucauauaucuaauauuuuucaaauaugaucuuauguauguuccuacccaaaaaaguaacugcuuguauuucaguggucugugcaagaaauaauaagcaugaaccaaggcagugaugauagggaaugagaagagagaauggcucugagaggaaaccuaauaucaugggcuugaaagaugaugaugauagagggcuaagccuacuacaacacuggaaauauuuuagcuuaagcaacuggaugguuggugggcuuauucaccaaaacacuggaagauggaaaaguucucaaaaggaaagaaacugaguucaauuuuggauuugaaauguucgugguaccuggaauguugaugaauaaaauuaucagacuuuuauuuucaccuaccuacaucuacgauuauuuuaaugcuuugccuuuaacuaugauuuacaugugcugcuuuuccuguuaugaaagagauuaaaaauggagaggaucuguauugccaucaugcuuuaaguuauuggguuugauuuaaugcaggcaucaucaugaaaauuuugugggcuaucaagaugacaaucuauuccaggaugaaaugagauaucuacguucaacaucuguaccugccccguauauaucaguaacuccugaugcaaguccuaauguauuugaagagccagagagcaauaugaagucuaugccaccaagguauuuuaguucucuccugucuguugaauagcuaguguuugguggaagaaagacuuugaacuagaaaagaguccuguagaaguucuuuaauacaucugugagccaguuuugcuaacugcuggagcaguaagaaaaagcauacauguaugacuaagguaagguccuugaugggagaggcagacuaguuggagagaagagaucaacuagugaaggaauuaaagauuacauuauaugacauuacuuaaugcuguaguaaaucagaguagggaaggguuacuuugaguuuucaugggagcaguggcauugaaaauaaaucuuaaacuucuuggauuauuguuuacagugccuccuaacuuagguaugguaguaucagaguaaagagcuucucggaaagcugaauagaaacuuguuacaauaauguaauacacaagaaaauagaggccaggcgcuguggcucacaccuguaaucccagcacuuugggaggccaaggcggguggaucaccugaggucaggaguuugagaccagccugaccaacauggugaaacccugucuuuacuaaaaauacaaaaaauuagccgagcauggugacacacaccuguaaucccagcuacucgggaggcugaggcaggagaauuacuugaaccugggaggcagagguugcagugagcugagauugcaccacugaacuccagcuugaggaaaaaaaaaaauagaguaccacugaaacuuuuuuagaggacgaaugaugugauaaaaaugcaaagguagucucacagugacaauugagaagcugacauauggauuaaagagauauauuuuguaggaaaaauaagugugacuuguugacuaacuggauaaugaaaaagauaaguuuaagaugacaugaagauuucagucacgaauaacugugaacaugguaucauuggaaaggaagacauuugcugaaugaaaagagaaugugcuuauuaaaagagcaugccacuguguuacuacuauacaacuauaauuauaaacuaauauaauaaauacuuuaaugagcgcaaugggacauauauauccaaaugagguuuuuuuuuuuuuucauuaaaaauacaugcaacuucuccccuccccaacuguguggauuacucgucagaauuucuuugaagcugcucuugacauuuucuccagagugcagugcaaccuuuuauaucuuuaaaagugauaaaguauuucuaaaggagauacacuuuuuaaaagaguuagaaacuguuuugaggcuagucugacaagugugauucucauuggguuacuauuaccccuuaggaucaaaauccaggaggcugaggcaagaggauggcuucagccuaggauuuugagguuacagugagcuacgauugugucacugcacuucagccuaggugacagagcaagaccccuucuauuuaaaaaaaaaaaguugaugaauaaaugaauucauuaaaucagugguucucaauugagggugauauuugccucucuguugacaucuggaaauauuuggaaauaacuuugucacaacugggcuaguugagugggcauccuagugaguugaggccagggauguugcuaaccauccuacaggaggcaagacagccuaacaaggaauuaccuggcucaggguagccauucaauuaaagaugucaucuuugcuuucuucuuuggauuuucuuguguugcuugaauucuuucacaagcaauuuuuuuuuuuuuuugguaaaaagucacuuuuuaaauuuguguaauuuuuuuuaaguuaguagaaaacuuccucugaaaacagaacaaaugucugugcuuuauaguaacaccauauauaaagugaauuaaguuaauguuucccuguauucuagucauucuggaaccaagcaaccuauacuaacacccagggacauuuacugccaaucaguuauguacaguauuuauagucuauucaaacaagaauguacauaagcuuagagaaguggugaguaaagaaaacaccuaggcaguuagccgucuauuagaaaauagauaauuuuaccaagggacacaggauuucaaaccuggcuugaaugauggaaaaaacuccagaaccaacggugagcaaaaauauuccaauuugaauucaggugacagaaaaaggagcucacgaaaagaauaguuucuaaauuuguuuuagagaaauaagaaagagaagggauuucucuuuuuuuauaaaaugugucaauaaaggaaauuguauagcucucuuaauaacuuuguaaguauuuuuaaauguugcuuuaauaaauagaaaagcuguuaguuuacuuaagccugaauaaaaccauuaaguucuuuuauagaguguaaauacaacacuggugccaaaaaucaguuuguuaccucucaugacaccuugaugcagccauccuccaagggcuuugggcaacauuucccaagagugagaaaccucacagaacacugaagacaccaaaagaaaacuuuggaaccaaauuuugcuuccuguuuuauuagguuuucauguguacauauccauuuucuuucuauuuggugcacuuacgauuauaucugacuguuuuuccugaauauuaugauacaugaauuccaccccagugcuuuugauucuaaaaggagcuuggaaaccuuucuucuuuuucauuuaaaauacaaaguagauuuaagaaaaccauaaguuuuaagguacaaugcugaaaucagucaaaauguuacugcauuugaaaagaucaaauuaugauuuaaagagagauuaucaauuuggcuuugauuuuguuucuccacaugaaauauugagucacauauuuugcaucauuauaaguauaguuacauuucauucagcucuucugaguuuguaucuguugcauuguuccauguacaguuuagaaaccagucccauaacugauacugaucuugcaaagagaacugucuuccaaagaucauacucaguuguugcuuccgaauaugauaaacaacacuccauuuuaccugcacgaguuaaagcuauuccuagaagaagaguuaacaguggagacacugguaaguaugaggauaaaaaagaauauugagugaucugacuacuacaaauaaaaaaauuguuuuauuugcauauaauuuuuaaaauuuaauuuuugaaggaaaaggcaugggauaauuucuaaugugugauugacauuccuucuauaugacauagcuauaaaugugcaucucuaaauuuugcaucuuaguugaagggaaaucuggagaucauucagugauuguucgagaauaaauugaccuuuacaaucuuacuuguuagguaucuaagccaaauguuacaaccauuaucccuuccacuaaacuuuuguggaccaggaguuccaaugacguacacauucacaguuaucucuccaccccaacugaagcuugauaacucuuggagcugccaucauucuaaguagauaauaaaacuuuggggauauaaauagcccuuaaucgauuuaaaaaaaaaaaaaaaacaguuacaugaucuggaccaguugguaucaacagccccaaauuggagcuggggauucuaccucaagaauaauuuuaaaaacccaagaagaacaggguaauauagugaucaauuaucagagagaucacuugcuaaaaugaagauuuggccuaaaaauuauagucagaugauuaaguuaucuuacugaagacuuuuaagaaaaacauuauugaagauuguccagcaauuuauagguucauucaacaaauauuuuugaccuccuguuaagaaauguuucuuauaaagccaucuuuuagaaaaugaugcagaugagauguagauuucauuuagagaaaauauaaaucacuuagcuuuuagaguguuuuagaaaaggugaacuuuagauucagcucugauucaaaacccaccucuacaacuuaauagcuauaugacuuucagagaguaacauauuuaaucuuucugaaccuugguuuccucaguaaaaguugaaauuguuaugauuugugucauguucaaaaaaccaaugacaaaggcuuuaagugaauauauuagauauuauuaucuuaaauauauaugcacugccuaugaaaauuaauaauuuucuuuuucuuuaauagaaguugguucuucccuuuugagacauccgucuccugagcuuucucggcuaaucucagcccacagcucucuuucuaaaggagaacgaaauuuccaguggccaguuuuagcuuuuguuauacaacaucaugaucuagaaggucuugaaauagcaaugaaacaggcccuaaggaaaucugcuugucgaguuuuugcuauggagguaugaagacauuaaugaaauuacugauucauugauuauacaaaucaugugaugauucuauuucacgaugccacuuuuuuaccaacagaaauugugugaaauuaaaaggcauuagccaauuaaaaguauuaaguguuccuauaaaaaucagacucuaaaguuuaugaauauaaaugaauuuagaauuucauauuuaagcacccuaaagaaauuuauuucuguauugcuuuacuauuugaaucuugagauuaucuuuuuuuuaaaagcuuuuuauacucagaaugucauuuuauuagaaugaaaugacagaguaaucauggaaagaagauaaggaguagggcuuuugagugguaaguugaccaguaauaacuucucugggccuuuggucucuggaaauaauaggauuacuguauauuacaggccuauauauaguaaaucuguguuuuuaucaaaugugauaaauaaccuaccacuucauggaugggaauuauaugaauauauuuaaguaaaugguugcuugccuagagcuugagauacacuuuguguucauccagaugcaaguuggaaaaaaugugcuugaauaaauuaauauuaaaaugaauuuucaaaguaaaaugugauuugaaaaaauauuuugguauuguaucuuauaaauuauuuuuccuguuuuuuuuaaauuaaaaccccaaauuauuaacuguuucaaguuccgugugcuuucagugaaauaaaggucagauuuucaaggugccaagcauaguagcccaugcuuguaauccuagcacuuugggaggcggaggagggaggaucacuugagcgcaagaguuugagaccagcgugggcaacaugugagaccucauuucuacaaaaaaaaaguuuuaaaaucagcuggguguggugguacacaccuguagucccagcuacuugggaggcugaggugggaggaucauuugugccugggugcuugaggcugcagugagccaugaucacaccacuguacuccaaccugggugacagagcgagacacugucucuuaaaaagaaaaacaaauaguaaaacuauaaggcauuuuuuuuaauuaaaaaagauuuucuaguaucuuucuuugaagucuuaauccauggagguacuuuauuucugaguacuuuuuaaacucauguauuuuauucuugaacucauuuaaccgucauuucuucaggcuuucaacuggcuucuguguaaugucauccaaaccacuucucuccaugauauucuguggcauuuuguggcaucacugacuccugcaccaguggaaccagaggaagaagaggaugaagaaaauaaaacaagcaaagaaaauucagaacaaguaaaugaaauuuuuguuuugauugugcauauuuuuauagaaacugguaguauaccuucaaauaguccaauaauuugcaugaaaucauucgcagaucuaacuugaaagcaaaaagaauauuuuagugcuaugggcaaaguauuaauaaugagaccuggauuuuauagaaggcagccuguauaauggagagagcauugaauuagggcacuaggagccugaguucagccucauuucuacccuauuguaguuguaugacuuguaggccucgguuuccaugucuguaaaaugaaaguaaucuaggugacauuuaucuuauucccagucacucugaaauuaugugaauggcauuuuagguuaauuuccaaggauaucaagcaacauuaucauagucaaauucuuaaaacucacaaacaagacaccaugagcaagaacuaacaaaaacaauagacaguagaaauagacccucaacaaugguuguaauuaucuauguaaauguagaauaauguguuaauaugcuuaaagaaauaaaagagaaacuuuaaaauaugagaagaaauuguaagaagaaauaugaagugaugaauuugauaaagaacuaaagaaaacauaaauacuaaucuaaguauaauugauauuuuuaguuuugagauuuuauagcaugucagugaaaaaauuggcuaaauauaagagaaugauggauucgauaaagaacuaaagaaaauacguaaaaauuaaucuaaguauaauugauauuuaaaaaacaaucaguuggacauuuuauagcaugucagcaaacaaauugguuaaauauaagagaccuguagaaauuaucuagacuucaacacagaaaaaguaaauaaaaaauacaaguugcuaagagcaaugaagggcaaaaugauguacaacuuaccuacuuggaguuucagaaggagaagacagaauggaagagagacaguguuuaagaguuaauacuugagaauuucccagaauugauuacagauaacaacccauugagucaagaagcccaguaaaccccaagcagaauaaauacaaaucaugguggacaaauuauagugaaucaccugaacaccaaaaacaaagaaagagaucuuuuaagcagccacagaaaaaaauauuagcuuucaaaagagggacagugagaauaauugcuuaauuuuugguagcaacauuacaaguuaaaauacugaguuuguuuaaaaggcugucaguugguuuuuuucaacgugcugaaagaaaauacuuguuaacccaguugaagggucuuugaagaacaagaccaaagacauuuccagaauaaaaacugggagaaauggccauggaguaucaaugaagagaaaagaaaguguaaauaugagggcauaucuuaaaaaacauugacuauguaaaaaguaaugauaugucauggugauguacaaaaugauaaaagaucaauccuggauauguaucuaccuaauacuguaaccuuaaaaaaaguaacaauugacagacugcaaggaaaaauaggacagucuacaguuacaaugugagauugucauauaccuguaacagcuaucuguuccugcauaacuaccccagaacucacuggacuaaaacaguuguuuauuugcugacagucuguggguuggcaauugcagcaaggcuccacugagaggaaugacucuuuccuguuuugguuacauagugugcuucaagugguacccccugagcucuuuuauccuccagaaugcuggccuagguuuguucagaugccagaagcauucaagaaagagagcacagaagcugcaaagccaaaauggcgaacacuaaacucauaugccaugcuucugccaccuuccauuagcuaguauaauucacaaggccggucaaauucaaagacugagaaauaaacuccaccuguugauggaaagagcgacagagaauuuguggcuguuuuguguauaguaccauaacacucuuuuuaguacuggauaggucaggcagagaaaaagaaucagaaaguacacagauuugaaugauugacagucuugauagaauauacaaaacauugcauauaguuguuuacauucuuuucagauacacacaaaugucuauggaaauugacuguuuacuggacacauaaagcaaguuuuaacaaacuugaaauaauugguuuucuucccaccauguccucagucuuuauugcuaguauauaagaauuagauaacaaaacaauaacaagaaaaauauuuauagggaaauuaaguaacgcuuccaaaugaguugcaucaaagaagaauuauaacagaaaauauuuuaaauggaauggcaauaauaguacaucucaaaacuuguuguuuggcagaguucuaguuauaguuacgaugaaacagccagugucagcauuaguucuuauaguaaguaacaaaaagcugggcaaaauauuuaaaacaauuguucauaggcucugaggagugaccaguacagggcuguaauccuugagagaagaaaagggcaugagguaagccccacaauugggaaaagagcccaagcagaguacgucaguuguguuggcagagaucaaaguuuaggacuguaacuuugggaugugggaagcagggcacuagugguacagagcugcagaaagggagucuaaaauuuuugcauaaaaauaucccuaggguccuggccacucuuagacugggcaugcaauuucucuggaggaucuagcaguggaaaugaauuguaagcugagaacugaacagauucuuagcuucagagcuggguucugaaguuuuaguccaaccagagguggggugagcgugaugaauacuccuggcaugcccuugaaaccccagaaagaccauacucaaggaauacagaccaugccuuaggaguaagggcagugccuaaaaucaagggcaaaacugaaauaaccccagucuaacaaagucgaaugccaagccuugauggaaucuagauggccugcuaucucccuguaagaacaaaacuacauucuuuagaagacaauauaaaccagaacuucuauaucaguagaagauaauauaaaccagaacuucuauaucaguaaucaauauaugcacaaagaaggaggcaaaaagcaaccaucuuuuacuuagcucagugacauaguuuaaaaaguuugaugggcuuacauugguagcaagauggaagaacaaacauucuuugcuguggaguagcagcuucuuagagaaugguuugguaagaucuaucaaaauucacauuaaaaaucauucaguaauuccacuuuuaugaaguucuccuuaucauauaugcaugugugaaaagacagauauacaaguugauucauugcagaauguuauauaaaaacaaaagauuggaaacaaccuaaaugacuguucugaaguggacugaugaaauaaacuaugguauuuuuauucaucagaauacuaugcagugggauaauauauguuacauacauaucuaauaaguaauaaucucaaagauaaauuauuguuaaaagaacacagaucaguuuguuuccagugcugccauuuguguaaaugaacaauauuuauagacaguccaagaaacugguaauagaaauugccagugggagggcaucuagguggcugggcuguagagacagggagacuuuuuaugguauuuuuuuauaccucuugaauauuuuauuaugauguguguuaucuacucaaaauaauaaaaaguuauuccauaguuaauauuauuaauggagccaucugaggguuguaaugagaaaugaaauucaaccccuacuucucuuuccuagcugugguccauuugcguagaaaggagcuuuuuuuucuaauucacauaaaaaugcuguaugaguuagugaccaccccaacuucuaaacauauguuauuuuuuauacauaaacauacacacaaaacauaccuacauauauguauguguauauauccauacacauacauauauaugcacacacacuacacauacacaugcauacacauguggauucacccuacagguaucuuugugaguacacuagaauugauacauuuauucauuugcaugcugauuuugcuugugacuaaacuuacagcuuuuuucccuaaaauaauacaagcauaauuaguuaaaauuacuguaucuuucuggguacaauuugguuuuguuguuuguauuucuguuacaugaccauuuuuuaaguauacauaauagucuuuugugaagaggauuccuuccagcacacaaacugauaaacuuguuucaauuucugccuuaggagaaagauacaagaguaugugaacauccacucucagacauagugauugccggggaagcugcucauccuuuaccacacaccuuucaccgcuugcugcagaccaucucagaccuuaugaugucucuccccagcggcaguucauuacagcaaauggcccugagguaauuuugguauccacauauccuagguacauuggacaagagaguuuauggaauauucaaaguaugaaaugcuccaaaaaaagcucuuuaaauaguaagauagaaucccuacauuauauagauggugccucccuccuuacagucauaauuuuuagaaugguccuuccucuuaguuaacauuuguuugcccuccuguaaaauguggcuaauguaauucuuagugcccuaaauuaucacuguagcaaucucccucacuuuccccagucuccuaccucaaaucacuuaaaugucccaaaaagagagagggaaaaugaaaucucaaaaacaaaaaccaaaauagaguuuugacuugaaaagaaucuuggggaaaacagagccugguuguaugcacccaguccuaaaagcaccuuaaggagcaucacagaugcucaacagauuccaauuucaauuugaaauguguugagaauuuagcauugcuuuuacacugugaaccuuguuacuagauucacauacuggacucacacuuauaaauaaauucuccuaauuaauguauacaagaaauagauugauggaaugcuugggcuucccauguuacuaaugauaagaccaguggaagagagauuucucuuuguccuccucacaagauuuuugaacuacaagauaaacuauacccugaugaauuaguauggcauuguaagaguaauaaauuugagggguuguugcaguugguguaccacuuguuuacacaauagauucauuacccuuuuugcuucuguagccuugaucuucaucugucuaauucuuuuauauuuaaaaugggucaacuuuccuuagaauuuaccuuguuccaaagaaguuaccuuuauuucucaaaaacaaaaacaauaggaaugauuuucuucccugaauuuuuaaaaugucuguuacuagaacauuaaaauuucuugagauauuagcuacagaguacucaucuaagaguuccuuagauguuccuggaaaauaauuauuucguauauugcuuauauaucgccuuuuuaggugcuggagucucaaauucaagcaaucugaucaccaguuccuucaucagagcaacgucuuucaucacauuaacaauauuuugucaaagucagaugauggcgauagugaagagaguuuuagcaucaguauacagucuggcuuugaagcuaugagucaggucagucauuucaguuauuauccugguuguccuguuaguuaauaauacaucaaaggagaaacuguaaguuauucauaaucaauuugauccugucuuccauuauguuuuaucuuauaccuguuuguuuuaucaucacgaaagauuugcuuuuaaguaucauaaguacuuauauuuguuucugauaggaauuaugcauaguaaugugcuuaaaggacuuaaccagcauuguugacauaaaaacuucaagccgaccugccaugauuggcaguuugacagacggcuccacagaaaccuuuugggaaucaggagaugaagauaaaaacaaaacuaagaacaucaccaucaacuguguaaaaggaaucaaugcccgcuaugugucuguucacguggacaauucccgagaucuugggguaagaaagcaaacgugauuuacggcucuuuagcucuuuucagaucuuaguauucaugcacuuucauuucugaauuuagcaacaagcuuuaucaccuggaauuucaccaaccaaacaucauugcuauaauccccaaauaaaucuuaagucuaaaaacaaauuaauaugauugggagcacuguggaauuccauuucugaaaagaggucugauuacaaauauaccauggcuacagcuaagcaaaaugaaagucugcucuacaauuuucugcugccauucccuugguuaagauuuucccgugaccuggaaguccuccccuuaaacucugcugaucaauucuuccagggucucucaaacucagcagagaaauucuaaguaacuccucuaaaaaauuacucuuucccucugcugauucuuuuuguauuacucugguggcacuuaauaauaaucuuugaccuauaguguaaucagcuuuuuuuuuuuuuucugagauggagucucccucugucacccaggcuggagugcaguggcacaaucuuggcucacugcaaccuucgccuccagguucaaacgauucuccugcuucaaccuccugaguagcugggauuacaagcacacgccaccaugcuuggcuaauuuuuguauuuuuaguagagacaggguuucaccauguuguccaggccggucucaaaccccuggccucaagugaucugcccaccucagccucccaaagugcuaggauuacagacaugagccacugcacccagccuaucuucaagugucuacuuugccacaguccucaugaaauaaaaaauaaguuucagacugucccaaauaaucauaauuuauauucucuucagccuaguucauccauguguuucaacugaauuaaauauucuuuuauaaaaggcacuaaacaagaaaaaagaguccuauuugcuugaguauuaacaaccaagaaagaaauagcacuaacugccagacugccuuucuucuaccucauuuagaauuuuuuuccucagaauggauguggcuugcuagcagauacaguauuaauggcucuccuugaaccauugccuggcuucuccugugccauuugcauauuuccuuucucaggaagagccacagugguaggauugggucucagauaaccuggaugcaggccagucugcaaucagagcaaccuccaacuccuguacaucagugcagguucuauuccucccugguauugaguaaguaaaagaggcuuagcuaauauaauaugagcuauuuccuccucagaccuaagaauuuccacugguguaacuacuuuaucuuacuggaaagucaaguguaacaaagcaaaacauuuuuguagcuagaacucacuguucagugcaaagcuaucuuuggcucaugguacauuuuaagcaaggacauacucucccucagaacaaugauugcaaucaauuuaacacuucugucuuuucuaagaggaaauaaucauaacaguauucauuuucaaaauucccaacauguaagcugacaucuacuuuccuuuuaacaggcuuccucuauguuauagguugagcauuccaaaucugaaaauccaaaaugcuacagaaucugaaacuuuuugaacacagauaugacacuuaaaggaaaugcauauuggagcauuucugguuuuagauauucagauuuggggugcccagccaguaaggauaaugcaaauagaguauuucaaaauccuaaaaaaucccuaauccaaaacacuucuagucccaaauauuucuaauaaaggauacucaaccuguauguauguuuuccuugaguuauguaccuccauguuccucaaccugccuaccacagagccuuguacacagcauuuguugauuugaguuguaucagccuacagcacucauauuaugcagcucuccaaggaauuaauguuaaucuauuucuugaugugcuuugcguaaaacuuauucagccuuaagauauuugacacuaguuugaacauguauugaacuuguacuguuugacauuuauuuuguguauuaauguugccuucccuaguuuggcaaguaucuugggggauagaaccuccucucauauauccuacuucaaaucuguaaggaagucuggguacauugugacacucauaaguauuuguuaguucaguuaccuucccucuuuauacuuccaaaaguaaugaaaauauagcaacaagagucugacauaagugacaagcagauuuguugaaaggcuucaugaggaaggaaucugaauauuuagacuuugaauaaggagagggaaugucaagcugugagagagcaccuggagagaggcugaaaugugcaauuuaagauggaguuugugagaaugagacuaaaguuauaggaaccgugguuaguuggagggaugggguggggucaaucaggaaggaccauaagagacaggcagaagaguugaugugguauuaguaggucaugagaaaccauuguaaguucugaagcaggaauauagcauauuaacuauugugaauugucuauuucagaauaaaguuaccucaaugaccuucuuaacuggcaaagcaguagaagauuugugcagaauaaagcagguaauugaaauuuugucauuaaauguuucgcuaccuagagagaaauuucuucuucucagccuucacuauugaauuccacccuuggcacacaaccaaaguauuauagggaauuaucuauuuacagaacacuaaauugacaagugguccaaaacauaggaauaguaaccaccaucccugugcuggacaucucaccuguuuuccuaaauguuccccagucaugagcaauuauauuguaccuacagucucccuacccuacuccccaacaaagacucaggguaucuuaaaauuuaucacagaucccauucacacuuaaaaccuuacuucaccuauacuuugaguuaauacagguuauuguccucuggccugaaaaaucugucuguuauaacacuuauaacacugcagcuauauccagguugcaagucaguuuaaaccaacuuuagaaacaaguuaaguuuuaucuaggcaugugucugagacugugcucaagcucccuuacuuguauucaugaaacuuugucaaaucuguuccucacuggcuacuuuaucucacaaaaaguuggccaaucgcuugcuugcuugcuuguuuucaaaucacauugaaggaaucaauuaagauuuuggacuaaacauauaauaaauuuuguuuaaauuguugaagaauuugggaaaauaauccuauucaaugagauuguguuuguuuauacuuaauaccccuuuuugaaaauugacauuauuaauuaaaauaauaucaacuuaaugucuauuuaaaucacauagaaaucgccaggucauuucuugguuauuaaaugccauaagaacaguuuuuauuuuaugaagggaauagugucaagaacuauuucacaguauauuaacauuuaauccuugaaaaaaaaagucauauucucaaugaaaauuagugaaauaaggaaucacaagugugaaguuacauauuauguaauuuuuguucaaaaguaaaacauauuaaguaacugcacuuuaaagucccuuaucuuuaaaugguacuuuaaugugaggaugcacaaaaaaagaacccuuuucugaucuugugagguuuccacuuacagaugauauagauaaaguacagucauauaaauuauuuguaauuauuucacucauauaauuuugcucggaagccauaucguagucaggccuggauuuuaauucucaauuccaccauuuacugaaaaucccuuaaccuguauuaaccuuaguuucuucaucuguguaauagcuacuauaaauaauauuacuuaucuucaccugguugaaauaagaaaaucagugugaaauaaccucauaaccuuuacucugugcaauucuuuguuauuugagcuugcugguaucaaugcuaaguccagcacagugauaaaagugauccagcugaaucagguuccugccucuuuucuacucaaccagguugaucuggauuccaggcacauuggcuggguaacaagugaacuuccaggaggggauaaucacaucauaaaaauugaauuaaaaggcccagaaaauacacugagaguucgacaagucaaaguccugggcuggaaagauggugaaagcacaaaaauagcuggccagauuucagccaguguggcccagcagaggaacugugaagcugagacucugcgaguauucagacugauuacgucucaagugaguguccuuacaacauauucuagcacaggauaauugauguaauauauuuuaagaguguaacaaaauauuuugugaaacuuauuacagaaauuucuggcuauaaauguugcccauuuuuucuuuucauagcccuaaacaccugaguuccauguugcauuuguaauuaagaaaaauagugguguauauuagcaagaguagcauauuauaaaaccugcggaaucagcuaaugaguccucuggccaauauaguguuaaugccugucauuaauuccuucucacaugcauaucuucaucagguauuuggaaagcucaucucuggagaugcugaaccuacaccagaacaagaggaaaaagcacuauugucaucaccugaaggagaagaaaaaguauacaauguauuuauuuguauucuaaagauauuuauuucccuuuuuuauucuuuuuuucagugaaauaauucauuuauugcuguauauuuugauggauauguaauaacaguuuuaugcaguucauauuuguucuuagaaagaugaaggaacuaucuaaaagaaauucauuauucauguauaaucuagcuaguauuuuaaguaacagcaaauuugcucuauaccuuggguuuuugcauucauuuguaaucauuucugugcuauaccccaucaguuaucuucucccuccuccauugucccuguccuucacaguucagcucaaaaguacugucuucuucaugaaacuuuuuuacgauuuauccucuucaugaaauuuguuuaugauuuccccaaacaaaagcaguuuucucucugcuggaguucauaauaaucuguaugugucucuucuucauuuuucucuuauguuuaucuacauggauguuuucucucuucuacugaaccauagcuucuuaaagaccaaguccaugucuaauuugucuuuguauccaucaugguagcaucacacacauguuuaguaaauuuuuauuagaauaacuacucuuuguuacuguucuugaaauuucuugcaaaaauacaguugcuuuacuuuuucgguccugacuaaaacacuauaccuaaaacuuuuguacuucauccauuugcaaaaagagaagucaacucugacuagucucaauauucuagugucuuuaaaugcuacaaauaaucaccuuggcagcccuuugaaagauaaauuucaaggauuucccuugucucacccuguguuucuuaauacaguaguaucuaaucauuguccuguuuuuguuugaggucugaaaaaaauaagauuucuuaaaugcugguaacuucuuucaacaucuuuuggagauuucauuugaaugacuacaagacuguguaacuaccuguuaagucaauugaauuuuagcagaugucaacucuguacuaaacaauugugagaauggcaagcccucaaaaagcuugcauucuguucuugguuaugaacccucugcauuccccucaccccccccaaaaagaaaucaacaaagauacuauauaguauaaaagcaaguuauuaaaugugugaaaaaaauugcagaugacauuggcuuucagaguaccuugagaucauugugcccuggaguggucagagaaggcuucuuaggggauauuggacuggaguuagaucugaaagagaaugaagggauucaaaugagauuaguagagagaaugggagcaaggacugaucagagagacuggccuaagggugggagaguguaugcugaggaguuaagguugaguaggaaagguuauacugucaugugugugcccaugaaauaacaugauuuuuaagagaaucuuuuuuuaaguuagauuauugaagcacaauuuacauacagaaauuccucauuuuaaacuguaucauucaaugaauuuuuacuuguguacacuagugaaaucauuaucacaaucaaguuuguuuuguuuuguuuugcuugagaccgggucucucucugucauccaggauagagugcagugguaugaucacggcucacugcaaccucaaccucccgggcucaauggauccuccugucucagccucccaaguagcuggaacuacaggugcacgucaccgugcccagcugauuuuaauauaucugcagagaugugguuuugccauguugcccaggcuggucucagacuccugggcucaagcagucugccagcauuggccucccaaagugcugagauuacagauaugagccaccaugcccagcccacaaccaaguuuuaaaacacaucacuccccaaauuucucucauguuccuuugcaggcaaucccccaaccucacacuuagagccuagcaacuacugaacuauauucugccaguguuguguugccuuuuccuggaugucauauaaauggaaccacucagaauguagccuuuuugucuuguuucuuucacuuuaguguaaugcuuuugagauuuauccauguuguagcauguagccaugguucauucuuuugguugcugagaaguguuccauuauauggauuuaccguaauuuguuuauccuuucauuuuuugauggauauuuggguuguuucugcuguuuggcuacuauuaguaaagcugcugugaacacucacauacagaucuuugcaggucuuuuaccaauuauguguuuucaaauauuuucuccuagucugugucuuaucuuucagagaacagaaguuuuuaaguuugauaaaguccaguuuuuucuuguuuuuuugauucaugauuuuuauguauggucuagaacccaaggucacacagauauucucuucuuuuccuuuagaaauguuauaguuuuaguucuuuucuuuagaacuguauacauuuuaauuuuuaugugcaguguaagaauugaggcuuaucuuuugcauauagauguucaauuguucuacuacgauucauugagaagacuaucauuuaucaauagucaauuuaccauaaaugguaggucuguuucuggacucuauucugcuccauugauccaucaaagugucuuacuuacuguagcuuuauaaaaagucuugauaucagguucuaacuuuguucuuuaucuaaguuauuuuggcuauucuagaucucuugcauuuccauauaaagcuuagaaucagcuugaccguuucuuuaaaaaaaaaaggggggggggcgguggggauggaauuuugacuggaauuaacaccaaauugauaguuuagggagaaucgccaugucaauaauauugagucuucguaucugugaacaugauauguaucagggguuuucuuacaucuguuuaaaauuucucucagcaguguuuuguaauucauuguacacaucuuguacauauuuuauuaaauuuauuccuaaacauuuaacauuuguaaagcuauuguaaaugguauuuuuuauuucacuuuccaauuguucauuucuaguguauaaaaauagaauugacuuuuguauauuagauuucuacccugugaucuuaaauucacuuacuaauuucagaaacuuuuuauagacucuuugggguuuucuuagauaaucauguagucuucaauaaauuuggguuuuuuccuuucuaaacuauaugccuuaaauuucuuuucuuauauuauuguguuauugcauugauuaagcccuuaagcgccaugcugaauagaaguaaugagaacagauagcucugacuuguucuggaucuugaaaagaaaguauaaaccauucauuauuaagugugaugugaacuguagauuuuuugggggugaaucuuuuuaauaagauuggagaauguuuucuucuauuccuaguuugcugagaauuucuaucagaauggauucuuuuuuaagagaccuggucuuaacucugucacccagacaagagcacagugguaccuuuauauguuucucuuucuucauuucuuuuauuccguaagauaauccauauauugcuaugcauuuuagucaacaugugauacuagcuuguauacaguucauuuuccuucagugaaaaaaaaaacuaggggaugguagcuacaugauauagugcuucuuuuagaaguaauaaaaaugcuguaauauugacugacgacgauaguugcacauaucugaauguacuaaaaaccauugaauucuaugcuuuaaacagaugaauagcaugguaugugaacuauaucucaauaaagauguuuuuaaaaagcaaaaauaaaugaugaaagagguaaacaagaugaaagaacuaucuaaaagagacucauauauaaucuaacuaguacuuaaguagcaaaauaaaugcucuauucuaaaaauucacuuucuuuaauagauaacagagcuguuucaguuaucuguuucuuuuuggguaagcuuuaguaguucugacacucaagcaauuuguccauuucaucuaaguuucuggauuuauugccauaaguuguucauaauauacccuuaugucuuuuuaauaucuguagaaccuguagugaugugucuuggugauuugugucuucauucuuuuuuucugaaauaguuucucuaaagauucaucaguuugaucucuucagagaacuagcuuuuuguuucauugauuuuccucuauuuuugcuucuuuuaauaaucacaacuuuauuucuuucccuauguuugccuuguauucauuuguucaucuuuuucugacuucuuaagguccaagaucagaucguagacuccaagaccuuucuuuucucaucuaaguauuuaaugcuauuauuuucuucuaagcacuacauuagcugcauuucacaaauuugggguauucuguuuuuauuuucauucaauucacaauguuuucuuaguuuucuuauucccauuugauuucuuuuuuuuuuuuuuuuucuuuuuuuuugaaauggagucuugcccugucgcccaggcuggagugcaguggugcaaucucggcucacugcaagcucugacuccuggguucacgccauucuccugccucagccucccaaguagcugggaguacaggcgcccgccaccaugcccagcuaauuuuuuguauuuuuuuuaguagagaugggguuucaccacguuagccaggauggucucgaucuccugaccucgugauccacccaccucggccucccaaagugcugggauuacaggcgugagccacuguauccggccccauuuugauuucuucuuugacccuuggguaauuuagaagcaccuuguuuaauucccaaauauuugggaauuuuccuguuagcuuuauauuauuaauuucugguucaguuucauuguggucaaacuguauuguauacuucguauaauuucaguccuuuuaaaauuguuaagauuuggauucuggccuauaauauagucuguuuuagugaauguccacgugcacuucaaaaaaaugugaacucugcuguucuucuuugagggguucuauaaauaucaguuaguucaaguugaucaauaauauucaagucuuuaagagccuuaauauucaagucuuuaagagccuuacugguuuuugguuuuuugcuuguuuacuuguucuguuaaguacugaaagaagaguuuugaaguauccaacuaacuggauuuguuuauuuggaauucauucuaccugguagcugaucucaacauucuaauggacuccaaaaaaaaaguuuugguuuuguagaugaucagguuuuuccucauuguuagggcgaaagggacauucucuucuggcucucuaucuuaagaaauguaaaaccaagcaucauuuuugauucuuaaacaaaagaguuucuuaccucaguuuucuuaccuguaaaguaggcaaaauauuacaauuuaccuucugggguuguugcgaagauuagauaagauuugugugugugugugugugugugugugugugugugugugcgugugcacacacgugcaugcauauauauauauacacacacauauauacauauguggcacuuagaagaacagcgugcacauaauaagcucuauaaaauuuuagccuuuauauuuuuccuuaugauacauuucuuugaugacuugguguuccgauagcuuaauuuaagaccacuaucaucacagagguuuguuaggacacuuuccuuuuaaacaaauguuauuuuccuggauuguucuucaaacaauuaaaugugggaugugaacuaauaauguuuacaauuuagaaauagauuuaaucaaagcuacucaaauugacuacauuaaagaaauuugugaaaggagaauauacuucucugaauuuccuaaguucugagauuuuguucuuuuuauuucaaacuuuauccuuugucuuaguauuauaagccucaauuuaaaauaaauuuacuuuaaaaauauauacacaaaauuauuucucaaguuacuuugaaauaucacauauacaaauuuuauuuaaagagaccacuucauucuuuuuuuuuuuuuucuuuuucuauguaaaggcaacaucagaugcugaccugaaagaacauaugguuggaaucauauucagcaggaguaagcugacuaacuuacaaaaacagguugguuaacagcuauuucauugucuucauuaguuuuguguguguguguguguguguuuguuuguuugucuguuuguuuguuauuaggguauaaagcagggauguccaaucuuuuggcuucccugggccauauuugaagaaaaagaauugucuuaggcuacacauaaaauacacuaaggcuaacaauagcugaugaacuaaaaaaaaaauugcaagaaaaaaaaaucuccuaauacuuuaagaaaguuuaugaauuuguguugggccacauucaaagccauccugggccacaggcagucccccggcugcagguuggaugagcuugguauaaaguauuuugaaaaauuuaugaaggcuuuuuuaugcucgcccuuuuauagguccugcagaaugugccugccauuuuuuagagaggaaugaguauuuuggcauaccuucaucauuuuaaagauuuuacuuaugaaaacuugcuuaccuugcugcuauuuguuauggguagauuuuuuauuuggugucaaauacccagcuauaucagauuugauuugcauuucccauauuucuuuucccccauucuucuguguguuggcugagcaauuaacaguguuaacuauaccaguguuaauauuuuuaaauauaaccaggugaggaaauagcgcuauauuguucauauaauggggugcuacauaacauaaaaauaucacuucaaaagucaaauaaaauauugauuuuaaauuaaccuauuauucuaacuuuuuuuuuuuucgagagggagucucgcucuguugcccaggcuggagugcaguggugcgaucucggcccacugcaagcuccgccuccuggguucacaccauucuccugccucagccuccugaguagcugggacuacagaugccugccaccacggcuggcuaauuuuuuuuuuuuuuuuuuuuuuuuuuaguacagacgggguuucaccguguuagccaggauggucucgaucuccugaccucgugauccacccgccucggccucccaaagugcugggauuacaggcauaauauuuuuguauuuuuaguagagacgggguuucaccguguuagccagaauggucucgaucuccugaccucaugauccaccugccucggccucccaaacugcugggauuacagguguaauuuuuuuguauuuuuaguagagacgggauuucaccauauuagccaggauggucucgaucuccugaucucaugauccgcccgccucggccucccaaauugcugggauuacaggcgugagccacggcacccagcccuauucuaacuuucuacacuauuauucuuuucaaugaacuacaacaugaauuuauuuuugcuuuaucuuucuagcaguguuucauugaaucuuagaugcuuucaauuguaaaaugucauguauaauuucaguauugugaaucuuaucagcuauaaagcaccuuaugaacauaaugguaaaccaugagaaaaagugccuucagugauaaaauauggugauugguuuuugacgugcuaaacuguaagcauaggcauuaauaacuugcauauaaucaguuugcacauaguaguugauuuaaauauuuccauuuuuauuguggcucccuuagcuuuacuuguuucuuagaugaguuaagagaaugacauaugauggagaauuaacugggagaauaguauuaaauugaguaucaauuuacauucuugucuuauucuuuuguuugcuuguuuugcuaggaguaguaaaucaaacuaacccuauauuuuuacauguucuguguuaacuuuaaauaggugugugcucauauuguccaagcuauucgcauggaagcuaccagaguccgugaagaaugggaacaugcuauaucaagcaaagaaaaugccaauucucagccaaaugaugaagaugccuccucugaugccuacugcuuugagcugcucucuaugguuuuagcacugaguggcucuaacguuggccggcaauaucuggcucaacagcuaacccugcuucaggaucucuucucgcugcuucacacagccucuccuagaguccagagacaggugacugaucacacuacagccuuuccauugcuuuuguuacuugaaacauuguuaaaaguugcaaugcaaagagaauuaucuaaggacccuaaguauagauuuuuauuucguauuuuguuauauuuuguuuggggccuguauuuuacucccuuuuuuacuguuuauagugagaguauagaauaguaaaauauguuccauuuuauuaauguguugugauaagagaguauucuggcuacugauuaccauauuaccaugaaauauauaaugucauuuagcccugaccagaaagaaaagguauuuuuuuucgugcugccuuggguuaguaauuaccacuacuauuaccauuugaauaguauguauaucauauuuucuuccuucacaaaauguaaaauaguguuuaaaucauauuucuuuucuuaaagauuuugaaguuacagaaugguaguuagguacauuaaaaaaugaagccugggaugggguacagugacuuaugccuguaaucccagcacuuugggaggcaaagcugggaggaucccuugagccuaggaguucaaggcugcagugagcugugguugcuccacugcacuccaaccugggcaacaaagcaagacccugucuuuaaaaaaagaaaagagaaauaaaagaaaccuuaaaacauuagucuuuacauggaauucucucauuuuauuuuucuuaccagguaaccucuuuacuaagaagaguuuugccugaaguaaccccuagucgucuggccagcaucauaggagugaaaucccuccccccagcagauaucagugauaucauucacucaacagagaaaggagacuggaauaagcuggguaucuuggacauguuucuaggaugcauugccaaagcacucacuguacagcuaaaagccaaaggaaccaccaucacuggaacagcugguaccacugugggcaaaggaguuacaacaguuacucuuccgaugauuuucaauuccagguuaguuauugccucuauuuuaguaccaaaacagaauagagugagcuacuguucagaaauuuaagacauaauuucagauuuuaccuuguuagguuacucaccaaauaaaauccauaaacaacuggcuaauaucuaaaaaggucauguauauaauaaaagugucauuuauaauuaguggggaauagaaaguaggcugaauaugugaugucagaauauuuggauauccauguuaaaaaaaauucuagauaccuaccucucaccauauacaaaauuaaacuucaguuuuagguaauauguuuuuuugccacaauaaaaagaaauaaauaugggggaauaaaguaaaguucaggucaacuaaagcuuuauguacauuucuuuuuaaaacuguacugggacaaauuauagaagaauauuuuuguaaucuucaauuugauaagaccuucuuaaacaaaacacagaacccaaaaucauauaggaagauauuuauagauuugacuauauaaaaaugaaaauuacuugauaggugauaauauuuaaauguuuuaaaauauagggaaauaacuuagaaaaauacuuaaaccuauauaauagacaaugacuuguuagcauaauauagaaguaugacuacaaaucaauuuuaaaaaggcaaacaacugauaagaauaauaaaugacaagaacagucaguucacagaaaaaaacuuauaaaugccaguagucaguucacagaaaaaaacuuauaaaugccaguaaacaaaugaaaacaccucacuacuaaucagagaaauguagauuaaaauaauugcaaaauaucuuugaugcuuuggcaacauuaugaggaaauaggcauuuucaucucauauaaauugcugcagccuuuuuggauaucuguuuauaauaucuaacuauauuuuaaauaugcauaucuuuugaccuaccaauucuacuucuaaaacuuucaugcauuugcaccaagguauauaugcaaggauguucuguaauuguguguaacaguagagaauuagagacaucugaacagugcuacuuguagagccaauccaugacaauaugcagauaacaucagaauguuaaucauuguaucacuucuuuccuguagucuugcuaggaaaaaagucagcugaacuaaauaguagugugcuuagugauacagugaauuuauauuccgguuaagcuccacauuauccgcaugugcccuagaaauaagucguguguggucccuggacuguacuucuaaaagaugcacacagaaauaaugugcaaacagagaaauacuugaaagggaacucaaauaaccuuaacugcugucuugggauuugggguaaugguuugaugaauuuucuuuuuaaauguuuuaauugauucagucacuuaaaaaucuaaaaugcugcauucugaaauaacauuuucaucuuuuucauuuguuacuacuacugauaauuuauuggcuuuuuaagugcuaauuuuucuuguaguuaucuccgacgaggugaaagucauugguggaugaagggcucaaccccuacccagaucucagagaucaucauuaaacuuaucaaggauauggcagcaguaaguucccauucuucuguuuuggcagugaagugcggcaggaagcugacacaaaacagcuuacucugcugaauugauaggagauguagauuaguguaacuuuacuuaaagacuauuuguaguauguuaacuaucaugcuguuugucuuuucagugagugauaauuugucauuuauguaaaccauguucauuucaaauuuuccaguuaauuugugugggaauuguuacgugacuuuaaaaucuaauaaaauaaaauaugcucuuucagacccuaagaaagaacuugauucaaaaaaccuaaaggaaaaaaagaggaagagagcucucgaaaguggaaguuucucauucuccucaguccucaugguuuuuaaacccuuuauucuucuuuauuaaugucauauacccucugucuuaagaugguggcuuccaaaggagaucugggaguguggaggacagggaguuacuuuacagaaugccuggcucugauuaguugcuccuugucauuuuccacacauuguauuauuucuaggagggcagccugagaaggacaagauaguauggaauguagagucagaaggaauagaaggcagcuuggagaaggaggaggaauugaacugccccuuaaaucauguggauaugagaagugggaggauuuucugggggaaagaugaaguucuaucacuuuucccaacagcguggauauuuucucaaccucuguggcaaacagacuuucucaggguguucauugaauuaaaauauuuaggaguaauauuuaggaacaccuaaauuauaugauaguuaaauguuuguucauuacaaaucaagguagcaaauaaagguaguugcaguuugaaccuguuuauauuuuagguuccuguaauacucaucuaaagcaguuagcuucacuguguaaauuuuaugcuaagugacaaacuucucaaacauagauaaccuuaguauuucuguuauguuuuuaucagaugugagaguaauugcccuugauuuccaggaaaagaguauugagaacuuaauuuuuuauuuauuuauuuuuaaauaucaaaaugaugauuagaaguugaauuuuccauaggaucacgaagaaauuuuaguucaaaaguuugugcccauaaucuaaaauuccauggucucacuaaaaacaaauauuuccuuugauaggagauguuauuuaagaaaaaagaguuuacuaugguaauacauuucuggucacuuauuaaaauacucuguucugcucaauagggucaucugucagaagcuuggucccgagugacaaaaaaugcuauugcagaaaccaucauugccuugaccaagauggaagaagaauuuaggucuccagugagauguauugcaacaacuagaguagguuuugcuuuguuuuguuuuguuuuaaauuugguguguaucauugcguguucuuuuuuaguaauagauuuaaacaaauuuuaaucacuaagucaacauaauuauuuuuuaaccaaauaccguauuuauugaaaaaguauaaagggcuuuuauauuaugaacuagucguuacuucucacuguuauguguucugugucacuuguuuuuguuauuguuuaggaagccaaggguacacugguuagaaaaggcuaauuacauuguacauuguuugcguguugucuuucuaaugaucuguuugcuguaguuuaccacaguaaguuuagugccagcauuaugcugugauagaccgaagguccuuuggagacaagaccccugccuaugccugguuguuccuaauguagagcccuguaacuuacuuacaggauuuauaggucuuacuucuaaaaagcaagaagugcuuguccagggcagggucaggguggaaaucuuugaggaaaugagauugcauucuucagaugacacauuuauaguaaguuuuaaccugcuagauuucaugucccauauacuuccagaagagauuugagauuuccuugaaggagggcagucugacaacguuaggaagaagugaaugcugguaaaaauugcuuagguuaauccucagaaaucugaagaagauaaacuauauaucccuagggcggaaaaagucaauuuaugcuaucuugcuauuauugacugugacaccugaaauagguauuuuugacaguaauccuuuccuaccacucauguguugcuuucuuucagucugcauuccccuuccuccuugcaugcauuauuucuuuuucuauuuuucugucccuauuuuaacaucucuugcuuucuguauccaauaacacucacaugcacuucuuagaguugagcuaguuaagucauuuucuauucuucauuaaugaggggauauaucauucuauauaaaacugaagcuuacccuuuaagccucagaaauuuuuaacuauuucugaaaacaguugucuuuuuuuuuuuuuuuuuuuuuuugagacagaguuucacucuugaugcccaggcuggagugcaaugguacgaucuuggcucacugcagccuccgccugcagguacaagcgauucuccugucucagccucccaaguagcucggauuacaggcauauaccaccacaccuggcuaauuuuuuuuguauuuaguaaagacuggguuucaccauguuagucaggcuggucauaacccccugaccucaggugauccacccaccuuggccucccaaagugcugggauuacaggcaugugccacugugcccggcccuauuuuggagaacaguuuucuaaagcuuuuagacauguauguauuucugacaaagugcaccaaguauaguauuaggcuuucuggggcaacaaggggcaacaaagacuucugaggaacuuuuauuaucuagaaggauuuaauguguaccugacuacucaugggacuguacacaauuuagcaguugcuguaccaccuucuuuggcauuuaaugauacuaaauggaaaaauauucagaagacauuaguaguaaauauuaaauaugccaauucauuuauucauauguuguuuacauaguagaccaauaaaggauaauuuuauuugucagauagaagacagggugguucaucagagaaacagucacuuguucaguagauaucugagugccuccugugugcauggcacauaggacagugaucguguaugccugcuaccacaucaggaagacuugagugccacugaguaucuauguauuuucaaaaucagccagcauuuauugagcuguugugaugugucacagucagcauuucauaagucuuuccuaaaaauucagugguguaacagccuucccuuucaacagcucuggcuugcucucgcaucccuauguguucuugaucaggaccacguagaucgucucuccucggggagauggaugggaaaggauggacaacaaaaacaaaugguaagaucagaauuuuguaagaauuuaucuugcuuuccuuuacaguaagcuuuagcuuagcuuaaaaacaaacaaacaaacaaaaaacacaucaacauaaacaguuaguggaucucuugaaagauugugucccuucggccaaguucaucucacaagucuauuucagagagucccuacuucauaguauauggaaacuuuaggggcuuuuauuuaaguauauuaaagagcuuucuucuucucugagucauguuugcaucauaucaaaauuuauuuuuagccagagucugauuuagugacuagauauuuuacuaaaauguaaucagucuuaugguaggaaggaaauaaagcaauaacacaggcaacaugacacaccaccuguucacauauauacuuaaguagguuugauggguaucuuuaaguucacuagaaaggaaaacuuuauauaggcccuuucaccauuuucuuauuaauguucaaguuucaaaaauaaacaguuucuuccuuuggcauacagaauguuuagauauauaauggggcagacauuucuuaagucucuaaguaacaaaguauaccuguucauuguauuaaucauugaaccugcaaagcacauuaaugauuggauuuggaguuuugagagauuuuuauaguuaaguacauuugcaauaauucuguuuaauauucagauucuaaauucuuaauagacuuccgaauaacgguuuauuuuuguaaauaaauuauauucaauuuguaugagagucugagacuugcuuguuaaucuaaguaacguggaaaugucuuauuuuagccuaugugugauaaccaugaugauggugaaacugcagcaaucauuuuaugcaaugucuguggaaauuuauguacagacugugacagauuccuucaccuucaucgaagaaccaaaacucaucaaagacaggugaagauuuuugucucuggagcauaaaauauguucagugaauuuugaaauaaaugugugaaagaggcuuuguguaguagggggaaaaaguggacuuuggaaucaaagaccuugguugaguucacagcugucucgcuuaccaucuauaaauagcaaguuguuuuauccuuagaaacacuuaauuucuccauuuauaaaaaagggacugcugugaagauuaaagagaagauuggaaauauucaaaacuucuuagagugcuuaaaugaaagccauuauuauuauugaauaauuaaauuuuauacucucccuuucagagugauaaauaagcauauuuuucccuguucuuuaaugaaauaauaggucuucaaagaagaagaagaagcuauaaagguugaccuucaugaagguugugguagaaccaaauuguucugguugauggcacuggcagauucuaaaacaaugaaggcaaugguggaauuccgagaacacacagguaaaagguuuaaagauugagccaugccuuuaaaacccacaaaaaaagauuaaaccgugccaacugauuaaacugugaauaauuuugagugauauucugauguuuaauuaugacaucauugaucuauauauuuacuaaauauauagaguguucuauggugaagagagcauuagaccaaaagucaagaaaccugauuugccacuaacuagcuguguggugucgagcaagucacuuaaccucuggaacucauugacuucauuuauaaagugagaggaucacaacuaauggggcuccauagauaaaauacauuucuauugauaauucccuucuaguucugcuaguuguugccccacaauaaaaauugcugcacuagaugaucacuaagaucucuauuuauuauaagguuguaugauuuuaugauauuuagagguuuuuguagaccuaaugcuucugaagguguugugaaugguacuguuuccauugauagcaauaaaauaauuaacaaaaaugaauagacauaaaacaaaagguaaccuauguauguuaaauguauuuuuaucucuaaaacauaguuuucauuuugcugcuuuucuaaaguaaaucuuguauauuccuaguucaaaguuauguugaaucuuacaaauucucaguuuucagcacaucugcagucugccauuugacugacacgaacuuccaguguuggaguuagguguaaauccgaaucaauuuaauucuagggugacuuugcaugcugcaagagcaugaccuucuuuucucauaguugauuucuuccuccuauaaucugucagugcuguauacugcauuaauaaauguucuaaugucaaaccauccuuguaaaccauccuuuuuaaauagauuuuucuguaaauauugcugaauucaauauauugauauuaauuauaguuagauuuuuauaucuguguuuaaaaaucagcuuggucuguaauuuucaaaucuucacguucuuuuucuuauugcucuguucuuguuuuauugauucuguuucuucuuuaaguauuucaaacauauuuaaauuccuuuucaaauugcagaguuccugagguaggaauucuguuuuucaaguuucauacucugaugauaggcuuuauaccaugccuuauaauuuuguuauauauaguuaaagauuucccuaacuucuguguauuuuuauuuaauuuuugguuaucauauuuuuuaugguauugugcauuuggagucaggggcuuguaacagcugcucagucugguaacuugacuagaagucuagucuguuucuuucacugaaaaaaaauauuagucgagaguguauuuggcuucagauaggucuuuaauuucuuuuuuugugugucauuauuuacuuuauaauuaggacaacuuagaaaccuuccguucuaaaacugucaggcugauuucccaaggauagcaacuuauacaaaccuaguuugcuuuuuaaaauuuaguucuguuaacauaucuagaaaacauccauaagaaggauuuuuauuuuucugcuugaaccuaggcaaacccaccacgaguagcucagaagcaugucgcuucugugguuccaggaguggaacagaguuaucugcuguuggcaguguuuguucugaugcagauugccaggugaguauauagugacacaggccaucccauuguccauguuccccugugacaccuuuacuucauacagaaaagaguuuuagcucagcgucacuccagcuuccuaaaugaguguauuaccuaugugaagcaucaaaugccuuaccaaaguugaagaaugggucaaauaaggcucucaagcccaaaccacacucuuuuuguauguuucucaguuaccaugaucauauguauuuaauaucuacuuuuguacuagaaacaguuaaaaauuuaugaacuguauuuccuuuaucucuuacagacauuauucacuuauuuccuuaaaauacauuuucaacaucuaagaguucuuuaauccugaacauauauaaacauauucuauguuguccaaauguuuuugguuucucaauuaauaagaauguggauaugcucagagagucaaagguaccuuuuuaaaaaaaaaaaaaaucugcauuuuggugaugcggagaguggugacugggaaauuauacauuggggaacuuuuuuuauuuuuuauuuuuuugagacggagucuggcugugucgcccaggcuggaguacaguggcacgaucucggcucacugcaaccuccgccucccggguucaagcgauucuccugccucagcuuccuaaguagcugggauuacaggcgcgcgccaccaugccugguuaauuuuuguauuuuuaguagagaugggguuucaccauauuggucaggcuggucucaaacuccugaucucgugaucugcccaccucagccucccaaagugcugggauuacagguguaagccacgacucccagccaggaacuuuuugcuuuauagcugugcaugaugacaaauaugaaauuauaauucacuuaucagcauucccuuuauagagaguggcauuuuuuaaaaaucgcaucaaaaaaaaaaaacuuuguuaagaagccuaauuuauauucaaacaaagauuagaaauaacuuuacuuuguuguuacuuggccugcauagauacuuccugugggaaaguaaucuuuggaaauuuauauaauaaggaaaauuaccagaaugugugcuuuuuuacauacuuguguaacauuguaauucaucuuuaacaggaauacgcuaagauagccuguaguaagacgcauccuuguggccauccaugcggggguguuaaaaacgaagagcacugucugcccugucuacacggcugugacaaaagugccacaagccugaagcaagacgccgaugacaugugcaugauauguuucaccgaagcgcucucggcagcaccagccauucagguugccucagcuuuuaaaguauugaauguauccagacauuaagauggggaauauauuugucaaauaaacauugauugaggccgggcgcaguggcucaugccuguaaucccagcacuuugggaggccgaggcagguggaucacgaggucaggagaucgagaccauccuggcuaacacagugagaccccgucucuacuacaaaaauacaaaaaaauuagcugggcgugguggugggugccuguagucccagcuacucaggaggcugagucaggagaauggcaugaagccaggagacggagcuugcagugaucugagauggcaccacugcacugcagccuggugacagagcgagacucugucucaaaaaaaaaaaaaaaaaaaaaagcaguugauugaaaucuuuuuuuauaucacuaggcagaaguguucuuuuaaucuauacauguaccaggcuaaugaggagcaaauucugccucuuuaugcugugcuuucuauguugcaugcucagcuuuaauuugugauuugugugaaccucuguaaucaacagaauguauaaaauauucagaagccagggggaaauaauuagauuaucccccaguagcuaaggcucuucuuaauuuccaaaauccagaaugguauuuuuacaacauuauauaauugaucuauacauaaugauacauacuucuauacauacacaaguuacugugcacuaaauagguuuuuuuaacuuuugcccauugcuuauauuuucaguucucaugauuccaagauaauaauagucuccaaaagaaaaucauaagucaguaauuucuucuucuuucugugagauacaaaauugaauaauuuuacuuuuuuuccuaaccuagcuuacuuuauauaaguggcaugaauguuaaaaagcaggagaagccaaaggccuaguuaauaguaucccaauuuacuguaaugaaauuuaguaaauaauaaugucccaauuucagugucccaaugaauuuucauuauaguaaauuucuugauuuuucucuuaccugcuuuaaguagugccuugcauuaaauaaucucccagucacucaacuguuuaucauuauuauauuugcuuauguccuuuucuuuuguuuauuuaagcuggauuguagucacauauuccacuuacagugcugucggcgaguauuagaaaaucgauggcuuggcccaaggauaacauuuggauuuauaucuugucccauuugcaagguauggaaagaaucugaaaucauguacuuucuuuuucuuuuguucuuucuuuucaccuuucaaaauaaacauaugucaguaucucuugguuuuacccaccagccccuagcaguuucuucccuucucauucauguggaaccugagaauauaaucucucuguuauaaugcaucucaaaacaguaauuguccauuuaaaacugauuacauucuguuaaacauauuacaugagaaaguucauuuaaacaucgugaugcauuaaagggcaugcaucucuacucucagaccacuagagagcucaguugacauaacaugacaacggcuaccaaaaagaagaaugauccucugguguuuguagaaacugauaccugccauuaaagagugaaauuggaacccucaguaccacuagaacagauucuuuuagagcuuaguuaaaacaaggagaaaguucuuggcauuuugacacauuuguacaaagguagucagcaaguaggaaguuguuuuggcaagcuaauaaugauuaacaaaaagcuguuuuugaagaauguggcaguacuuucccuauuaauucaucgccccuuuuuguucuauuaagcucucccuauuuucuuaucuucguauuugcaaacuaauauaaaggguagaauguggaaagacuuagcacaaucauugucuagauagacugaggaauaaucaaaaagauuguaguauuuugcucuccccuaucauauggugcuacaaauauuaauagauacaugaaaguuuuacagcaaauacuaccuguucacuucugucaccuggcguucugccuuccccucaaggaagcaaaacacacacacacacacacacacacacacacacacacacacacacacacacacacacacaccaaacacagagcgugucuuauuuguggcaacaagguaacuuuguuuccacaauagcuagggcaacaggagauauauuucagacgcaggaaauauaaagcuaauaaaauggaauuuucaugcucugugucccauuugccccauuuucccugcucuuggaaaaauaugggcuucuaaagaauuuacagaauguuuuucaaaugacauuuuauuuagaauaugugugcugucugguuaucuucuagcacaaugcuuggcacuuaggugcaugcuaaguguuuguugaguugguuaauaaaugauucugcuaaagaguguucauuuuuuauugcagaacaaaauuaaucacauaguacuaaaagaccuacuugauccaauaaaagaacucuaugaggaugucagaagaaaagccuuaaugagauuggaauaugaaggucugcauaagagugaagcuaucacaacuccuggugugagguuuuauaaugacccagcuggcuaugcaaugaauagauaugcauauuaugugugcuacaaaugcagaaagguaugcuauaaauuauacugagaaguuuuaaaaacuagagcuuaccuauaugauuaagaauucaaauuguacagugauaucuaauuauuccaucuuaagccugaaguuaaaaauaagauagcuugguacaauguuucccaauguuuccaguaaaacuuguuuacuuaacuuguuuggggauucuuuauuuaaccugaacaaacuuuucgaaacaugcaguauuucuguauacaagcugcuucccaucaguaauaaccuguuggcccagggcaauuccuucucgaauaaacuucucucacuugacucugcuaaccauuccuuccuuaaaacccuuaauuccuuggcuuccaggacaacacacucuuuuucuguccuccuuccuuucuagucauuuaucuuuaacuacuucuucuuuuuuuuuuuuuaaccuaccccuuacauauuuguuuuccuagagcuccauucuugccuacuuaauaaauacuuccuuaccuugggugaccucuuuuacaucuauaccuucaccuaccauguauauguuuaugaccccccaaaauuuuugagauuuaguuacaaauaaccaacugcguaccagacauuuggaucucucacacauacuucagaguucacaugucagguauuauauucaucaaucuuggccgggcacaguggcucacaccuguaaucccagcacuuugggaggccaaggugggcagauuucuugagcucuggaguuugagaccacccagggcaagauggcaaaaccccaucucuacaagaaauacaaaaauuagacagguagguuggcaucugccuguagucccagcuacuugggggacugaggcaggggaaucgcuugaguccaggggguugaggcugcaaugagcuguguuugugccacugcaguccagccugggugacauagugagacccugucucaaaaaaaaaaaaaaagacuuuaccaaucucugaucuuuauugacaaaauccuaucaauucugucuccagaucucucuugaguccuuuuuucuuuccauuacaucuccagcaaaccuaaucauuuuccuugguaauuacaguagccuucuuccugagcucggguguagaaccccuaauuccucuguugcaucccuuacacugcugcuaauuaauacuucuagaucuaaaaucuaacuggaucacucuucuacuuauaauacgguagcccagucucccucuccagucucaucucccaagaugcuaccauuugcucuccauuugcugccacauaccaaauaacuugcauuucccaaacucagcccugucugcucacccacugacacccccaugccauugcacaggccauugguguuuaaaggaugcucuucucuaccucccccugcauauuuuacucugaccugccacccccaaccccauacacacaugcugucaugcagagccuaaucugucuugucauaccucgggcuucagcucagguuucaccuccucuguaacauacccccaucucacuuccaucaacaccaccaccacaugauuuugguaucuugcaggcaucuagcauagaacucccuauucugcauuaugacuacuggaccacuuaucucucugcccuacuugauaaguuccaugaggacaaagaguauguuuuuucauuuuucuaucucuaguacuuugcacuuacuagauacaaaguuaaguggagaaugaauaaaugagugaaagaaugacuacaugagaaaggugcauagucucccaauguagcaaaaagaaaauacagaggaugaauggaugucuaaguagagagaugauagccagaaaggcagauaaauacaugcacacccaauagugcacauuuaugaagcuuguauuguuacaaauaauaaaauaguauuucuguguguuucauguacuaaacauuauaaaugaauauugugcuauuacaggguagcagucaaaugcuuaggaagccaagcagaggauauagaaaagugaaacagcuggaguaagcaguccccaagacaaaccgaaauacuuccaggguuagguuuagcuggugaacgaccguuuauaaccucugcaucaauggauccugucuuuggaccuguuuuucuaguauagauaauagauuuauauugacucaguuuguuuauucccaauccggacauagcuuuuugacuaugagacaaucagugcaugcaaauugucccaguuccuuggccucacuuaaucucugcccagggcaaauacagauaaaucacccaucaugauauuuuuauuuauucaugauaauuuuauuuauucaaauucuauuuaugcaagugucuguauuggaaacuguugaguuccugccuacugcauaacuuuauaacuaugagcagaauucugaacagaauuaucaaauuugccuuuuuuuuuuuuuugagacggggucucaccauaucacccaggcuggagugcaguggcaugaucucagcuuacugcagccuccaccuccugggcucaaacaagccucccaccucagccuucucaguagcugggaccacagguccucaccaccacgccuggcuaauuucuguguuuguuuguauuuuugauagagauggguuuugccauguugcccaggcuggucuugaacuccugagcucaaggaaucugucugccucacccucccaaagugcugggauuacaggugugagccaccaugcccagccggccuuuucuucuuaaaaaaugugugaucagaggaugcuuaaaauuacuuuuuucuuucccauuagccuuggaauuauaauucuauacuaauuacuuuauguauauuuuguucuacaguauuauaaauugggaacugcuaagcauauuuauuaaaacaguagaaggggauauguauuuuaauauuucaaaaugagaaaaauuucucaaacuuuacccugaaaaaagcauagcuuuuacuacuuaauauucuguugauauuuacuuggaauauuauacuuuuuuguuuugacaggacaauguaacugccuacuuuaagcuugaauccauuugagagucgaaauagcuuuaggccaggcauguggcucaugccaauaaucccagcacuuugggaggccaaggcaagaggaucaccugagcccaggaguuugagaccagccugggcagcauagggagacucugucucuacaaauaauuaaacaauuagccgggugugguggcgugcaccuaugauccuagccacucaggaggcugaguugggcggaucgccugagcccaagagguugaggcugucgggagccaugauugcgccacuaugcuccagccugggcaacagagugagagcccgucucaaagaaacagagagagagguggaagaggagaagagaagagaagggaaggaagggaaggagggaaggaagguaggaggggaagaaagaaaaagaagaaauagcuuuauuucuuacccugauccacccuacauacagucagcaagcaauaugggcaugcacuuggcauuucaagggauggucuaguagauaaugguauuuucuaaaaccccuagaucuuacuuucacuaugcccauacuguaucucccaugccagaguuuucuuuuuuccugcuguaaucuagauguguuuucuccacaggcauauuuugguggugaagcucgcugcgaugcugaggcuggacggggagaugauuaugaucccagagagcucauuuguggugccuguucugauguuuccagggcucagguaggcagaacauuuuauuagaaacaacaguuuagaaauguuaaauaguauuauuuuuuaaacaauaauauggugggaauguaaaucaggcuuuucuccucaguauuuucugauauuuguucaguguuguauaauuuuucacauuauuucauauauauuauuuccuuugggcgauauuuuuauuuuauaauuuugucuuccaugaaaugaucaccauaguuaaacaauguaauaaauuuucuuauuuucuuaguuucuuaaacgugcagugaaacuuuuagguuuuccccucuucagugaaauguucacaguacaucugugagauuauaagagagguuaauuucauuaauuuucaguuugaccagccauaaaacauucauaaagaaauuaaguaccuugcuuauuaaaucagauagauuaugauggaaauggaauuagaacuuggaucuuuguccagaccuuuuggacaggccacauauuuauuuguuaguuuucaaacauguguaucaucaguuuuucaaucaauuuuuagaguuauguaggcccucaaaauaugaauuaaggagcugucuauguauaugccuaucuuaagugugauugaaauagucucacuaugaucuugugucugucucuucucuuuugcuauagaugugucccaaacauggcacagacuuuuuggaauauaaaugucgcuacugcuguucaguggcuguuuuuuucuguuuuggaacaacacauuuuuguaaugcuugucaugaugauuuucaaagaaugacuagcauuccuaaggaagaacuaccacacuguccugcagguaugcuuuuaauauuuuaaaaucacgauuaugaucuauauaccauaguuuuauguaaacauuauaugaaagcucuguuucaagugacagaaacucaauucaaacuagccuaaagaagcaggaggaauuccuugauccuuguaagcuuaugacuuucugggugaauuaggaagcaggcucaucaucaugagugagaaguuagcugugacggagcagaucucauggggagugagaaugaagucuacuaaggauuggugaaaagauggcuguucagcacuaaaaagucauaugaaguucaauauuacagaaccauuuaaaaggauucugugauuuuuuuuuuuuuuuaacgaagccuggaaccguugccauaaaaugaaccaagugauuuaaucuagaauggcugggaaucaguaguguagugagcaucagaaagucaagggaauuaaagaaaccacucagaauacaggagaaauuauugucuauggaaagcaggcugaggggaaagaaguaugaaaccaaaaagaagcugaaaauacuggaagaggacaggaggcuaguggcaacggugagguggaauaccaggcuucacggaagugagagaaguggaaggagagguccgugcaaccauaggagagaauuuuacauaagauauaucugaaauuagugaaaauacaugcacaaguacauacaacacaauauaccguguugucaaagcuagaaaacacacacugccaucugcugccuaucagagugcaagugauagaccucuccggaaaacagcuuaauagugccucucaaaauuaccagcguaucaacccuucagcacucccucuucagggauauagcuacaaaugugaggacaguaaaaaagggcaaauaaacaagguuauuaacuacagcuuugcuaugauaauaaaaauguauaaacaaugcuaguguccaguaggguaguggcuaauauuacgcaucaguuuaaaaaaaaaaaagagugaggaugguguuucugugugcugauuuggaaagaucuucaggagauagcaucagaugaaaaaaguaaauuaggccaaguggugugacugacaccuguaaucccagcacuaugggagaccgaagcagguggaucacuugaggucaggaguacgagaccagccuggccaacauggugaaaccccaucucuacuaaauguacaaaaauuagccaggcaugguggcggguaccuguaauccgagcuacucacgaggcugaggccagagaaucacuugagccugagaggcggagguugcagugagccaagauugcgccacugcacuccagccugggcgacagagcuguuucaaaaaaaaaaagcaaauugcagaacagaguaugcaguaugcugccuuuuguaagagggaaaaugagacuaucuagucauauuuguuuauauuuacauaaagaaaccccuggaaagauacucaagaaacuaauacuauugauuaacuauugggaaaagcaagaaaaagaugaggguagagacuagggaaaguugcuuccaauuguguuaucauuuuuaacauuuugauuuuaaaccaugugaaacauauacuauccauuucaaaauaaagauaaguaggguuuuuucaaguaugacuacuuuuuaccauuugcucaugucaaauaaaaauuguuuuacuguuucuccucaaauacuguuuuuuuuuaauagaaguagcaggcuuugaaagaagcaaggccagaaugaugugaagccagguuauggaggauaauggacagaacagagaugugagccaugcuuggagggagggggugaugugcuggaggucagcaagugaagggaguguggaaagggcaguauucuagaugacucuagaugacuugagcuuggaggaagggcaauuauugaaugaaaguuguagguuguggucuggaaagaaauaggagccaagagaaaaaucagucacacguuguagccauaugaccuggaggagcuugggagauaaccagccuccaguugagaaagauuuaaggcaagcaguaucuucaggggaaaucuagauuuuacuuaaaguuuccucuauguuaaaaaacagaaauaagaaugcuaaaaauaaggaaguuaacaaugaaacacuuuagagaacucagugguggguaguagcugagagaggagggucagguuuccucacaggaucagggcagccaacacaaaggaaucacaggagggaggcgggggaggagccagaguuggcagaaggaaggaaugaccucgguccugggcauuuucacacauauuugcuccauuuuuacaaucugcgaguagaugguauuaucccuauguuaucaaauggaaaauugagggcuagggagguuaaugaacuggccuaagaacauacacugagauugagguauacucucccagccucacacaucccucuaacucauccauucauuuagagaacuggaauagaauaaaggagaucccacagggaugugaguagggaagauggccauauacaguuuacuuagaaggacagaagaagcaauucucuaaccacucucaacccuguuaauucuaauauuuuuagauaaucagucuucauccauucaagcugcuauaacaaaauacuguaaacuggguagcuuauaaacaguggaaauuuauucucacaguucuggagaccaggaagucuaagaucuaggaauuagcagucgaggugucuggugaggacccacucucagccucauagguggcacuuucuugcugucguggaagggcagggggccucuccugggucucauugauaggaagagcacuaaucccauucauggauuccaccccaugaccucaucaccucccacagcuccaccuccuaacaccauaacauugguguuaauguuguagucucagcagugcaccaagauauaacagucucucauugucugagauaaugccaggaguucuuuguccuaccuccaagaagauuaaggagcacagauacaaaggugagguuagagcgaaaguuuaauaagcaaaagaagaaagcucucugccagcagagaggggggcccaaacaggaugcucccgugaggcuggggcccaggguuuuuauggacuggaaaggggaaggaaugugcuuagucugugggcugucuuggcccgcagcgugacucagcuuggcccgggacccuggcccaggaacccacuggagcccacugugccuaugcccacaaaaggagagagcccccugacuauacaaaggacaaaggcauuucuaucccaggucuuguccuuuaucugauugaagguuuuucugucugugcagccgugggcaugucuuuaggcacaaugcccugugcuaguucccucaucggugccugcagcuugacuuuuuuuccccaacugcuuuuuauguuauauggggaugaggcacugaccuguggaccuggggcucucuggggacccuucccuugcuaucuaccuaaggcaaacuaacuccuuucauuaacacgucaguauauaaauuuggaggagcacaaaaacauccagaccauagcauaaucccucuauccauuucuuucuaaaauauuuauugacuaccuucucgugccaggauacuuaaucuucacagcaccccaugaguuagguauugcugugucuauuuuaaagaugagguaucuaagaaucagaaaaaauaauuuuacuucaguuucauaucuacaaaaugaggauaaucguuucugccuccuaugacuguuaaaugguuaaguagcugauauacuagaacagugccucaguaguaagcacucagauguuugcagguguguuuucacuauuuuuauuucucaccaccauguuggauugugaacaccuugaagaugggagccaugcacuuuucaucuuuaaucccaaguaccuaagaaugcccuucauauauuaggcaugcgguaaauauuuguugaguaaaugacucauuuuuuccuugaaaaaacccaagggcugcaguuugugucaccaccauugauauguuguguaucugaacuagaucugccauugaguguccccauccugcgcacucucccccacccacugguggggugggcaccaaucugcagugugauuuggagcaggagcuacugaacuacuuucuaacaggaauaauuaacuuucuagcaaaccucuggcauccucccaugcugacccauccugaggucugugccugcauuugucugagguggcacucauugccacucucaugccuguuagcucuaaccugaaguugacuucucugagauuagcugucuucaguuugacacucuaaugucuuggucuuacucuuguacagaacuuacuuuuuauuccucuagaucaggccucaguuugugguuguucaguaauaguaguaauagccaacauuuauuggguauuauacugugcagucuaagagcuuuauaaaugcuagccuuuuauccaucaugguuuccuucucuuaugucagaaauguuuuuaaaccuagaaaagguaaaguaaaugagacgucauuccucauugaucaguguaagcucauuccauccaaucucgugauauuuuucucucaagcacaaucagaauuuagauuuauuauuuugaaaacuagcuguagaaaacuaaugcagaguuccuauuccuucaucuacuauuaaauagggacucugcuuucaaguauaagccuagcguguuuuucugacaaaguaagccuccugguuucuaaaggaacuaaaaaucuuuucuaaaugauaugaaacccaugacgugaagcacauuaauauaauaauuuucuuuuuuaaaauacuguuuuugguacauuugauaggccuacuuugauuauuaucaacaaauucauaucuuccccaaaguguuuuuuccacauuguauuuuauaacauuguucauguuuuuaaccugauaacuuucauuuuccugcuaauauccuucagguacuuuuaaaaauuacaggaaucauuggccuucccauuuuaccagugugggcuuuuucaucaguaaaaauaaaagggaaaacauggcuucuuuaaacuuaaauguuuuuacuuauagaaaaacauucuacacaaaaaucucccuguuuucuauucagaaaaauaauguucugccagacuaaauugagggguuuugugaccuuuuuuguucauuacucuguuuuaaaaugauauaucugaugcauuuauuaauagaaaaagaucuguagcucgaagugauccucucuaggcaggauauagugaguaagggaccccaucacuucuuccauuguacauaucuguguugaauuuuuuauagugaacauuuuuuacuuuugugaucagaagaaaaauuucuaaauguuauauuuguauaaccauagucauguuauuucuuugaauaaccuaucagugauuuauauuucugugagguuuauauguguguauucuuaaaacauuauuuuccuuugccuccuucaaauuuauacaggucccaaaggcaagcaguuagaaggaacugaauguccacuccauguuguucauccacccacuggggaagaguuugcucugggauguggagugugcagaaaugcccacacuuuuuagaacacgcagauccuuugucuacagagagaaaaauugccuucaucccccaagaggaugcggugaaguuuaaacucugcucaggauaaggacgggaccauuuuuacauccaugaaaaugaaccauucacagugcaagaaggauaccaaauaccauguacauaauucuugcuaugaaaaguuuccccauuauuuugguuuaucuucuuuugaacaaaugacaucaaacuugugagguguuugcauguggccauuaccgucauuggccugugaagcauuggacauuuauagauaauugauauaaaagaaucgccaugcccauggacuaagaacgaugcuggcuuucaagcaaaaaagaaaaauaaucauuguuuauuguauacugccuuuuuguaauccuguacaauugcaucacggguggggauaaaaagaggaauauucugguuuauuuccuagacuguuauuuaaaaaaaaaaaaaacauuguguuaggacagcauauaaauguaauaaguaucacacuguauauaaacauaucaauguuuguccuguauaagaauuacuaaauuacaaaugcaauuucauuuaaacuucuagguuaaguuugagccugaaauuuuaaugaagugcaauacugagugugccucauuaucuugcagcuguaaacauauuggaauguacaugucaauaaaaccacuguacauuuuuauacagugauaaagucuacc

SEQ ID NO: 17698 - RNA, 66579 nt, Homo sapiens
cggcuaaaacccggagccgccgcgacgcccaggggacuggagggacgcacugagcaugugcagaucagcucggugguggcugccgcggccggaggcgagggcccggugcugaugcgaaccgccggcucggccucagcccgcgcguggucggccccccaggccggggcgacagggaaggagccguagccuccccguggcccgaggagccggcgcggcggcgcgcacuccccggcggccgcggcgcccucggggcccacgaugauggcggagcaggugaaaugcgccucggcaggggucagcucuggagcgggcuccgggccgguggugaacgcggagcuggaggugaagaagcugcaggagcuggugcgcaagcuggagaagcagaacgagcagcugcggagucgagcggccagcgcggccgccgccccgcaccugcugcugcugccgccgccgccgcccgccgcgccgccccccgcuggccugcagccuuuggguccucggagccccccggccgccacggccaccgccgcggccucagggggccuggggcucgggcuggcgcugggcgcggggggcgguggcggcagcgguaguggcagcggcgguggcuccagccccgcguucccgggcaccuucugccugccuagccccgcgcccucccugcuuugcagccuggcgcagccacccgaggcgcccuucgucuacuucaagccggcagcaggcuucuucggcgcgggcgguggcgggccggagccggggggcgcggggacgccgccaggggcagcugcagcgccgcccucgccgccccccacgcugcuggacgagguggaauugcuggaucuggagagcguagccgccuggcgggacgaggacgacuacaccugguacugccuggcuccgcuccuuccccgagacccuggccucgggggcuucgggcaccggggagcgggggcggggggcggacggggguccccucgcggcagccggggugacuccccgcggcucccggaggggccgacccagcagguguugagccaggcggugacacuucccacgaugaggcuucucaugaaggcagaaaccuguuuucuaaucgcuccgacugcggaugaaccggcccccccuuccccccaucugccauggguucugcuauuugcugauuguugggucccaagcuccucguuagcauuaagugcaaaauccaugucaucuugucuuuuugcucagugcugcucuuuuccccaguguuuucggagggaugacgggggaugguagggguuggccucugucugcgacuguuacuguucuuucguuuuaaacgaacgcuggacaggauuugcgugcucuuccuccucggguggcaucggaagccgcgcagugauggaucucucuuuauagagagguucguucuugcuguuugaauuuugcagucgugugcccuuuugcguugcauuuucauugaaaucuuauuuucagagacugacuugcuuuuuaaaauggggugaccucacuggcuuucccauaaauagugccaauaaagaggacuuuucuuggaguggaaugaacaggugggagggacuuuuuuauuuauuuauuuauuuuuuuaccuaggaaccaacgaacugucuuuaauuuuuuaaauuaaacuguagaagaaaagugagauuagagaagccuuauuuucuuauuucuuggaaacuuuuuagcuugguuaucagaaaacuugaggcugacagcauuuauucaguugacaucugguuagcacugucuacuuuccaugaaugaguaacuuuagggggaggcuugcuguaguccuucuuuacuuuagguccuuuuuauguaggacccuuucuguuuuuccaagcuguguuuucauuacuuucuuugugucucuguugcaugauugcauggaagggauugggaaauggagauccuuacugguuuccuauugggaacugcaguguuccuuuucccuuacacucugucaugugagagcucuaacuguaaaguacauuaguuaauugguuucauucaagaaucaaaauauauggaguuacaguaagccuuucagagguguauucaucauccaccuuaauacuuuuuggcagcugugcagguagcucaagguguaaaaaaaucaaacaacucaucacuuuugggaacuuuaagccauuuuuucaaagcugcacccuuauuucuguaaaguaaucucaguuucagucugaaugugguacuagaaaaugcucucaugaugguccuuagauuucacuaauaacucucagcccuuaugccacuuucaaauuauuuuagguugauuuagucccuacuuagccuuuucugaugguauguauguaaacaguggaaggaaacuuguuuacauuuuugauggggagauauaugggaucaguuuuaugcuuaaaauauuugcauuuuaaaauuuauugugauauuguuuguaaauaugagauuaguaaucuauuaauaacuuuccuucuuuugaauggauuucugucauauuuaguuagcauccuauuacuagcauuuugguaccuaggcuuucuuuuuauaguuuaauuuuguccaaauagcauugaaauaaucaacuuuaacagaaaucacccacuuagugguauuaguauauuagcucuucagaugguuugaagcaaaucaaaguugaagcagguucuauuucauucaacaaguacacaggugaauaaaucaaagccuugaugcuuuacaaauguuucuagagacaaauggcagagaaucuuccugaaaacaagccugagauuagaauuccagguggaaaaacaaggaggguucauuaaucuuagugggauggucuuaaaaauuuuaaaguuaccugauuuacauaauuuuauuauuacauuuuaugcaucaagauuuuguuugcauugcaaaucuuuuugaugaagaaaauaucaacaggguuuaauuuuuaaaguuuaacccacuuguuaaugcuugcaaagcacucuguuccuuuaucacugcagacuauagugucccaguaguguggucucagaaauaagagugcuguucauuugguucccugauauguuugcaggauggcaacuuauuuuuauuuccuguguuuauuaagaaacaacuggaguggguauauaguaccuuauuuuaaaaauauuuaaaacuacaaguuuuacaugcucauuguaaaaaaacuaaaacauagauguagguauaaggucacaaaaauuaucuuccuuguccccaauuuauuaccgugacucagaauucacccuguuaauacucugcagcuccuucaagauaaaaaaauauaauuacaacaaucaauauacaaacauauacacaucaguuuuuuuuaacacuugccuuucauugaacauacauuggacauuuguguauucaugugacaucacaucucccaguaacaaaggcaucauuauuagaguaacaauauuaaggaacaaguuacuguuaacuguaucaccuacaguuuuucaugcauuuuuuauugugauuucauccuaauggguugaacaaaauguguuugcuuauuuauuuagaauagcacuuccugcuaaaaaugucauaaguucaggaaaguuuacaaauguagauuaaucacuggauauuuuagcuauucuuuuauguaaguauaucuuuucuaauaaaaccuuagaauacauuauuuuccuuuuauuaacaacuuggacaauauuuggguuaagaguuauguguguaaggaaaaucaugacuaacagaaccaauauuuucuuuaugauaguucauuaguuaaugauuaaccaggucuuugagaucauuuuucugaauaauuauuuaaccuauaaguaguaucuuaaaaaaaacagcuuuaaagagaauggaguguuaugcucucccuuuugacaaaaaagcuuugaugaaacaauuuucuuauuucuuugaauauuuaucuuaauugaauuuuaagucuugaauguugccuuaauacuaccugauuaucuuagcacaguauugcuggaauuaagugucucagaaaguuaaaguugauggcaauuccagaaccugaauucuuucuuucuuucuuucuuucuuuacuuauuuauuuauuuuuuauuauuauacuuuaaguuuuaggguacaugugcacauugugcagguuaguuacauauguauacaugugccaugcuggugcgcugcacccacuaacucaucaucuagcauuagguauaucucccaaugcuaucccuccccccuccccccaccccacuacaguccccagaaugugauauuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuaucgugaaccugaauucuuaagucaucuuauagcccuauaguaaaacucucauccugcuauacugauuccucaguuaucuuacuaauuugauaggcuuagcucuccagaaggccauuggcuagaaaggaaaagggaaaagucugaguaucaggagcaaauaaaaagcucaaagggacuaaaauauccaugcauacaugggacacagugugauuggaugcuuuuucuaucuuuauggaagaaauguuuuuaagauuuauauuuguccuaaugucaccaggcucugcagcaccagaguacaaacagaguaauucagauuggucugaaguggcaaugggagccauuagcuaacugcauacuagaccuuccuaugaccuguuucagcccucuuauuucaguguugagggacgggagcucugaggcaaaauggcuuauguaagcucuucuaguuacugauagaguucagacuaaaaaucagauuauuuguccagauucagaaguguuuacaucacugauauuuuuuuuuccccagagcuagcuguguaacucauuaguaaguuuauaaagucaauuuaguggauugaccagcauuuuaaaaaagugaagugcaguagaauagaaaaucagaguuuaucacaucuuauaauacaaugcuugcuuugauuaaauauguuuuaguuuuauagauguggaaauauuaaacguauuuuugcauuaugaucaaaguuaacaaaacucuauacuguuugaaagcaaaacggagaaagcagguggaaaagcacugaagauaguauaguacucugaagggaaguuaggucuugcacaccucaaccaggaagaugguucuauaugagaaaaugccacgauaaaaauaagucagccaauauaaaaugcagccauauaaggaggcuuuauuuuaguagaaugacaauuaacagaacauugagacuauauaaacaggauguggcaaggauuuuuaacuuucccaacugggaaagacaauggaaaaguuguuaauuauacaaggaaaaauggugacuuguacaaauuaagaaaaauuuaaugaaugagauauucaucuuccacauguaauaccaagaccccagacagcuggcuaacaucauugccaauuuuucaucaaagcuguugaacaccuugugcuauacauauggcacaacuaaauuagaccaccuaaacuguuuuuugcauaauugauuuucagugaaaagaccagagggugcuucccuuuuugacagugcuaauugaaaauguacaauguuuucuaggagcaaauggaguugacugaaguguaugacguguguuugaaauaaguaacuuuuaaauguugaagugaggugcugaaguaguuuaccugcaacugggcgaggcaggguuggggguggagggaaaguuuguuauaggacagcuuaguaaguaacgcuugaacuucauguauccuuuuaagagccuguuggaacuaaguauuguaguggcuaucuaguuugauccuagcaggugccagugacucaaacacuguuacagagaacuaaagauucguugaucgugcuuauuaguguugauguuucagcuuuccuuaaaauaaaacuugcagagauugaaggcucuuaaaauuauuugucugaaaauuaccacauauuacuuuucaguggcaggucuaaaaaaaaaaaauuauauauauauauauacacacacacauauauauuuuuauauguguauauauacacauauaaaauauauauacauauguuuuauauguauauauauacauagaaaauauauauacauguuuuauauguauauauauacauagaaaauauauauacauguuuuauauguauauauauacauagaaaauauauauacauauguuuuauauguauauauauacauagaaaauauauauacauauguuuuauauguauauauauacauagaaaauauauauacauauguuuuauauguauauauauacauagaaaauauauauacauauguuuuauauguauauauacauagaaaauauauguacauauguuuuauauguauauauauagaaaauauauacauagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacauagaaacuguauauacagagguuuuauauguauauauacacacauaaaauauauacuuguguguauacauaugugacuguaccauuuguuuuuuguauuaucugcaaaaagaugacuuuagaaccaaauauuuugagaauaacugagacuuuguuuuccagacaguugucauacuucauuggaaacauucaggguuaucaugggcuuuauauuauuuuuguucucccagcauagaaugugauguguauggaaaagaagggguucuaugagaaggauaguaguuucuggugugugugguuuggaagcaauuuaagaaaaguuaaagaaaauuagagugacauuccaaauaguaguuugaaauguauauuucaaauauaauuugaagaauucugaaaauuuagauuaagacuuuucagaugcucuugccagaauccaauauaccauuaaugaaacuacugaaguugaaaaaaauguuuauaagucacuagaauguaugauguacuaaugauggccagauaggacauuguaaauguuacuugcauucuaaugacauugaauaaagugauuuuuaaaaugacuuuuuggaggguuagagcuauauaggagaaauacagauuuuuuuuuuuuuuuaaaaaccuugccuaucuaauuuuggagcuguguuguacucaaggaguuuuuagccacaugaucucuauaacuaguuuuuuguauuaucugcaaaaagaugacuuuagaaccaaauauuuugagaauaacugagacuuuuuuuuucuagacaauugucauacuucauuggaaacauucaggguuauugugggcuuuuucuuucuuuaaauccagcucuaggccaagucauagaaacacuaggcucaaagcuauccugcucacugucaggagacugacucugaaaaugaucacuucugucuuaaugccauacauuuguauagcaccucaacaguuuuaucaaaauaauauaauaacauguuaguaguuuucaaaacuccccuuguuaggcuuauuacaggaagcaguccucuacucccuccuccugcugaguccuucacauaggcaucacuuuauacucuacuagcuguuucuuuuuccuaaacagucuuuauacuuuuaugaucuuagacaucuauggacuuauuaugaaagaagaaaacuuagcucucuuccucucacccuugacuaccauaucucuuuucccuucucauaaugguuuuuaugguuuuucuuuuauauuuaaugucugcauuaugauuauaauuuacuagcuaaguccuguuaauugcauguuaaacauguauuuucucugaccccuuuguuccuccaagaguuaguaauggcacuucuucucuccucuucacuuucuuuaauuaccuaucagaaauuauuuccccaaacacgcuaaaggagccauaaaaucccucauuaaggucauacacauuuggcagucuguuaaaucugcuuuuuuaaaauuuauauuguagugcuauccccucugaaacucuuaaucucauugcucuaguuuuuacuguuugcccccuaagcuggaugcauacugcuguugccaugggaacucuuucaguuucuuggcaauguggauucccuucuucuuaaauccuuuucguuuguauuuuuuuuauucucuuagguggggcacagccuucaauagcuuucugagaaaggagaccugcaggagaggcacacuuugagauccugcguauuugaaaaugucauuguucugcccuuacauaagauucauaguuggacuggcuauaaaagucuaaguuaaccuuucccucauguuugaaggcacuguuccauuuuguucuagcuucuguuauguucuagcuguugagugcacuguguuuggauaucuaauccuuuuugacuuuuucuuuugcuuccuuuauuccuaguauucuaaaaugucauguuguaccuugguauggguuauuuuauuuaauauacuggacauucgugcacacuuucacucuagaauugcauggccugacuuccacucuggaaauuuucuugcucuuuuuuuuuucuucaaaauaacuuuccaguuucuuucuuuucuuucuuucuuuuuuuuaagaacuuguaacagacagauguaggucauuccaucuggcuuaaucacuugauuuucuuaucugucuuaucccauugcuaaucuguuuuuauuuuguuuucaggagacuucuucaacuugauauuccaaacucauuuacugacucuuuuguuuuugcuaugauaguuucauuucccaagcaugaauaaacuguuuuuuucaauauccauguguaugugugugcuugugugugugugugaauguaacauuuucuuuuagaugauauaaauuauauucgucuugacauuuucaucuguucccugcauuguuuuucucuuugguucucuuuacucccucuacuuuuagucucaguguuucauguaaaaggaauauuucacauauuuggugucacugguugucuguucauacccaaaggaggugccgaagccgaucuaaagcucuuaauggauggagcuccuuggugcaguuuacuagugauuggauggguagccaggccacauucaagcaucucuaggucuucucuuggauucaucuuuuucucuaugcauaaaccuucuauacuccuaggagauguaagcaaggcagucauuucuaggaauauaaagaaagaaaugggaccagaauucuaacgagucagcauguggacuuccauuuaauguuugguuaaguaagguaccucauuuauccuucagcuaaguuuggugugccugaagucagggcuucucuggaucagcuuauucacauagcaaagucucugaucucagguugagaugaagaggggugguaggacuggcuguauuggaggggauuugggauuccaguugucccuuagguagacuuucaacuggauucacugcuuuuagugccaugaucaucccuaccuucuaugaaaugcggagugggaaugagauauaguaccagacaauaggaauuggacuauggaguaugaaagagaaaucuccauaagugaacauggcauagugggucacuuagaaacugaaugugccuguagaaaugagcacugcuuuugaauaugcugugaggcaguguggacaaaugaaauauuuguaucacauaggcccuaaguaauugaagacaccuuacugugguguuccccuacaaacaaaaaaaggacucuaucaaaaaaagugaaugggaguaucuggaauccagagucaagcugguuggaggaagcuuccuagcagcagaagagaucagcaauucucccauuggauacuggagguaacaggcagagccgugcuuuagauagcaguuucagaugguagcugagagggauuugaaaacaacaggcacaagcucagacagaaacaugaauucuccagcagggguugacagacaccucauacgggagagcucuggcucgcaucuggcaggugccccucuggaacaaagcuuccagaggaaggaacaggcagcaaucuuugcuguucugcagcuacugcuggugauacccagacauacagagucuggaguggaccucaggaaaaccccagcagaccugcagcagaggagucugacuguuagaaggaaaacuaacaaacagaaaggaauagcaucagcaucaauaaaaaggacguccacacagaaaccccauccaaaggucaccaacaucaaagaccaaagguagauaaauccacgaagaugaggaaaaaacagugcaaaaaggcugaaaauuccaaaaaccagaaugccucuucuccuccaaaggaucacaacuccuugccagcaagggaacaaaacuggacggagaaugaguuugaugaauugacagaaauagacuucagaagguggguaauaacaaacuccuccgagcuaaaggagcauguucuaauacaaugcaaggaagcuaagaacuuugaaaaaagguuggaggaauugcuaacuagaacaaccaguucagggaagaacauaaaugaccugauggagcugaaaaacacagcacgagaacuucaugaagcauacacaaguaucaauagccaaaucaaucaagcagaagaagguauaucagagauugaagaucaccuuaaugaaauaaagcaugaagacaagauuagagaaaaacaaaugaaaaggaauuaacaaagccuccaagaaauaugggacuaugugaaaagaccaaaccuacauuugguguaccugaaagugacugggagaauggaaccaaguuggaaaacacucuucaggauauuauccaggagaccuuucccaaccuagcaagacaggccaacauucaaaugcaggaaauacacagaacacaacaaagauacuccucgagaagaacaacuccaagacacaaaauugucagauucaccaagguggaaaugaagggaauaaaguuaagagcagccaaagaggaauuacccacaaagggaagcccauuagacuaacagcggaucucucuguagaaacccuacaagccagaagagagugggggccaauauucaacauucuuaaagaaaagaauuuucaacccagaauuucauauccagccaaaugaagcuucaaaagcgaaggaaaaauaaaauccuuuacagacaagcuaaugcugagagauuuugucaccuccaguccugccuuacaagagcuccugaaggaagcacuaaauauauuguuguuguuguuguuguuuuugagacagagucucacucugucacccaggccggagugcaauggcgcgaucucggcucacugcaacccccgccucccagguucaagugauuccucugccucugccuccugaguaguugggauuacaggcacccacuaccaggccuggguaauuuuuuguauuuuuaguagaggcgggguuuugccacauuggucaggcuggucuugaacuccugaccucagaugaucugccaggcucagccucccaaagugcugggauuacaggugugagccaccgcaucuggccuuggaagaacuaacaauggaaaggaaaaaccaguaccagccacugcaaaaacauaccaaauuguaaagaccagugauacuaugaagaaaccacaucaacuaaugggcaaaauaaccagcuggcaucauaaugacaggaucaaauucacacauaacaauauuaaccuuaaacguaaaugggauaaauaccccaauuaaaagacacagauuggcaaauuguauaaagagucaagacccauuggugugcuguauucaggagacccaucucacaugcaaaggcacauauaggcucaaaauaaagggauggaggaauauuuaccaagcaaauggaaaacaaaaaaaaacaaaacaaaaaaacauggguugcaauccuagucucugauaaaacagacuuuaaaccaacaaagaucaaaagagacaaagaagggcaucacauaaugguaaagggaucagugcaacaagaagagcuaacuauccuaaauauauauccacccaauacaggaggacccagauucauaaaacaaguucuuagagaccuacaaggagacuuagacucccacacaauaauagugggagacucuaacaccccacugucaauauuagaucaaugagacagaaaauuagcaaggauauucaggacuugaacucagcuguggaccaagugggccuaauagacaucuacagaacucuccaccccaaaucaacagaauauacauucuuuucagcaccaugucacacuuauucuaaaauugaccacauaauuggaaguaaaacacuccucagcaaaggcaaaagaauggaaaucauaacagucucucagaccacagugcaaucaaauuagaacgcaggauuaagaaacugacugaaaaccgcacaauuacauggaaacugaacaaccugcuccugaaugacuacuggguaaauaaagaaauuaaggcagaaauaaguucuuuaaaaccaaugagaacaaagacacaaugucccagaaucuaugggacacagcuaaagcaguguucagagggaaauuuauagcacuaaaugcccaccagagaaagcaggaaagaucucagaucaacacccuaauaucacaauuaacagaacuagagaagcaagagcaaacaaauucaaaagcuagcagacaacaagaaauaacuaagcagaacugaaggagauagagacaugaaaaacccuuuuaaaaaguuaaugaauccaggagcugguuuuuugaaaagaccaacaaaauagauagaccgcuagccagacuauuaaagaagaaaagagagaagaaucaaauacacacaauaaaaaaugauaaaggggauaucaccacugaucccacagaaauacaaacuaccaucugagaauacuauaaauaccucuaugaaaauaaacuaggaaaucuagaagaaauggaucaauuucuggacacaaacacccuccccagacuaaaccaggaagaagucgaaucccugaauagaccaguaauaaauucuggaauuaaggcaguaauuaauaaccuaucaaccaaaaaaagcccaggaucagauggauucagagccagauucuaccagaggugcaaagaggagcugguaccauuccuucugaaacuauuccaaacaauagaaagagaggggcuccucccuaacucauuuuaugagaccagcaucauccugauaccaaaaccuggcagagacacaaauaaaaaagaaaauuucagcccaauaucccugaugaacaucgaugugaaaauccucaguaaaauacuggcaaaucgaauccaacagcacaucaaaaagcuuauccaccacggucaagucggcuucauccccgggaugcagggcugguucaacauaugcaaaucauaaacauaaucaucacauaaacagaaccaaucacaaaaccacauaauuaauaggugcagaaaaaggcaucgauaaaauuuaucacccuuucaugcuuaaaaacucucaauaaacuagguauugauggaauguaucucaaaauaauaagagcuauuuaugacaaacccacagccaguaucauacugaauuggcaaaagcuggaagcauuccuuuugaaaacuggcacaagacaaagaugcccucucucaccacuccuauucaacauaguauuggaaguucuggccagggcaaucagacaagagaaagaaagaaaugguauucaaauaggaagagaggaagucaaauugucucuguuugcagaugacaugauuguauauugagaaaaccccaucaucucagcccaaaaucaccuuaagcugauaagcaacuucagcaaagucucaggauacaaaaucaaugugcaaaaaaucacaaguauuucuauacacuaauaaugaacagccaaaucaugagugaacucccauucacaauugcuacaaagagaauaaaauaucuagaaauacaacucacaagaaaugugaaggacguuuucaaguacuacaaaccagugcucaaggaaaucagagcggacacaaacaaauggaaauacauuccaugcucauggauaggaagaaucaauaucgucaaaauggccauacugcccaaaguaauuuauagauucagugccauccccaucaagcuaccauugacuuucuucacauaauuagaaaaaacuauuucaaauuucauauggaaccaaaaaagagcccauauagccaagacaauccuaagcaaaaagaacaaagcuggagguaucaugcuaccugauuucaaacucuacuacaaagcuacuguaaccaaaacagcaugguacugguaccaaaacagauauauagaccaauggaacagaacagaggccucagaaauaaugccacacauuuacaaccaucugaucuuugacaaaccugaccaaaacaaguaauggggaaaggauucccuauuuaauaaauggugcugggaaaacuggcuagccauaugcagaaaacugaaaccagaccccuuccuuacaccuuaugcaaaaauuaacucaagauagauuaaagauuuaaacguaagaccuaaaaccguaaaaacccuagaagaaaaccugggcaauaccauucaggacaugggcaugggcaaagacuucaugaguaaaacaccaagagcaauggcaacaaaagccaaaauugacaaaugggaucuaauuaaacuaaagagcuuaugcagccuacugaaugggagaaaauuuuugcaaucuauccaccugacaaagcgcuaauauccagaauccacaaggaacuuaaacaaauuuacaagaaaaaaacaaccccaucaaaaagugggcgaaggauaugaacagacacuucucaacagaagacauuuaugcggccagcaaacaugaaaaaaagcucaucaucacuggucauuagagaaauguaaaucaaaaccacaaugagauagcaucucacaccaguuagaauggcgaucauuaaaaagucaggaaacaacagaugcuggagaggauguggagaaauaggaacacuuuuacacuguuggugggaguguaaauuaguucaaccauuguagaagacaguguggcgauuccucaaggaucuagaaccagaaauaucauuugacccagccaucccauuacuggguauauacccaaaggauuauaaaucauucuacuauaaagacacaugcacacguauguuuauuguggcacuguucacaauaguaaagacuuggaaccaacccaaaugcccaucaauaguagacuggauaaagaaaauguggcacauacacaccauggaauacuguucagccauaaaaaaaggaugaguucauguccuuugcagggacauggaugaagcuggaaaccaucauucucagcaaacuaacacaggaacagaaaaccaaacacugcauguucucacucauaggugggaguugaacaaugagaacacauggacacagggaguggaacaucacacaccagggccugucgagggguggggggcuaggggagggauagcauuaggagaaaugccuaacguagaugacaguugaugggugcagcaaaccacuauggcacguguauaccuguguaaaaaauccugcaccuucugcacauauaucccagaacuuaaaguauaguaauaaaaaaauaaggaaaauuggugaaaaaaguauugagauaaggaaacuccacaguugacuaacuaguggcucauuucugucagggcugugguauucauggcuuuuuacauacgugguagauggcagcuaugaauuucucaucuuaagaacacugaguacuggucauggugggucacaccuguaaucccagcaccuugagaggcuaaggcaggaagaucacuugagcccaggcuuuugagaccagccucgacaacauaggaagaccacaucucuacaaaaaaacuuauaaaauagcugggugugguggugcaugccuaugauccuagcaacucaggaggcugaggugggaggauuacuugagcucagaaggucaaagcugcagugagguguguuugucccacugcacuccagccugggugacagagcaagaccaugucucaaaacagaacaaacaaaaccacaaagcagugauuccuuaucuugugacuuuuuaaaaacugcuuuauuggaauacaauuaauauguaaacugcacauucuuguaauguacaauuugauagacuuuaacauguauauauacccgggaaaucaugaccacaguuaauguguagugaacagauuucaacacuugaaguuuccuguggccccuuguuuuccuuauucuuucccuccugauccuugcuaccuccaacccaggcaaccccugaucuguuuucugucaguuuagauuagucacccagacuggaguucaguggcacuaucucagcucacugcaaccuccaccucucggguucaaaugauucucuugccucagccuccugaguagcugggauuacaggugcaugccaccacaugcagcuaauuuucguauuuuuaguagagacaggguuucaccauguuggccaggauggucucgaucuccugaccuugugauuugcccaccuuggucucuaaaagugcugggauuacaggcaguuugcauuuuuuauaguuuuauaucaauaaagucacagacuauguacucuuccauuuguuuguuuuggucuggcuucuuucaagcuagauaguuauuuugaaauuuguguuauuacaugaaucaguaguucauuuuuauugugggagcuguuagauuucaucauuguaaccauggcuuguuuauccacucaucuuuugaugggcacuuggguuguuuuuaguuuuggguuaugacaaauaaaacugcagacauuuauguuuaagucuucauaugaacaugcuuucauuucucuuggguaaauacuucugacuugagugucuggaacagagaguaaguguagguuaacuuuuuaagaagcugccaaacucuuuuccaaagugguuucaccauuuuucauuuucauaaccaguguaugaaguuuucaguggcaccaaaucuuucuuaacacuugcuauggguaguauuuuucauuuuagccauuccaauagguaugugguagaaucucauugugguuuuagcuauuuuucuaaugauuaaugaugaacaucuuuucauauagcuguuugccauaauaggucuucuuuggugaaauguguaaucgaaacuuuugucuauuuuuaaaauugaguuguuugcuauuuguaguuucuuguuuucugcauaaaaguucuuugguagauauaugauuugcaaauaugucuuucccaaucugugguuuaucacucauccuuuuagcaaugucuuucaaaaagaaaaguuuuuaauuuugaugaaguccaauugauguuuuuucuuuuauggaucauauuuucagucuuauaaauuguaucuaagaagcauuugccaacucaaggacacacauacuuuuaccuuugguuucuuauaaaaguguuacuguuucaaguuuuacauuuuugucugugcucuauuuugaguuaguuuuggauaguguuuguacuguggaucaaaguuuuguuuuuuuuuuucucacauauagauacccauuuuguuccaacaccauuuauuuaaaagacuauccuuuaaauuguguuuuacuaaaaauccuccauauaugugugguuuuauuucugggcuauuuuuuuccacugauccguuuauuuuuaugcuacacuaaacuguuuucauuacugucaugagcuucaaucagugguauagcucuccauuuuuuuuuuuuaacauuuguuuggcuauucuaagaucuuugcauuuccauaugaauuuuagaucaucuacauuucuacaaaaaagcuugcuggaauuucuauugggauuuugcaaauuauguggaccaauuuaaggagaauugacaucuuaauauuuaguuuucuuacucacgaaaauggcauaucucuccaguuauguccucuuuaauucucagaauguuuuguagucuucaguguucagguccuacacaucuuuugucagauuuauccuuaagcaucugaugguuuuuuaaaaaaugcuauaguaaaugaaaagugaaauuuuaaaaauaugaauucguuuguuguuaauauauauaaguauacaauugacuuuccuacaucaaucugguaucuuacaaucuugcuacuaaacucacuuaugcuauuaucauuuuuguagauucuucagauuuuuuuuacauagaugaucaugucaucugugaauaaagacagauuuacuuguuucuuuccaauguaaauguuuuuaauguaaugccugauugcauuggcuaggaucuucagcagaguguuaaauagaagcgaugagagccaaugucugugucuguuugauaucacaggcaaagcauucagccuuuuaccauuaacuaugcuguuuuuguagaugccuucaaucagguugaggauguuucuuucuguuuccgauuugaugagaauuuuuaucaggaguggaugucaaaugccuuuuuuuucuauugauauuauauacuuuuucuauuuuaguuaaucugauaaguuauauugauguuugaauuuguaccaacuuuuuauuucugauauaaaccccacuuauuaauggugaaauaugcuaauggugaaguuagacucaauuuacugaaauauuuagacuuuuuacaucuguguucaugugugauauuggccguuaguuucuuaauuuguaaugucugauuuuggugucaagguaacacugcccuaauaggauguauuaggauguauucccuccucuucuguuuuucggaagaguuugugaagaacugauguuuucuuuaaauacuugguagaguuuagcaguaaagucuucugggcccagguuuuucuuuguggguaguuuuuuauuuuuuauuuuuugauuacuuuucuggcuauuuacuuuuaacuuauuuguuugcccauguuuaaggugcguuuccuguaggaagcauauaauugagucuuuugugacacuuccaccucccuuuaaggaaaaacuuguccgcaagcuuaucagaugauuuucucucaguuucuguuggcuaggauugugucuggggcgugggccuaaaccagucaggcaaaggggaacaaugaaaauaccaugauuggcuuagcugagugccucucaagauguggucuccagaccgguaauauuagcaucaccuggaagcugcuuagaaauccagauucuuugacccuaugcaucaaacuuuuaaggggugugguuuagcaauuugucuuaacaagauguuuaaguaauuuugaggcaugagacauugagaauaacuagccuggacuaaccuauacuugugaguagggagaaguaccguguacugggcaguuuaggcuauguugcaaggaaguggaagggauuauuaccuacauagguaggugauaaucuugccauaguaggacugagcuggggcccaagaauaugauuuuuaacuauauauacucuugauggagucacaacugugcaacacacucuaaggaaaaaaaaaaauauauuggacuuacaauuaaauccauugagaucuauauuuuagaguccuuaccuguaacuggagugaacaaacugucucaagggcaaaucagagccguugcauguuuuguaugguggguaagauacgguuuuauguuuuuaaaugaugaaaaaaaauacaaagaaugugaaaacuaugggaaauucaacuuucaaugucuauaaaucaauuuuaaaggaacacagccacguuuauucgcuuacauauugucuaggaugccuuuggacuggaauggcagggcugaguaguugugacagagaucauguggcuuacaaagccugaaauauuuacuugccgguccuuuacagaaaacauuuggcaaucccugaucuguaagaauaauuuacugaagaauaguacauuccccaaccaucuuguauaacugauaaauuacucuaauaggugaacguuuugucuagaacagugaaaguaugaauaaugaaguauguuauuucaagaauaugugcuuauuagaauugugguagcuuuguuggaaagaagauuacuuuagauuuguaauuaauguaagcuuauaguaguaaggugucacguauuagagccagcaguuuuggggagguaauucacccuccccccuuuuuuaguuaacugcuguuuauuccucaagauaaaccuuucuguauagcccuaucacugaaaauauucuaaaaucuaccuuaacauggcauauuaaugagagaagcuuuuuuauaacuugcagugccuccggguagucauuuugaauacuauccauuacuguguaauuguguaggugcugaaagugaagucuucguaaaacauaucuuuuaaagcucuuuguuuggcuuuaaugaaaaagaaacauauaccaagguuaguauagauuugagacaggagaaauaugugauuauguaaggguucaaagaaucaagugacuggcuuuuacggguguuuagacuuauuuuuaaaaaauacacauaagauuugccuuguuugucacaucauguuuaccuucauuagcccaaguuuacaaaagauucuguugccaaagagaaagaugaaaauguucauuucuugacaugucaauagagauaguaagaucaugauagugccuuuuuagggcuaguuuaguuaaaaaaaaaaaaaaagcccuugaucucugaugcugaaacacacaguuagggggaaaauuguuagaccuuuuuuuggaaguucucaccaggcuacaggaagugucauauucuauuuggggauauuugccuguuaaaaacuauuucugauacuuugaagucaucaaauaugaguucuguuucuauggaaauuguuaaauacauguugcuuuccccagagagagguacucucuguauaccuauaucauaccuauaauguagauuucuuuuuuuaagguuauacauuggcucuucaaagacguucaccucaucagagaaaucccugacuccuuugcagugguguagacauguccuagauaacccaacuccugagauggaagcagcgagacguucccugugcuuuagacuggagcaagguaauugugagugugugcauuuacauucuccaacucuugucacucucagugcugcuuuuguugcugguuuuggaauaaacauuucaauugaaaauucuuacccugaggugcagcuguugcaugcaauuugcuucacauguauuacacaucaagcuuucucaauguaagauguguuuaguuuugugcuugauuuuagccauauuuuuaguuugcuuuaguucauauugcaauguaggaacacacaaauuuauuucuuuuuuuuuucuguuugcaaauauaccagucaaaaaaauugucaguuaucagugcucuggggucaguaacaagguuguguggcuguuuucuaaggcagaaaacaggauuucauggggaucugaguacugaccuuacugagugucuuuaacauuuaguuggauguauaacuggaagugcuaaccuuuaaaaacuaagaaaucuucauauugucuguaacauuaauuaacuuauggagccuaacagaaguuuaaauuuaaaaaaagggcaguuggaaaaacagcaaaaaugaaugagugguacucaguuccuugcuauuugaugcagggaacuacuugaagcuguaauuauguaggcuuuuggcuugucucuuaaccucugggcaucuguuugauccucugggaacacuguuucuauuccauggaccaccugcauccaaaucauacaugagcuucaaaguacagauuccggagccuccagauuaaagaaugauacuguuugaggguagagucaggggagucugcauugagaaguucaccagugugauucucauguacacugauauuugagaacgcugcccaugaagcucuuugaggauaaugaauaacauguuuggacauaagacaaagcauuauagauaaugcuucaagagcucuuaauucuaugacauucauuaccuuuacauucuugacauccuucaucuuauucaguguaacugaacucaucuuuagaggugagaaauacgaaguuuagagaaguucccaggguuacaaggcagaaugauacucagggacagagucagagccagggucucucugaaaccagagucuccauacuuaauuaguauucuguacugccguauuggcauggucauaaguaaauaucaacagaaaucuguuaaauacucggaaggugggaugaaagaauguauuuuauuaacauuuuaacugaaaugaaacaggugacuuaauaauggaaaguugaagagcaguguagggacaaaggcauguuaggguuaaaacuuuggugauagaugcucaucuaacagagcagccaucucagagucggaggcuguaguauucauucuguucccauuuaccuaagugacucgaagaaaacugauacgguuuggcucuguguucccagccaaaucucaucuccauuuguaauccucacauguagagggaggcaccuggugggaggugacuggaucaugggggcgguuucccccaugcuguucucaugauagggaguucucaugagagcugaugguguuaaguguggcacuuccucgcucuuucacuuucucucucuccugccaccauguaaggaugugccuugcuuccccuuuaccuuccacuaugauugcaaguuuucugaggccuccccagccauggggaacugugaaucaauuaagccuccuuucuuuauaaauuacccagucucagguaguaucuuuguagcagugugagaacagacuaauacacaaaccauuaaaucccuuuggauuaacucuuugaaggguuauauagaccauuccuaagccuccuuacuuaauccuugacucagugacuuauaucuacauuuuaacauacaaauuuggcucaauaauuugaaguaaaauucaaauugaauucagaauuaguccuuuaucucaggggucaacaaacuuuuuuuugaaaggagauagauagucaauauuuuagauuuugugggcuacauaaucucugucaugacuguucaacuuagccaugcccagaaaacaaugaucaaugcagaaauuaaugaaugaggaugcauuccaauauaacuuuauuuacaagcccugacauuugaauuuugugugguuuuucacgugucacaaaauguauauauuuuucccaauuauuaaaaaaauaugaaaacauuucuuagcuggugaauuauuacaaaagcaggagugggcuggauuugggguacucucggccacaguuuacccaccccggcauuaagucauuugcacacuagauagauuuacauacauauaagcauuaugucauuugcacacuagauacauuuacauauaagguuagguuuuuuuuucuuuucuaaaaaguaauccuaauuggugguugcuauugagauauuagacuaagugcuucauuauccgauuuuccuuucauugauguggagcucaggcagaaucgugaggucaugaggauaggaacuggcauacugcaguuuuguucaugauguaauuuauuuaaacuuccuguaaaaguuuagagaacgaguuuuucaaaaccaaaauuagucuuuuacuuaauuuguauauaaacucaaaacuucuuuugcugugacacuaaauguuuuuauuccagagauccauaauccauaauccuguugagauaagaaguaaccaauuagguuguuuacuggagaaaauucuuuuuuaaaaaauucaacuuauauuuuauaaaauauaguuuaaaaaauagucuuacaacuguuauaagacaaauaucaaauugcugccccaaucucucaugcccuuuuuauuucccagauauacuuaagaaaagcuauuuguuuugguuuuacuguuuaccucucuuuuuaaauuccauguuuauauggccauugcuuugaauuuuuucauuuuaaacauuauccauuggcuuuugacuuuggauggugaagauuuaauucuuuuacaccucacuucuauauuuuuucucugcauguccuuucuauguaaccuuuuacuaccuuuaggggacaucaguauauauuaugauagaaaguuauauucaagccaugcaauauuuuaucauuucuuuuuccaucuaacuuuuuuguuuuugagacagauucuugcucugugcccaggcuggagugcagugguguaaucucagcacacugcaacaucugccuccuggguucaagggauucucuggccucagccuccugaguagcugggauuacagguacacgcaaccacgccuggcuaauuuuuguauuuuuuaauagagaugugguuucaccauguuggccaggcuggucuugaaugccugaucucagguaguccaccuaccuuggccucccaaagugcugagauuacaggcgugagccacugugcccagcccaucuaacauuuuuuuucagaauuaauuggaaaaagacaccuaguuuuguuguuguuguugcuguuauaauuuauaagacaggguccuugucauuaauuuauccccaaacucucuugaugaaccauccgcaguaugagacacauaaauccaagaauuuuguuuuguuacuguuccuucaggcagcgcccuauucucuuacucuacuuggaacuagucaucuuuagccucugaagagccaucauggugggacuuucuuuugcuuauccugggaauuucucuggccccucuucagugcuauauuaccugcuucugagauacaaguacuuuccuuucuauuccauuaaaagaaacgaauauuucugcauuugcuuuuuugggagaguagagggaaaaaggauauguggcagguaaauuuugagaaccuccuguguuucaaaacaucuuuauuccuacuuucacucuuaugcaggauuguuauuuggguuagguauagaauucuagguuaaaaaccauuucccacagaguuuagaaggcauuauuccauuauauuuuagcuucgggguugcuguugaaguucagcaccguucuuauuucugauucuuauuugugaccuuucuaccuaaaauaacaugaauauuuuagaauauugucuuuuauucuugguauucugaaauuucauuuauuuugugugugcuauaaacuuuaguucugcaaaauuucuugcauuauuucuuuguauucguagcccuccgcccuuguuuucucuauucuuucuagauacuucugugggucagaaucgccuagauugauguucaaauuuuauauuuuucucucuggcuuucuauucuugauuuuguugcuguuguucuacuuuuuuggagauuaaaaaaaaaaaaaaacacaucuucuaaacucuacugcugcauauugagugacuucuauguaccagguaccauuguaggugauggagaugcaucagugaacagcacagguauuaagucucugcccucauugagcucaccuucugguauucagauuuucacuuaguccuccagaucuguaagguauuuuuauuuguguuuguaaaaucuaguggcuuucuauuucaguuuauucagguaaugaagccugucuuugaucaaaguaggagaggagcaguugccugagcaggcgggguggggagcuggaggguuuaggugcuuuccuauagauuuucagucaccugguuuuuuucacuucaccacaaaacucccuacccucugugguacuucgcaccuacgauuccagaaccuugcuagguccuuauuaguuucuuuuugcuguaaggccauagaacagaggaugucaaaacccaagucucuuccgcuuuucauuucuaagauguugugaccaucccgagugugauaauugucuccugucccguucagucuuccuauggcuuuauaagaguuugaguuuaacucuuacuguagugugguuuuauaagagaauagggaggaauucauaguuaaucccccauauugaagaauacuuacuggcuuccaauuaaggggguccuuugucaaugaugguuaauugacagauaucaaaaauuaugguuuugacccacacuuuauucauaacauaaagauuuaauuggaauaaugcgagcuuuccauauuuuugguuucaauaauucucuaauaaagcauuuuucuuuuuuuuauuauacuuuaaguuuuaggguacaugugcaugaugggcagguuuguuacauauguauacaugugccauguuggugugcugcacccaguaacucgucauuuuauuuuucuuuuugcuuagacuuaauuucucccuugggcaguccgcauuuuugaguaacagauauuacugaguguuuucuuugagacuagaguuguuucuuuucauuugaauauaaauugcccaagggaauggacuuuguuuuguugagcaccaguucucuaauuccuagaaggguaccugacacaaaauagaugcuguugcuaaaguaaaugaauguuuuuuugagcccaauguaacuauuacuacuguuucaguuuugguguugaauaauuuaagaugggucgggguccuugcaacauuuuccuuauuagccaccucuuauauucagggcauagacuagcaucaguugaaguaucagcuugcaguauugcuuucccauucacaagcauguuuacucuaaaacagucacuuucuacuuaucuuacacacuuuguugcaaagugauuaauugaaguccuuaggaguuauacaucucccucuguauacacagaaauuaaagacacuucacuaagaaauucacagccaugaguaggagugaugagagguaaacaaaggguaaagcuacccucuccuuuucacccucuuccucucugcauuaugcuuuugucucucauacucuuaacucuuucauugacagauagguaaaaguuccuuaaugugagccuggagcuucagaugagaugcugcugcuuauguaauauuugagcaaauauuuucgaaacuugguuccucuuuuuugaccuugauguuuugaaaagaaaauucuucaaaaaguaaagauuaauuccuuuguaggaaauguggagaggggcauagcugugaggagccagaauguuucuggugggcagagcuggucuuaaacccucuucuaccuuauuuccucuuuacccuaggccguuagcccagucuguuuucuuggcugcaaguuagccacggugguaaguuagccgucccuccuuguuuauggaguaagcauccccaggaagccaucugaguaaggguuugucaagguugguuucuguagguccaucuggcugcauuucucccaagauugucucuaacugcacaauugcuaaugagcuuauuuguacuguaacuucuugcagggcccaggccuauuucucuucuugcugccuacauuugugauuucauagauuccucaaaaagcuuucaugauguaucugacaacuuuugacccuggaccuagauaacaaaacuugcuaaguuaugagagaauguaugggacacaguuaagcuuugucuugagauugugagaacaagcuuauuagaauucugcccuucugcagaaaguuuuuuuuucugaagaaaaugaaggaaagggauuuuuauaagauuuaauuuuguagggagacagcaccugcauuaucacuguuuuuaaaauauugcuaaaaaauacguugucuucacaaccacaauuuugcaaaugguuaaauauuuuuuaaaagauauaauaagauaguuauuuuuagugcauauaguauauuccuacagaugacuaauauguaucuaauaccccuaauucuuauagggaauauuaauugacuuggaucuaagaaacuuuuuuuuuuaaagacagggucuuacucuauugccuaggcuggagugcagugacgcaaccacggcucacugcagccuugaccucccugggcucaggugacccucccaccuuagcuucccaaguagcugggacugcagauguaugccaccauaccuggcaaauuuuuugcagggucaggauuuugccauguugcccaggcugauauugaacuccugggcucaagcaaucugcccaccuggccucccugugcugggauuauaggcaugagccacugugcuuggcccuaagaaacuuuuuauuauaaauugcaaaacuuacuauccucuuuuccaagcugaucuuuuaauauucagauuuuacaauuuauaaagucuuguguaucauguagucagcacagucaaguuacuuaaguuuucucagccucuuuuacauuuguauuuauuuuguaguguuguuauaaggaaauagauauuuguaaauuagaugagauaauggcucaaauauuaggugucucccccuuauaugugaauaguguaaauggcuuuuuuggauaauuuacagaaaguaauguuaaaagugaaauaacauugcuggaaauuaaaaucuccuggcaucucuaaaucugcagucuguugguauaaaguuaacuaauaaagccuagaauagaauaaucuuucucuuuuuucccccagaacacuggccacuuauuugaguaugcagucuucaacaaagcucaguaucuugguugguuuuccucuuuugaagaugguccuaacgauguuugcuuucuauuucgaggcacccuguuuugugaacuucuuuuuauuuaguuguuaauguaugugacuuuuuccaaauagauuaagcaucugaagauggaggucuauaccuaaaauuguuuuuugaauugccagugcuuaauaaauuuuucagcauguuuuaaguacugaauuuuuuuugugugauugacuaauuugaguauguuuaaauuuuuuaaguugggcaaaaaaaaaaacaaaacaauuuucauugaacauuugguguuguaaauggcauccuacuagccaagccaaaaaaaaaaaacaaaaacccucaaaaaaccaaaacagagugguguucauuaaaguguuaguucugagcguggggguuucagucuguuuuguucauugcugugacccuuucugugccuggaauaacucccaucgcacuguagguguuguaugcuaguuguugaaggagugaauaugguggaaguuuucaccuuaauaguuaugccucaucccugcuccacugugauugagaugguuguccuuauuucuagggccuugccuaguaaguggggacauuuagcagauuucacagggcuauuuuagaaagauuucuggaaauauuggaugugaaauuacuucagaaauguggaguacuacauauacagaaacauuccuaauguacagauuuucauuuagaaauugaacauaaaauacagggaauccucuuugccuggcuacuuauacuucauagaaaacuaaguguguuuuuggcagaggguggguaucuguuuucucuaccuacaaauacagguauuuguuagggaucuuacacugaaaaauuuuguaaguguaguuuauuauucaacauagaaaaucuacaacaaucucuuuaguugguuguuuuuauuuuauuuuuuauuagaucuguguguauuccauuucuaacucgcccaucuuucuaaccccccucuaccccuuuagaauaaaaauaacaaaacugcauagaacuuucauggguaggauuagcucacuugauauccuaaauugaaauaaggcuaaucuagggucuuugguaaauucacgcaugaggcugggauguuaaauaaccaaauaaugaucaaaggcuuaucuaaguaauuugaaacgcccaaaauguggcucaguuaauuuggggccaguuaauaaaagcuuaucuuggcuuaagguacuugaaugucuauaacuauugaaucaggacaggucacauuugagcagaguagguguacuuuucacaaauaguggaggccuacacaauuauauccuuggcucauguuucgcuaugaccaucugucauuuccucugggauuagauacuaaggaaaugugaauagaaauuaccccauucauugaguuuuucuuuuaucuucauaugguaccaguucccaaucuuauuuuaguuguuauaaaggaguguuaauguccaaauuuagcugaugaagaagaaaguuguagacuaauccacaguucugcgagugacccuuucuuuuguuaaaauccacacagauugaacugagacauuaagcuuaucaaaugucugucuucuggaaccuguccagucucuccuugcuuggcccaagauguuaucuccacuagcucauauuucuagucucgagaugcucugucaaacuuggaacacaaaauuaaaacuuagucugugagguucauuuuggguaagcuuuguaaagaauuucuuuucucacuggaaaaacaaucuggaaucauauuggaauuuuugugcagagacagggucuccugauacaugcuaucauuccugugugcugaaaauggaaaaugcauugucauagcugugggauuucaucacaucuuuauguugcuuugcucuuauguucagaauagccccagugcauuuacuucaguauuggcaaugauuuaguacaguaacagauaauaagggauugugcuucuaugaaauuugcaguuucaguccauuauacccuacaaccugauauguguuugccaaauuuccuuaaguaauccuuuuuucuuuugcuaauuuguacuuguguuuccauguguuuuuuuuuccuuugguuucacuuugcauuucuaccaugauucgaaaaguguuuuucaaaauaaacaauaaugguuguucuggugaauuuauuauugacaugcuauuuuguuaccuaucuccaccaaggaaaaaauaaaacaauagagauucucccaaaguaguugucuacugcuuucauacuacugugacgguugauuaaauuugacucuaucauagugaaauucuuuuuuuuuuuuugguagguguugguaccuguuucuugggaccucuacagaauagucagguuuaaagcaagacuuucuagacucucuuuucugaaacacuggggcuugaucagaugauuacaauacaugaaauguguugaguacuuauuagguacagucagugcuaaauacagggugcaguggcaagcaagaugagcucagugccuggccuugggaacaugcauucugaugcaaaaaacagaugacaagauagcaguucuuuguucuuccugucccauaaaagaagcauaaugaugcgaauggcagccugacccagggguaugaucagaaaaugauuucccaaagacgugaggcaucagcugggaccggagagucagugggaguuaagccaguaacucuguguguguguguguguguccguguguccaucuguucguccauccaacgggaggaggaggugaggaagagugucccaggccuuuucugucacuaggauaagccauaacucaaagaagagucuuucagucucagagacauuggagaggaaggauagcaauagcauguggaaaggcccugcagugggacauaaugugaggaaacggcaggcuguugugguugggguguaauggagggaaaugacucuaaaugaaacuagaaacuagacaugugugcagcgucuucagggcaguuaaagauucuggauuuuaucuuaaaaugguugaaaaaccuuugaauaauuuuuaguaaaggagugauguaacugaacagcuaagcuacaggauauuaccugaauugucuuagaaggcagagccuuuuuuggaaaucuggugaacuguggagagugaaauggugguuuuagaaauucuuuggaacauggguaagguuaggcuuuagcaauuuuuaagggagagucuuagauaaacuugggaauguuuucuucuuuuucauuaauaucccaaauuucuuaugugacuaaugugagaaaugguagaugaaaauguggccaaguucucgugacacuuaauuuacuucggaaacauaaggguuugauuuguugauguucucaauuauuuauaauauuugggagcuuuaaacuucuauauaguaauaaguuuaauauauuugaguuuuggagcucuugucaauuugugaguuuaauuuuuuucuacugucauaguuguaagguuguauuucaagaaacaguguauuuaaauuuacuaggcuuuugaaaugcagauuugcugucaucggguguguccuguacuuguguauauguauuugcauaugcaugcucagucuggucuuccauuuuuauagcauuuucagauaaaugaaguuggaucaguaaaaggauaccugcugggaaaacaagcaauuaaaucauaaguuuuuuggucauuuuuaauuucuuagacauauugaaggaagaauggacagggcuaagaaccaagcugcuucucugaaaguuggccaaaggaaucuaccaaaaugggauggaaaauaugagagaagugaggggacaaaagaagacagacccagaaccucucauguuuuaacaggaguucuagaagcaggaacguacugaacaaaggaaauaaucaguaaauaauagaagaaaauuucuuugacagauccucaggaugaacuaagauagaugaaaaaaagccaugcaccuagaucuccugguuauugaauuucagauuuuccagaauuaaagauaaacuauuccuucauuugaacauuauugggaguuuaucuauaguauaacaaauuucagacauuuuauaaguaauauuggaugcuagauaaaaaauuaauauugucuuuaaaguuuuaaggaagaaaguuauuuucaaacuauaauccuguaccgaagcaaauaaguguaggagcaaaagaaacuuuugcuuaugcaaagucuggauuuuaucuuaaaaugguugaaaguuuuacccuuugugcacccuauuuuaacagugggaaacguacaaggaaaaaagaucacaugagaucuagaaaacaguagccucggagaugaccuaggagaagcugagaaagaugaagaugaaauaagacagugauugacucucaggcuugugauguucuucaccugguaguuguguucuagagcagaaaaauuacuuucuuuaccuugguccugucguaucuagugaucaccuuauagcuaucccaaucacagcuauaaaacagaaugaaaauccaguaaaccuugacaguguaaaaauagaacugucaaaucuggagauggauacggagaaggugcauauauacuaaauaaccuuucauggugggaaaucagauaccaacaaggcgaugauuggauuuucuauugucuauuuaaaguuauauacuaauuauguaauuguauugaaauuaugaaaaacaaaguggaaagugggccuggguggggaaggaaaagagacuccuguuuuaggccuuuaauguauauuuuaguguuguuuugugugcagguauuuuaauaaaaucaugaauggguuaguuuuagggccaaagauaguuuucccuuggucagaacucugaauuuguauauuuacuuucuaucgucucuuaagauuagugggucagaggccuuuucuguuacugggauaagccauaacucaaagaagagucuuuuaguaucagagacacuggggaggaaggauuauacaaauucucuucucaucacucuuccauucaauaacugacagugcuuucuaaaagcuuggauuugccaccacacuuuacccagucauaggcgugaagacucuuaguaaaaaucuagucuguccuuucagagggagggcccucuguuuucagcaugagauuauuuagccuauuucuucauguaauuagauucuguaacauauugcuuaccuuaccucaugauuucaguguagaaccuguaaguuauucuagcugguugucagcuugcauuguggcuguagucuaaauuggaagcagccgucuguaaucuguuugacaacaucucaucguugccaaauuauuagaucagucuucuucuuuguucuuuuaagauuaaauuauuaaguuugauuuaaacuauagcagacacacagaccuaaagggaaaauggcuucuauaaaagggaauuuuuaaacaugccuuugaaguguaauuacuacuacauuuuuuuuuuuuaaaucuccacuauuaauugcagaugggaagucagaagaugacuugugaaguuguagcagucacucugguccuggauaauacuggauuugaucuggugugcuuaaagcuguugucuuaucuucaguuuugaccaaugauuaaguggaaacaaguugauagucaagauaacuuccccuuucugaccuuuauguuucagcucuacuuugagacuguuguccugguuaaagaagucccgcagaaggauccgauaauagucaugagggaagagcauuagaugugugaucgugcaguggguuaagaucugagaaguagauaaggucuaauccuuuaauuaugauuagaugccuuauccauuaagauuauguuuccuauuaaaaccuaagaaacacuugaccuuuuaaacuuagugucaagaauaauuauaaaacucugauuuccguggaauaaauguuauucaguaguacuccuuaugcaacaugguggaauuuguaacucucauucaacaaauauuuaugaaacauuuaccugccaauugucaggaguauacaacugcuuuguuacuuuugaacugaauauauuuuaaagcuuaauccuaauaucaaaagugauuuucuucauuaacucugcauauuaauuacauaugaacuaaugaacucuugcauuggguauuucuuaaagaugguauauaaaucauguuuuaaaaauauuacauuuugaguaaaauuggaaguuuaaagauugaguaucuguaguauccugguaucauagguacucauacauauauaugaugguuaaugauuuuuaaguuauuacauucauugucauaguuugaaugaaugggaacugcaggaaaagauacaaacuaacuuucugauaaguuuuucauagcuaaauuugaagacugugagacuuggguauaaugacuaacuuacuuugauugaaucgucccuaagacuaccaauuaggugcauuuaguaguucuucaacccuucuuauguaaauacacugacaaauacauuacaguugaauucucuguauuucaugcaugucugggaaggaguacugugaacaucugcuucaaaguaguaggacuuccuagaccccauaugcuuguuuaucaggucgucaagcacuguggagaaacuaaugcuacucaaguuuacccaauaaaaaauauuggaucagauaagcugcaagccauauguuacugcuccagaaggguugcucagguuggagccaagucagcagcacuuaccuacugugaacuuacagccuuuccagaaagcuuguaucucagucugugcagacagaguuuaugagagugaaccaguaaauugcugucuucaccuugguuuuugaauucuuuuguuaaaguuuaguguaaacauuugagcacaucugugugccaaggauuucuauaggcucuaaauacguaaagauauaauaucaccuaagaaguuuauaccugagaggaugguuuauggaaauggagauuuuccugcccuggugguuuauggguuugggucagaaugcuguguucucgguaaaacucccugccaauuuaagggagaauaaaaaauucuuaaaggagcugauguuuccuuuaccuucacugaucuuaggccauucgguaacugguauuuauaaaggacuagaaguuggauuccucuguuuggcuuggaacugaggcuugcaugccuguuguauaaagaaagaaaaaagcaggauuugcuucacuuacuuuuuccuuauuuuccagaacucugguaaugaacaucauuaagagucaagauaaauaaguaagaacuguugaccuauccugaccaagcuuuugaaggucagacaguucaguuuugcuucugaguugguaacaacugagcaaagacuaagucgccauaguugucuagguagauacaguguaagaagccggcccauuguuuugagaagacuagguuacacuucuuuagaaucaggaaaagugaaaaguagaaaacuccuacagaaucuuuucuccuaccuagcuucuagaacauuuucuuucagaauguagaauguuggcugggcgguggcucacacuuguaaucccagcacuuuuggaggcugaggcggauggaucaccugaggucaggaguuugagaccagccugaccaauauggugaaacccccucucuacuaaaaauacauaaaacagccagguguaguggcacaugucuguagucccagcuacucaggaggcugagacaggagaauugcuugaaccugggagguggagguuucagugagcugagaucgugccacugcacuccagccugggugucagagugagacucagucucaaaauaaaauaaaaauaaauaaauaaauaaauaaaaaagaauguagaauguuuuugcuacaacuugcuauaacauuucauuaaaaaaaguauuaccauuugugaaugcuugcugcaggcuuucauccuguacccaugaaaagccuguuuauuucuuccuacaaacauaacuuuuuuucauaugagaacacugcaacauuuaagauguuaugauuugcuccaaauuucaaagcuaguauguggcaggaugaagacuggaacucgggcaucugaauucuuacugaaguguccuuucagucuuuucuuggucuuuauuacaauauguuauggaaaacuguagugaagaaguauccugucagccaucacugcugugucucaacaccugaugcuaugguuccagcccugcacguuuuucugagugacuauuauaaaacugguaauauauguuagcccgggguugacacacuauggccauaucuguuuuucugccuguucuguauggccuaagagcauuuaaaauguaaaauguuaaaugccuuuuauguuuuuuaaugguugaaaaaaacaagaauauuucauaacccaugaauauuaaauucaauucucaguguauauaaauuaaguguaucuaugcuucuauaaaacauuuucauuucaguuuuuucaauagcugcuuucauaccauaaugucagcauugagcuggugugacagaaacccuauggccagcaaaauaucagcuggcccuuuacagaaaauauuugaccacuguuagucuguggcugugcucucauuuuggacacagccuuccagaccccaucuaacucuucuucucaggaccuucccugugguuucuaaaaucuccaguggaagauuaucuucagucacuggggugguuuuuuuuuuccucuuaauuaugguaaauuccucuuaauuaugguaaauuuuuuauuuugacaacaauaugacucucacacagccacucucaaccugaaccuguaagacauaaauacccuuuacagaaugauaaggcaggcacacgcuaacauuuucaaucucagcucuuguguugagauuagaauuguuccagagauaugcuuuucagacugacccaggcagucacuuucaugguuaaccauuuuccuuguuuccaguaguggccauccuagccuuuuacuacaugagguucuuuauuccagccucuggaauaaauauucucagcauauuuauugccuguaacuuacagauuaaaaagccuuaaacucaccuuccucucccucauucucuguauucugucuuuaccucccuguuucagaggaagugagaacccucccuuuccaaggcuguucccccuagcuaaucucugucccauuccucucaucuccaggaacuuuuuuccaugcuuuucuuuuuccuuagacucuucucuugucuguuauuucuaaucuccaagucuccuugauccuaaaagccauccucccuugagccuuauacuccucaagcuacagccccccucuuuuuuuaaacaacaacaacaacaaaacaacaacaaaaacauuuauagccaaaucucucuucaaagacuuuuuccucaccuuauaucugccugaccugcuaacacugauuuuuccuuaugucuucugcugaaucugcucucaucaguggccugguuguucuagccaguagccucuuuuuaguccuuauccuacaugcccucccugaguaguugccacuauuaacuauuagcucccauguugaaacucuucugcauuagucuuuuuuuuuuuuugguugggacuggaugcaucuuugagccucuggaauucuccuccccaaauuaucuuucucaguuuccuuuacucauucuccaucugucuacucuaaauuguuccuuccagucccuucucuuuuccuuguguauuuucuccuugggugauuucaaucaugcuucaucuaacaccuauuuguugauguacccugaaucuguuugucucucuagcccucuucccugaacuccaacuccauacuggacacaagcauguaggcauuuccaguaaccaucuugaguucaacuaauuuuuuuuuuaaucuaaacaugaguaucucaugcucuccaugugcgauggcaucagugucuuaagaacuaaagcauuagcuucggucucuuuuuuucccacucccuauauucauuggguugccagauagcugcacuucagcucaaauguggcucauugaaccuauucucaccaaauuuucugcuugugcuuuuguucaggaccucaugaugucucaccaggucuauuuacaagccucuuaacuggucucccagacaucagucuccaugcccauuuaguucaucauuucuauggcuacuuaugucaucuucauaaaauguaaucugauuaugucuuucaccuucucacagucaaaacacuaacuguucauuaaaguauaaacuguucauuaauguguauagauaugagacagugcaaaacccaaaccuaccaaccucuccagcccuaacucuucucuuauacccuaugcuuuaguccaaacguuugccauucccugauuguacacugcucuuucauguguucuugguuucauaugcauuacuucuauuuagaaugguaucauauccugugagauaagcuccucaaccuucaagggccacauuaaacuuaaugucuccugaaguguuuagauucccccagaaaguuaaucauugcuuuuacuuugcucugaguguacuccuuauggugcuuuuacugcacuuacaauaugacaucauauuccaccuuacuugccugucuucuguaguagcuggucuuuagaaacuggagugggaaggagaggagaacagucaccauaucuuauucaugucagcaccuggggcaucugauaugcuauagccacaauaguuagugccuauucaaaugaauagagaaaugaauuuuuaaaagugggugggaguauaggggccaggcagacuucucggaaugacuguggagcagggaaaugccacaugcuguguguaucuguggaagauauuuagguaacugcuuggagacugaccuuugaaguuuuuuaguaucuguugccaaauguugauuaaaggaaugacucuagauguuguaaacguugggcaucugaaucauucuggagcacuacacacacacccacacacacacacacauauacacauacauauauacauauacauauauauacacauauauacauauacauauauauauauuuuuuucucagguacacggcauuacuuaugaagauuuaaauaaaaaguuggccaguuccacaaggcagaaccuggguuagggaaugagggagaauauaaauuuggcuagcugggaagacagccaugagcauggauacaaaaccaugacuuauuuagaaaauaggcugugaauuuuagugaaacagaccuaaaguuugcugcuaaugaguuuuuauuggguuugcuagguauuaagccuagcuauuaagcccagcaugcauuaaguauuuuuccuaaugcugucccuccuccuaccauggauggagcuagaagccauuauccucagcaaacuaacgcagaacagaaaaccaaacacugcauguucucacuuauaagugggagcugaacagugagaagauauggacacagggagggcuuguuuucuagaauaacuucugccugaugagaaauguggcucuccuguuagaacucacuagaaagagugaggguccugaccuccagggcuuccucaccuaacugaaaccaagccagaugccguguacaguagaauguaucgaaaugcuaccaaacggcccaaacagaauugcagccguuuuguaacucuuucuuggauugcaggaaauggcagcauuuccagaauucgguggcagcuuuguugccuucuugcaugguuuuccaccgguuagugugcuuggcauaauccuuccuuuuaacugugcgaugcagugcuguaggaacuaacucaucuuagugucaccuguuuaaccacuuuuccauguuuguuaccccagucacacagauccuaggccuuaguaauauaacaucauuuaguuggaaaccggaagauugauauaaaauucagcaacuuaguaguuacuagaaaguauuaaugaagugcuucuccagguauauuuuucaccgagauuuuagcugguuugaaacaucuaauuagacuauuaugugucuucagaguuaacagaauuauacuuaaguuuaaaaaauugggcaaaguaauuuauaugucaggauaggagugguagaaugguuugagauaaggaaauauuagucaacuugccaaaauuuugaccacauuuagcauuuauugagugcauacuguguuccaagucuuauauuagguacugaaaugacuguagugagaagaaugaaaaggauuguugccagaauauguuauaguguugcuuuauuuuugaacucuuuaguuuaaugcacuaccgaccuuuugagucuucuaagauauuaaaucaguuuuuucuuuuaugugaauuaaguaauugcuuucuuaaauuugauuuugauuauguguagagacaugucuauuuaacaacaauuugaauacuuugagucuaagcaaagaugaucaagcaaugguaggaaugucauuguuucugggaacuuuuuguuggucacagaauaauuuucagugugacaaauuaaagaaacuuagguuguuccuuaaacccauucugucgucugccuuuuuaugauuuucuugauuuuaucacgggagcauuuaucgaaucuaguuuuuuuggucauacuuugcuuaaugguauacaaaaauaacuacacagauguguuauaacuuaucuuuucagucaagcaacuuugaaaauguacaaaaaauaagagaccguuagucacccucaacuuauauuuuugaaaaaaaaugagguaucagucuacaauuuaguacuuuaucacauucauucaguagaagaugauugucagacaagggaggugaaguauaaaguuuaaccaauaagggugcauccuuaggguagcuucagagacacuguagaggugggcaugagauaaaugacagucuguaagggugguagugaaaugagcugaaguaccuuuaaggucuugcauuugaugaaaagccccugcgguacuuuaauugaugagaguaacacaguuaaaauacaugacauucagaacagguuugcucagggcaguguugguggcuggaaguuuguugaagagcagguugcaguaaucuggugagagguggugagugguuaaggaaguugcgguagaacuacagagauuaugcagaaagaaguguccugggaggcaguuuagcuuaaggcauuugggaaagaaaacugugccaaguaucguacauugauucaguguguaguccuguuuggggccaguucgaugcuauucuagggauuggaauaaaaugaaaaaaugcauagucuaugccacuuccaaguuugcgaaccgcccccccccccuuuuuuuauaaauagaacucuggaguaggaguauagggaaauuuaacuguuguucaaaaauggaucacccauuuuuucucuuuuggcaaaauugccucacuccuuucuuuagagcuauuucggucaucacugagccucuugaaucauuucacaucauuuuauauaccaaaaauccacugagauaauugguugaaaaagauaaaauugcucuuuuuuacaaguucuuuuuguuuguuuuauucuuuauaaaagugcuuccuguuacaauucuuuagcuauguacugaagaacaacuaggaugugauagcuuccacuccuguccuccuccuccuccacuguaaccuugggcacuaguggagcauuauuguuuuguuagccugccuuuacaauaauuuuccuccccuuucugaaaagcuucaaugcuaaacaacaauguagagcauucuuucuugcaauagacgcuaauuguguuccuaguugggaucuugcugucauagccacaauaacugugucaauugugcagggaggcugggucacagugguuauugugcagagugaugaaugcugcuuacuugugaugugcugccgcccgcaucugugggugagaacacgcaguuacuguaauuugccuggcaagugaucagacugguauaaaauaacaucaucuguuaggcaagauagcagucacaaagaacuauuggucuuuuaaaauauagaauuuuuaaugagaaacuuugaauaauagagauugaacaugugagaacagcuaccuaguguguguugcauuauuaaccccuaguuuguaguguauucuggagucaaguugaccuacauagaagagaaggaacuggaagugcaugucuguguucuggcuccgauugggaaaagcugcuuaaccacuguaaguuacggguuggauaagugacauauacgacuggugucaauuggcaaccaggcuucacaguuucaugaaauguguggauucugaaaguguugucauugcgaaugugguuuccuugccuaguucuuccacauacuuaaggaaaagauauuuuuaauguaauuguuagaauguguugguacguaaugauucugaaguaaaaggaauuuuuuuuuuuuuuuuuuuaaguaaacuugguguuuugcaaggaucugaagaaucccaguuuggagcugauuauuuucuugacuguccacaucccacaguuuuuuuuuuuucucuccaucccacugcccauuuuaaagcacuuuucagcugucugauugcucauuagcauugcucauuaaaaguggucugggggcaugcauuucaaagcaguccuuuuaauacuugguuuuucaaguuuugucaaauucccagugaauacaaaccaaguuauuucuugaaguuuagccuuguuuauauuuuuuauauuauuccuucugcuuaguacaugucuaaaugauuacuuuucagaaaagugaauuuugcuuagcgcauugauuuguaucucaugagaggagaguaaaucauguuuggugugacuuaagcuuuuaugauuugggauuugugugugugugugugugugaccccaagaacauggagauacaaggggugguaauuuuggaggggagaaguacauuaauuagacaagugagguaauguaagaaugagaucaucugcccauggcugguguaauuccuuuuuguucauuauauuaauuuaaaaaauaauauuaaaguaauaacauguauauuccuaccuugaaaagcuaguuauauaaauaauauguauguuuaaugcagauaauuuggaaguuuuuuuuaaagaaaaaauccgagugaucaccaauagucucuguaccggauagucauuguuaagcucugguauagacaccccucuguuacucuguacacuguuuuuccuuuaaaccuuguuuuggucucaaggccauuuggaaacacaauagucauucuaaguccucccauaauccaauacugaauuuacauaaaauguuuuuuaucaacauuuucugauauuaacugaguagaaaaaauauagaauuacauauaguuaauauuaagaacauuucccuuaauuccuaaagauuaggaagauuauaaacuugaguuuuucuuuugacacuaauccuuuuuuauauugcaaaacacuaaauccuuauguggaaauagaaaauugaaaacauuucuaacguagaaacucaaaauaaauuuucauuauuauacaggcauguuggcuuuaaucaaaguaagauugauuuacuuuuuaaaaauggauguauaaauaggacccuaauucacaaauuguuuauuuuguauauauuuuuuauuuagauaaguggaagucaguuaagauaguccuaugaaaaguugcuuugucuuuuuuuuuuuuuuuauucucuucccuuucuccuucugacaagucaacauaugcuuccauauagcuaacugcugcuauuuucugcuucugugacagcuagccgauggcggagucucuucucuucaacugccucacuggcuuuuccuuauaguccuguugcaagacucagcccuuauagcaauggcauuaauacucccagcuucucuaaaaccucaaauaaagcaauacuaacaccugaaaaaacagguaauauuuuaacuucuugacuagcugcuugcuuuguaauucaguuacuaaacacggcuuaaauauucaucuuucauuugaaaagcuugagaauaaucuuaagaguggagaguuugugcugcacacuuacuuuggguacaaaaggccuagcacuaauuuguacucuaacaccauugaucuacugcucucaauuuuauguagcagacagucuucccucuuuagcaaaaguauaugcaugcaguucuguauuuccaaaugcuuaugugcuuuuaaaauuaaaugucaaacacaauuaagguaguuuuuauuauucaagauuguaagucuguauuuuuuuuaauuuuuuucugguagcuuuuaaauuuagcuaaggcuguguagaagaaaauagucauaguggcuuuuuaugagaugaggaucucaccauuuucuuauuuuucucagcauugguaugauuccauuccuauagccuucuucuauuuguucuuugguucuuuuaucugaagccauugauuuuuuuauccucauggguggcuauaagucucccgugacuacucucuggucuauauuauguggguguuguauauauuucugcauauguaugugugccuuuuagaugugauauucuuacccauuuguagcacugcuguuuguacucauuaagaaauggaccagauuaaaauuuaauuuaaaaauauauuaucaguuacugucagacaagugugucuuauuauuaaaguauacaugaauauauauucuuauaauaucaugccuuuagauauauacauaucuaauaggauguagauuuuagcaguagugaauuuuuuauugugauaaaaaauauaaugugaaaucuacccucuuaacaauuuaaguauauaguacauggugacuuuuuaaauugugaaaauucaauuugaaaacaaugaacaagugguuuuguauauaugaauuguguacacaugaugugcacguugaccauuaaauggugacauguuggugauuuuuguaacaugaaaacaugagacaaauugcugacuguuuauauaugaauugugaagcauguauagauaucaguccugcagauggaagaacacacuuuuccuuuguguuucagguuacacuuccaggggcuccccacucaguccccagucaucuaucgacagugagcugaguacuucagaauuggaggaugauucuaucuccaugggauauaaauuacaggaccucacugauguucagaucauggcucgucugcaagaagaaaguauguguucuuucuaaacuagcaaaaugaggcuuccacuuggaauauacaggcagagggggagguucaggcauuucucuccagguaaugggcaaauaauuagauucuuucucucauacuguccuacuuuuuagguggagccaguuauaugcuucucacacuaucaugaggugguaggacuuagucugaugaaaacacauugauacauggacauugcugguauugucacuguggaaacagauggacaguuuccuaaaaaacuaaaggugcaacuuccauguggcccagcaaacugcacucuuggauauuuaucccagaauaguggaaauucguguuuacacaaaaacuugcacgugaauguucugagcaccuuuauagcccaaaacuggaauuagcuuagaaggccuucaguggguaaaugauuaaaccaaucauguuacaucuauaccauggaguauaacucaucaauaaagaggaacaaacuacugauauacacaacaucuugcuugaagcuccagggaaucauggugaauaaaaaauuugaucauaagagagugcauacuguauaauuccacacauauaacauuuugagaugacaaaauguuaggaacagaggacagacuagugguugguggaguuagguauagggcuuagggucucaagagggucucgaagcuggauguaguuauaaaagggcaacacaggauuuuugcaguguugguacuauucauugguggaucuuugaaccuguagguaaugaaauugcauacagcuuaauacucucucuaucucuuucugacacagacacacacacacccccacacaccugcgauaaucugaauaaaaugaguggauuauaucacugccaauacccuggcugucauauuauuauaauuuugcacaauguuaccacugggggaaacugggcaaaguguacaguuuuguuuuuuuuuaagcacugcaugugagucuacaguuaucuuaaaauuucaguuaaaaugcauugacauacuucuccagguaaauaauugugaaagaguagauaaguagaaauaggauaguuuuucacugguucugcgauaaaguuacaaaaaauuaucugggagugaacuaguugaagggcauuaaugguaucaaaaggcacagaacuggaguguuuguuuuggaguuaucuuuuccaccaacauaaguagaaauaaucaaguaucauuuaagcauaauaauuuccuguuuucagaauuagucaaggcuucuaugagaaacaugguaaugcuuaugcaggauuuaauagauacauuuuuaaggggaaaagugguuauuuuauauaauuauuuaguaaaagcaaauuuaaauacucuuucuaaaaauauauauggcuaaaagauuguaugucaguuucagaaguuaaguagucagggauagaccacuuuuuuuaaaaauuguaguacuggcaauggguuaaauaaugagaacuuuguaguuugacuauuuuuagaugauuaccuuauaggaugaccuaaaacuauuagaaguauugaggugucagugugcuuugaaagagauaauauuaguaacauaaaagaacaauagagagaugaccuugugggaaaauauuuguaccucggcuuuuaaacuuucccuuugacuuuaaaaguuggggguggggagcagaaugacuuccuacuugggcagagauuugaagauuuuaguuguuuuaacucauagcaaacuauucauaaugagaugaauauuucuuccuaaguuccccuucuaaaauaucucuugauuugaaaaggggaaauugauagauauuaacgaaugagcuguggcagguauauauaauccucacuggaauuggggcaaucuuuuugcaaaacagaauuguccaauauuagauaucuguuucauagguaaaugugauuauugucuugguaaacuugucaauuuaguaaacuugagaacaagauaauaagucucugugaguaauuuauuuggcacaauuuuucaucuaauacuugguuaauuauaacuaaauguuagcuagaucaaaauacauuagaguacuauuuguuauuuuauaggucucaggcaagauuaugcuucuacuucagcaucuguaucaagacauaguuccagugugucauugaguucaggaaaaaaagggacauguagugaucaagaauaugaccaauacagucuggaggaugaagaggaauuugaucauuugccaccaccucagccucgucuuccaagauguuccccuuuccaaagaggaauuccccauucacagacuuucuccagcauucgggaguguaggaggagccccaguucccaguauuuuccuucaaauaauuaccagcagcaacaguauuauucaccucaagcccaaacuccagaucagcaaccaaauaggaccaauggagguagguuguaugcuuuuuugguauuugauaugcuuuaauuuuuuuauauguggucaagaaaugguuuuuguguuuuuguuuuuguuuuugagacagaaucugucucugucuccuagguuggagugcaguggcacgaucucagcucacugcaaccuccaccuccuagguucaaacgauucuccugccucagccuuccaaguagccgggguacaggcaugugucauuaugccuggcuaauuuauuuuuuauuuuuuauuuuuuauuuuuaguagagaugggguuucacccuguugaccaggcuggucuugaaccacuaaccucagguaaucugcccgccuuagccucccaaagugcugggaugacagccaccauacccggccaagaaaugguuuuaagagaaauauagauaauuggucaauguuucucagauuaaaaaucauccuccagaccuucucaguuuggucuaaauuugcgucucuaauugacuggcuucugauuacgugucccagauuuauaaacgcacagccucaagaaaaccuucaugacauagcuggcucggaaugaguuauaaaugugcggcaucucugcauuguugcuggugccuguggcagaggcaggguuguacaagcugagaaguuuguggucaagcccauggaggcaaagucugugaguugucauuccuuaccuuguccacagccuucagucucuuacugucuguuccuagcacagagugagguuguaagcaugaaugaugaugcuugcagaggaugcugcucuuacacagccagaucuaggcaaguuugggaugugucuuucccucugaucuccugacaucuagaauuaagaucuguguagcagcaggaacauggagguugcuuuccauuagcauuugacaggguaaugggaaauugaucugucuugucaacaugguggguugcugucugugucauucguuuauucuaucucuucaucauuuaucuuucuuccacacuugcagaaguuggacucugacuucuaagaacuaugggagaagcaaucauguaauauucuaagccuguuguguuuuuguacuaaugaucaccugaacccucacacauaaauucuauauauuauggagaaacaaaccaauaaaaaaauuuauaauuauacaauuacaguucuuaauuauuauauagcacuauuucucaaagcuggguccagaugugaucaaauggucuuuaaaaauauuuauaggccaaauauaaauuuuguauuagugaucagccauaacccuguauuuaguuuuuacccuuucuuccuuuauacugguaucauucaugcugaugcuaauuaagagaucauuuggaaauauuuaaaauuuuguauuuguaauuucucuuacuaccuugagauuucaaguuuaaaggagugguggcuaaaaaaugucaucaugacuaacauauuaaagcucauagaucagaaagacaauguauuccaugugcuuaguggaagucauaacaucuuauuaaaauugagagggcaccuagaguuauuucucuaaagcuuuuuuuuuuuuuuuuuuuuuuuuuuacuuaaaguguuuuagaacaucguagucaaguugccaagcagaugcuagcucugcaucuugauugauauugucaaugggaucauuuuucuccgcuuagcuguuuguugcaccucagaaaagugguauucacuuccaucaaacaccguuugaaaaggauuagguuucugugaauccugugcugggauacucuucacaggaaaguggagacauaucacaguuuaggucccuuuaugguaguuuuauuuugccuaaaaugucuaguuuucacaauacaagaaaaauggaauacaaaggcaaucuucuggauaugacuucugacuaauuagcuuaaugguugagagcagaggcucugaaguccaguagauccuguguuucucaacugucuaagguucgguuucccuaacuaaaauguggacaagaugauaucugucucuuaggaaacuuagguauaauuucacaccaaaccaucugguacacauuuucuccaccuaaauauauuauaaggaauaaaugaaauaaugaauguuacauugcauguagccuggaguggaugugcuaaauaaagguugucuucuccccuuuuguuuuuaaacuuuuauuaacauaugauucagauguccuagccugcauuuguuacuauagaauauugagcaaaaaacugaaauaagaaugguaacuuugaagcuaaucuauuaaauauuuuucuaaauuaucaaaauaauauagauagaaaauaauuguaaacuguugauucauuuuaaaauaauugagaauaaacuagaaauguauauuaauauuuacugcuuuuguaguuccuacacugccuagauuuaaagagaugguucauaaaacuuucugggauauuucugagauucauagaauuaaaagaagcauaacuggaauaacuugcuaaauaucaaaaugacucaacuuguagaaucuuuaccaacuuuuuuauaauucuacgguauggcagggguuacuggaggcaugauguaguccuuauuaucaugaggaccuccccuggagccuguguugccuggaugccuagaucuagcuguuugguggacaaugagugucuccuuuaguccuaaagauuccugagucuuuguucauagagugaugagucuugcugccucuuuaaugugagcaagcucauuugaauucuuuacuuggucuauucuuccaguuuccugcugcaucucagcccuugaagauuaaacugcugauuucuugugaagauagaacuagaacauuacuuuugguucccugaacuuuaaagaauaugugguuauuaaaacguuccacauuguuugacaggaaauguaccucauuuccagauggucugacacaaguuggagaucacagcuuuguuccaaggggaauaguguccuaaauauuuacacuuggaagaccuuauuuuuaagagcauauuucaggauuaaagcuuugugaaacugacuuguugcuuaaauaugaguaaagauugguuuuaaagacuaacacagauuagaggcauagccaaauguaacguauggaccuugauuggaucgugguuuagaggaaaaagcuugugaaagauauucuugggaugucugaaaaauuuuguaugcagauuaucauaugauauuguuaauuuguuuacaugugauuacaauauugugauuccauagaauuuucucaggagaucaauaugcauuuaaagugucaagaugucugaaguuuuaucuuguuuagcaaagcaaacaaaaguacauguggagaugaauuaaauauggcaaaauggaaacaaccaguauagccagguggaaaaacagguguuuaugauacuauuuuuuaacauuucuauauguaugaaaacuauuauaguaaauaguuggagagagauuuuaaaaagaaauauagaagcucaauuaauuuucucaauagcauauaauuauguuccugugccucccugcugcuuaaaaauauauguauuggaaauauguauagugaaaauagucuaguacugauagaggcugucuuuuuuacaccaguuuuuguaauagucaaaagaucuagauauggccacuaagauuauguagagaugaauccuucuaauuccucccuucuuacuacacacugucugccaaaucauacacauaauauuugcugauauauaaaguaccugcucugugaggcugggaacuuuaauaggaauuugggaauacgagacguaugauuguuaaaaauaggcaucaagaagauaaugaggaaaauugccaaggaaucuaacagucaguggcaauauuugagcauccuuacucuagaacuacacacagaaaguaaugugugagagguagauacuuccagcugggaaguccauagaaaagcuucucuaugguggggauaauugugccaauucuuaaaguauuaguaagacccacaugaguaaaauauucuuuugugcuuucuaccauagcacucucuacaauuuuuuaugcucucuuauuauacauauuaucuaaguauacuuauugugcuuguuuaaucuucugccuuuuccaccccaagggagcaaaaauugcuggacauggcaacauuuaauagguguuaguaaugucaaaggaguaguguaugaaaggggaauaagaagagcugaguuugauuuugacuugaaugccuuuuggauuagcauucaaguauaucauuauuuucugguuuugcuugaaagaaaaugaccacaagauugaaugcucugauaugugcacuuuaguguuuugcgguauauaucaauaaagauaaaaauaucuuguaaguuggaggggugaaaaaaauuuuagauauuacaaugauuuaugaucuuccaugguuuaccccuaucaaaauguuaaucuuuaauauuuauuuuauuugggaaaaaauuuaauuuuaaguuuaauuaaauuuauuuuagauuuucucuuuaggaucaacaauggguggggaaggauugagaagcacuggucuagacuauaaaccuagaccauaaaucuugacuauaaacucaaugagacucuggacuguaucugccuaauacacugugguauccccaacagcucacagagugucugguauuuaguguaaacacaauagauguuuguucccuuguucauuuguuccuucuccaaagugagguuggguguccacauggagggaccagccugcucacagguaugagagaguucaccccuguggucggggagcaggcugagaggccaggcuggagaaguauaaagagccugggccuugaagcccucaucugggcugugcucaggagcuuggccuuucagaagagggagcaggggaggaauugaggaguuggagggauuucagcaagugggugacgcaugcugugcucuaggaagaguggaaucgaguacuugaauuaguuuuguccuugaauuaguuauggcuuaguacucguauauaugcuuuuuuuuucaguuuaaaugaccugacauagguacuuuaguuuuugggggauguguauugaucaaggaaaaagugucucauagaguuguggucuuguggcuggcuuauuucacauguguuauuucacacaucucaacauugagaucuguaugugacucucugcugccucuugguggcagaagaugaacuuagcaaggcaaaaaaauugaagcauucucuuggucuuuuuuaucugcaaacauuugguggcguacucaugaaaguuaaaacuuuccagagauuaauguggucauguuaaugugaugaguggauauuucaagacaucugaaguuugaauuuuauuaauuuguuccauuuugauaugguagcaaaagauucaguaaauguugguuuugauucuucuaggguucuuuuuuuuuuuuuuuuuuaagaagcauguaacuuaauuucuaggguuguuuugguaaauuuaauggcuauaagauuauuuucuaacuuuuuaaauauaguuuuagccacuuauugaauaggaacagauagcuaacugcuuagcuagucccuaagucuuuuuauagaaguuucguucuccuuuaacacauuguauuaguuaggguucucuagagggacagaacuaacaggauaaauguauauaugaaggggcauugauuaaggaguauugacucacacgaucacaaggugaggucccaugauaggcugucugcaagcugaggagcaaggaagacagucggagucccaaauccucaaaaguagggaagccgccagugcagccuucagucuguggccaaaggccugagagauccuggcaaaccacugauguaaguccaagaguccacaagcugaagaacuuggagucugaugcucgaggguaggaagcauccagcacaggagaaaggugaagucugcuccuucugcauucuucugcgcuuuuauccuagccaugcuggcagcugauuagauggugccuauccagauggagggugggucuaccccucccaguccacugacucaaauguuaaucuccuuuggcaacacccucacagacacacccaggagcaaugcuuuacauccuucaauccaaucaaguuggcacucaauauuaaccaucacacaugcuuauuuggugggaacccuucugguugggaaggguguuuuccuguacaauagguuagaaagcuugaucaucaacauguaauaauuuguauuuauuauugagcacaauaugacuuuuguuauuugcuuuugaaagcuaguacuuugguugcauaacaucugucauuuuuaacuuaguaaaauucuuuuccagauaagcuccgaagaaguaugccuaaccuagcccggaugccaaguacaacugccauuaguagcaacauuaguucuccggucaccgugcgaaauagucagaguuuugacucaagcuugcauggagcuggaaauggaauuucaagaauacaaucuuguagugaguauaauuauuugauauaauuauauauuguauaauuguauaauuuuuuauaauuuuuaauuguaaggaaaaugucuguuuuauuucuuuguauuuacuugaaagaacacuaaacuuuuuuccuugccguguaacuuauuuuuuuauuucaccauuagaguugaauaguauuuuuacuauucaaauaguauauuuacuauucaacuuaccagugccugugguauaaauuacuuaccagugccugugguaucaauuaauaauaguaaauuguuauuuguauaauaauaguaaauuauuuguaguccuuuauauccuaggauaguagaaguacuacauggugauugauuuauccacucaucauacaaaaauuguuuuccuugcagauccuccuccuucuagcugucuaccugaauaagcacacuuaauucuguuuagccguuccuuuugucuuguuuuucaccuaugcauacuuuugucuuuuucccccuaaaugaaguuauauuuuagagugucuaaaguaguuuuuguccacucuauuuagcuuaccccacauucuguuacuuacuuucuauguuuuacccagcagugagugacacaguuagcauuaggccuagugcuguguaucuucacuuuauguggggaugugcugcuucggcaucccccuauuccuacucaugcugucuauauggguuguugcaguuaagucuuacacugacuuccaggaggaaggcacaagguuauauuaccaguauucauaaaaaugcccaaacuugggaggcugagcauguucugaguguacuggccaagagucgucaaccggauguuuuaagucugcauccaaaaugguuuguagcuuuucucccucaaacuuaguuuuaggugucagguuguaucucccuaacaugcagcgaucuuucauuucuuuauguuuuaguuccuaacaaccaagugacaucauuuacucuguacaaggaacugugcuaacuaguuuauauucauuaucuuauuuaguucuaccaacaacucuaugaauuaguuucuacugccauucuuauuuuguggaagaggcaacaguucugauagguuaaggaacaguuugucuaaggccauacaguuggaagagcagagaggcagaccuaggucugguuacucccagagcuuuuaacugcuaucauauucuagcuccacgugcuguucuucucugccuagcauucuuccuuuuccuucuucguucaguuuacuccuauuuacuuuuauaacacaguccaaauaccaugccuuuggaagucuucauugcuuacuuaaucacccuaacacacuuucucaaauaccccccaaacaauacuagaguggauuagauuuucggugcuuaccucuguuauucaauguaccauguuuuacuauuaauauguuugucuuccuuacuagauuguaagcucccucugggcuugggccaucauuuauuugauuuucuguucccagugccugacguauugccagaacauaaggaacucucagugaaugcuugaaugaaugccacaggauucuauguuaaggcuugaccuauuaaauauuuagaaccaaugacuuguauaaggacacauaaacaaccuaugaaauuugccaauaguagaaaccgagaggacuaacaacucauuuuaugucaggagguuaggagaaugggccaaauguaucaugaagaaauuuagcugauagaaauauacaauucuaugucugaauuacaaaaaucaguaacauaccagccuaggcaauaugaugaaaccccgucucuacaaaaaauacaaaaauuagccaggcauaguggcacaugucaguaguccuagcuacuuggaaggccaagguaggaggaucacuugagccugggagguugagucugcagugagccaagauugcaccacugcacuccagccugggcaauagauagaaugagacccugucuugaaaaaagaaaaaaaaaaaucaauaguguaagugugggaggggagaaauacaguuuggagaauagcaaauauaguaacaauuaggaauuuuuguugacuccaacucaauguguauuaguagcagauuugagugccagaaaaauguauguagcccaaaauagaauguacacugcaaagaauguucagccuugauugaagugcccccaaaaugacgggaaaaugucaaaaggauacaggaaccaaguugaaggaaccuccuaauggccaaauuuggggcaguuugagccacagaguaaauaauuauaguaauggauuauaacugauggaauaaaauaaauaugcauggguucauacuuaauuggauaaauagaggggaacauccucuuuguaguagauuccaauucaugcguguaaaagcaaugaggaaaauauaaaaaucaucauuucuaagucaagcauaauacugagagaaagcccccaagaagaauauuaaaguguaggagaaggaggacucucauaacuuuuguuucaaaucuuaagauuauguucucauuuacuuucauuucugagcauucuaagccacuguucuuuaugcauucuaaguuccuaucaugacaauuucugguucugggccauuuugcuuucuggaaagaacagagguaggauagagaguuggaaaggcugcaaguauagaaggaggaacacaguuguagucaaagaccugguuuugggucuuuucuuaaucauaaauucuuuggaaaguuaaguauucuuucucagucuuguuuucucaguuguaaaauuaggauuaugccuauuaauucuaacuaguuucucuuauguguuuuuuuuuaaaucaagggugguuauauauguuacauguaggagagauaguaggacucuauuccugaauaaacuguucuguaauuucauuucaaaugaaauugguuggcauuucauugacucugcagaucaauuuuuggaagaucuuaacaauauuaagucuuugcauccauuaauauguaauaguccuccauugacucaggucuuuaauaucagugaaguuuuguagcuuucuauauagagguuuuauguuucuauaguuaaauuaauuucuagguauugugauuuuuaauaaguaguauuuuuauaaauaguauuuccucagguuucuuucaguuucuacuaguuugcugguauuuugaauauaauugauuuuuguguuuugauauugaauccagcaacuuugcuaaauuaauaucuccuaauaguuacccaacauaaugagugcauaugaucaccaaaacauguucaaggagguucauaaaaccccaaauuagaaauaaccuagcuuucugucaucaggggaauaaucacauuuauacaauggaauacugcuuaguaauacagcaacacaggugaaucucacagacaaagugucgagugaaagaagccagauuaaaagguuaacauacuaauaagucuauuccuaggaagcucaaaauagggaaaaacagucuguugugauaaaagugggaauaacacuuaccuuugggggaguuuugacuaggaagaggcaugagagagcauuguaaggugcuggugaugcuuuuuaucuugauaugauuagugguuacaugaacauaugcacuuugaaaauucacugagcuguagacuuaagauguauguauuuuauguauauuaugcuucagaagaaauugagccaaauucauguguugaagguuuuuaaaaaauuaacacuuuuuuggagcaguuuucaguuuauagaaaaauugaacaggaaguacaaagaauucccauguaaucccucacccucuguaucuuccuaguuuccccuauuauuaacaucuuguguuagugcaguagacuuguuacaguugcugaacuaguauauuaaauauuugcaugguuaaaaacuagcaaauuaaggcauuacagaauugauuagaaagaaucuuagagaugauucgucaaccaagaggacuuugcugugucacaaagcuaaaugggaacacaccuaagggaggaucuuacauagacuuuauuuuuauaaagcuuuuugacuacuauacacauguaucaacauuucuuuuuuuuuuucuuauuucaauaguuuuugggguauagcugguuuuugguuacauggauaaguuauuuaguggugauuucugagauuuuggugcaccuguuaccgaagcaguguacacuguacccaauauguaguuuuuaucccucaccacccucccagacuuccccacaaguccccagaguccauuaucucauucuuaugccuuuacauccucauagcuaagcucccacuuacaugagagaacauacgauauuuacuuuuccacuccugaguuauuucacuuagaauaauggccucugguuccaucaaaguugcugcaaaauauuaauuuguuucuuuuuaugggugaguaguauuccuugguguauauauaccacaguucuuuauccacccguugguugaugggcacuuagguugguucuauaucuaagccauugcaaaugcuguugcuauaaacaugcguaugaaugugucuuuuuuucaaauaaugacaucuuuuccuuuggguagauacccaguagugggauugcuggaucaaaugguaauucuacuuuuaguucuuuaaggaaucuucauacuguuuuccauagugggucuacuaauuuacacucccaccagcaguguaaaaguguucccuuuuugccacauccacaccgaaucuauuguuuuugacuuuuuaauuauggccauucuugcaggguaaggugguaucucauugugguuuuaauuugcauuucccuaaugauuagugauguugaacauuuuuucauuugucuguuggcuguguaucuuuuuuugagaaaugucaauucaugcucuuugcccacuuuuugaugggauuaguuguuuuuuuucuuguugauuuauuugaguuccuuguagauucuagcuauuaguccuuuaucagaugcauaguuugcagauauuuuuuucuacucugaguuaucuguuuacucacugauuauuuauuuuggugugcagaagcuuuguaguuuaauuaggucccauuuauuuauuuuuguuugaguugccuuugcuuuugggauuuuagucaugauuucuuugucuaagccaauguccagaauaauuuuuccaauauuaucuucuagaauuuuuauggcuucaggucuuauauuuaagucuuugauccauuuugaguugauuuuuguauaaggugagagguagguauucaguuucauucuucuacauguggcuugccaguuuucccagcaccauuuacugaauaggguguccuuuccccaauuuauguuuuuguaugcuuuauugaagaucaguuggcuguaaguauuaggguuuauuucuggguucucuauucuguucaauuggucgauaugccuauuuuuauagcaguaccaugcuguuuugguaacuauagccuuguaguauaauuugaagucaguuaaugugguaccucuagacuuguucuuuuugcuuagucuugcuuuggcuaugugggccguuuuuugguuccauaugaauuuuaggauuguuuggauuguuuuuucuaguucugugaagaaugaugaugguauuuugauagaauugcauugaaucuguagauugcuuugggcaguauggucauuuucacaguauugauucuuccauuucaugagcaugggauguguuuuguuugugucauuugugauuucuuucaacaguguuuuguaguuuuccuuguaagauuuuucaccuccuugguuaaguauauuucuaaguauuuuauuuuauuuuuuauagauguuguaaaagggauugaguuccugauuuaauuuucagcuugguuguuguugguauacagcagugcuacugauuuguguacauugauuuuguauccugagacuuuacugaauccauuuaucagaucuaggagcuuuuuggaugaaucuucaggguuuucuagguaucuaaucauauuauugguaaacagugacaguuugacauccucuuuuccaauuuggaugcccuuuauuucuuucucuucuauaaguacucuggcuaggacuuccuguguuauguugacuagaaauggugaaaguggacauuguugugaaggacguuuuguuccauuucucagggggaaugcuuucaacuuuuccucguucaauaugauguugacuauggguuugucauauaucgcuuuuauuacuuugaaguaagucccuuguaugccuguuuuguugaggguuuuuaucauaaagggaugcuggauuuuaucaaaugcuuuuuuguaucuguugagaugaucauauaguuuugguuuuuaauucuguuuaugugauguaccacauuuacugauuggccuauguuaaaccauuucuauaucccugggaugaaaccugcuugaucaugauguguuaucuuuuugauagcacauguaucaguauuucuguguauagauuuugccuuguauaauuaaacacauuuuuuaaggaaaaaaaauuuaaggaaaaacuauuuuuaaggaaauauuuucaagagaugauaaauaaaaccauagauacuuuuuugggucuuuuucccccuuauauuuauuucaaaaaaguauuuauauauuucaugauuaaguaaauucaacuguuuuagaaaacaggguauguccauguuuaaccauguugccaguacuaggcaucaaaggcuuggguaguuaguauguaagcagaauucugugcauaaguuucuauuaaauuugauuguuuuccuuggagaaagggauuaaaaaauuuaaaaacuucugccuaccaguuuguuacuuuuaaugugaaaugauacacaaaguuggaucaguauauugaugaaauuuuuaaggguucuuauccagagaguucccagugcccuucauuuuauagguuuugcuacuauuauaaauguaauaaugcccagcaacucagauagauaaaugacauaaugaauauuauuuaaggaauauaucuguaauaaacuguuuguaccuacagauaccaccuugucuucuuuucuguaauuacaacuauuaaaguaucuccucauuuuauuuucuuggaaccaccaccaaagcaagcaucaagaaauccuaaugucuagcaagcaaacggggaagacuuucucuugugagaacucagacaucaucacauuuguaaaggaaaggaggcugugcuuagaacuggcuucugcauauagccaggcacuccaaaauguggcugauggacagaccaggagaucuuugucaaggauuagaauuuuccauuucucagugcugucuggaaccuauauucuguuuuucuccuccuguguauauuguacucucaggcauaauggacucuucugaaaauaacacacauuuccuaagucggauagugguagaagguugcucacaugaauaucauuuucucuucuaguuccaucaccgggacagcuucaacacaggguccacagcguggggcauuucccagugucuauccgacagccucuuaaagccacagccuaugugaguccaaccguucaaggcagcaguaacaugccuuuaucaaacggcuuacagcuguauuccaacacaggaauccccacaccgaacaaagcugcagcuucugggauaaugggucgcagugcacucccaagaccuucguuggcaauaaaugggaguaaccugccucgaagcaaaauugcacaaccuguuagaagguaagaauguguauuugcguaacuucauuugcaguuuggaacuagaaacugcuccagacacacgcugacuuuuccuuuggcucacuuuaaccuuaguaagacacuacccuuuauggccugacuugugcucuccucccuuugaaaagugauggauaucccugugugggucagguccccuucucucugaugucauuuucuucccuuacucccucaucacuaucacuccuaagacgcucuuugcuuuugcuuuuaccagauaagcucugucuccagagcuuuuguagcuuucugcucccaaguuauuugcauggcuugcucugugccucccucaggucuuugcucagauggcagcucuauccaaaaauuguagggcggggggagguugacuuuuugguucauugcuguguauccccgaugccaagaacuaugcccaauacagguaggaucucaaauauuuguugaaucagucauuuuuaaucaaaauauggaaaaaugugucaggcguaugugcacacgcacacccuccucccacacauuuaugguuugaaaagcaucuuaaugacauucaccuggggcuuuaucagcuuauguugguaaguucaguaugguccagguaguaauuuuuuuuuuuucccuucaaaguuucagaguacuucaaaggacauuuagucuagcucuuggucaugauguucccuucuugaacuggauaucauggaguaucuuauauuaaaaauccauaaaagugguuugaggagagauugguagaugaggaaauaaagacaauaaauacagacagcucuuucaagaaauuaggauaugaaggagaaggagaaaaccauaguaaaaaguuugaaagagguggaacaagcaauuuuuuucugucuuuaugcauuuauggauauauaaauaguuuuauuuuguuuuguuuguuuagaaguaauagaugcucagaucaacaacaaauuucgaaaaacagaaacuauugaaaaauagaaaaguaaagacugacccauaauccuacugccagauagaaauaauuuugguacauguuuauuuauucaguaaguuuuggcuuauucugcuuuguaaaugcagagcugugucaucaugcugauggcugacuagaaucacauuauuugauguauaugguuauuguagaccauacauuuauccuugacuaugugucuccaaacuaaacucuuggaaaggucacugcuagacaaugugagauggucuauuuccccaaacuuaagcaaaugcuagguauuauucuuuuuaauuguuuuaaauuuaaauuuuuuauuuuaucuauucuuuuuagagacagggucuugcucuuuugcccaggcuggagugcaguguuaugguuguagcuuguuguaaccucaaacuccugggcucaagugauccuccugccuugcuaggacuacagugcauaucaccacucccagauaauuugaaaaaaaaauuguagagacaaggucuugcuauguugcccaagcuggucuugaauuccuggccucaaguuuuccuccugccucggccucccaaaguguugggauuauagaugugagccacugcacucagccaaagauucuuuuuaaauguuuugcgaauaugauaggcaaaucuucaauuacuaauaagguuuugaaaaugucuucauauucauuugcuguuuguauucaacagaguaaccauuuauguuuuuaggucauuuuucuagccaggauccuauauuuuucuuauuuuaaaauauguuuuauacauuaaggguauuggccccuuuauuuauguugcaaauuuucuugugcaaauacaacaugcaugacacuuugccaugaacuggggcucugggagauaagcaugcagugaagacccguaagugugaaccacaagguacacuugagauggugccaguggcuucucauuacugcaguggaagaacauagaugggagaguaggucaaagugagugaugugacucauaggauuauuaacaaucucucucucuguuuuucuugucucuuuuuaguuuucuucagccuccaaagccucugucuucacucagcacucugagggauggaaauuggagagaugguugcuacuaaugcaguuuuauguacccuugaaaaaugggaaagaaguaaaaaugaggguuguguuaccuagcuggcuggguagcaguggauguugggauauucuuucccuuuuguguuuuaauauauuuacugcauuguuucucaauggaccagucaccagagacuaauuauugcacuuaaauauuugccugagauacugcaacauucucaaacccaugguugcaguauugugacacuuagaucuaggaaguuuuuguagaacugcucuguaccugaauacuuuuugagagaauuaagauguaucaauaaugcuuugccauaugaguuuuuuaaaguaacuuguucaauuuacucacguguucuaaacaucuuuccauuacauguucuguauuuuaauacauugcauauugacaacuagguucuauaauguaugcuuugaaauuuacuuuuuuauaguuuacaggaauuuuauuuuuugugccuauuucuuuuuacaccuaugugaaccacuauggaacaacuuaaauuuugugccauaaaaauauuuuugugguaagguacuauuuuuuuagcucuagggauauaucagcaaaaacacaucaugcaauuugagacacauaauuuuguguugaaugagcacaacauaauuugaagcauugcaaggagauaaccagacagcagaauuaaaugguccugucuuuuucauuuuuaauuuauugucauacauggguuucauauuuauaacggcaucaugagcucauugcacuuaauaccugcaauguuugcuacuguaccacaauugauuuucaauacuuuauuacgaaggaugaaacuguaauguuuuauuaacaaugcuucuggaaaugaaugcauuuuaaagcaaauaaaucuuuuugauagaccuuuuacaaaauccauuugcacuaaugaaugcuuucuuauggcauauaacuuaauauuuguuacuguguacacugcuguuuuggaauguucagaaauaaagacucuauuucagcaauauca

SEQ ID NO: 17699 - RNA, 5126 nt, Homo sapiens
uaaugaggaaaauugccaaggaaucuaacagucaguggcaauauuugagcauccuuacucuagaacuacacacagaaaguaaugugugagagguagauacuuccagcugggaaguccauagaaaagcuucucuaugguggggauaauugugccaauucuuaaaguauuaguaagacccacaugaguaaaauauucuuuugugcuuucuaccauagcacucucuacaauuuuuuaugcucucuuauuauacauauuaucuaaguauacuuauugugcuuguuuaaucuucugccuuuuccaccccaagggagcaaaaauugcuggacauggcaacauuuaauagguguuaguaaugucaaaggaguaguguaugaaaggggaauaagaagagcugaguuugauuuugacuugaaugccuuuuggauuagcauucaaguauaucauuauuuucugguuuugcuugaaagaaaaugaccacaagauugaaugcucugauaugugcacuuuaguguuuugcgguauauaucaauaaagauaaaaauaucuuguaaguuggaggggugaaaaaaauuuuagauauuacaaugauuuaugaucuuccaugguuuaccccuaucaaaauguuaaucuuuaauauuuauuuuauuugggaaaaaauuuaauuuuaaguuuaauuaaauuuauuuuagauuuucucuuuaggaucaacaauggguggggaaggauugagaagcacuggucuagacuauaaaccuagaccauaaaucuugacuauaaacucaaugagacucuggacuguaucugccuaauacacugugguauccccaacagcucacagagugucugguauuuaguguaaacacaauagauguuuguucccuuguucauuuguuccuucuccaaagugagguuggguguccacauggagggaccagccugcucacagguaugagagaguucaccccuguggucggggagcaggcugagaggccaggcuggagaaguauaaagagccugggccuugaagcccucaucugggcugugcucaggagcuuggccuuucagaagagggagcaggggaggaauugaggaguuggagggauuucagcaagugggugacgcaugcugugcucuaggaagaguggaaucgaguacuugaauuaguuuuguccuugaauuaguuauggcuuaguacucguauauaugcuuuuuuuuucaguuuaaaugaccugacauagguacuuuaguuuuugggggauguguauugaucaaggaaaaagugucucauagaguuguggucuuguggcuggcuuauuucacauguguuauuucacacaucucaacauugagaucuguaugugacucucugcugccucuugguggcagaagaugaacuuagcaaggcaaaaaaauugaagcauucucuuggucuuuuuuaucugcaaacauuugguggcguacucaugaaaguuaaaacuuuccagagauuaauguggucauguuaaugugaugaguggauauuucaagacaucugaaguuugaauuuuauuaauuuguuccauuuugauaugguagcaaaagauucaguaaauguugguuuugauucuucuaggguucuuuuuuuuuuuuuuuuuuaagaagcauguaacuuaauuucuaggguuguuuugguaaauuuaauggcuauaagauuauuuucuaacuuuuuaaauauaguuuuagccacuuauugaauaggaacagauagcuaacugcuuagcuagucccuaagucuuuuuauagaaguuucguucuccuuuaacacauuguauuaguuaggguucucuagagggacagaacuaacaggauaaauguauauaugaaggggcauugauuaaggaguauugacucacacgaucacaaggugaggucccaugauaggcugucugcaagcugaggagcaaggaagacagucggagucccaaauccucaaaaguagggaagccgccagugcagccuucagucuguggccaaaggccugagagauccuggcaaaccacugauguaaguccaagaguccacaagcugaagaacuuggagucugaugcucgaggguaggaagcauccagcacaggagaaaggugaagucugcuccuucugcauucuucugcgcuuuuauccuagccaugcuggcagcugauuagauggugccuauccagauggagggugggucuaccccucccaguccacugacucaaauguuaaucuccuuuggcaacacccucacagacacacccaggagcaaugcuuuacauccuucaauccaaucaaguuggcacucaauauuaaccaucacacaugcuuauuuggugggaacccuucugguugggaaggguguuuuccuguacaauagguuagaaagcuugaucaucaacauguaauaauuuguauuuauuauugagcacaauaugacuuuuguuauuugcuuuugaaagcuaguacuuugguugcauaacaucugucauuuuuaacuuaguaaaauucuuuuccagauaagcuccgaagaaguaugccuaaccuagcccggaugccaaguacaacugccauuaguagcaacauuaguucuccggucaccgugcgaaauagucagaguuuugacucaagcuugcauggagcuggaaauggaauuucaagaauacaaucuuguagugaguauaauuauuugauauaauuauauauuguauaauuguauaauuuuuuauaauuuuuaauuguaaggaaaaugucuguuuuauuucuuuguauuuacuugaaagaacacuaaacuuuuuuccuugccguguaacuuauuuuuuuauuucaccauuagaguugaauaguauuuuuacuauucaaauaguauauuuacuauucaacuuaccagugccugugguauaaauuacuuaccagugccugugguaucaauuaauaauaguaaauuguuauuuguauaauaauaguaaauuauuuguaguccuuuauauccuaggauaguagaaguacuacauggugauugauuuauccacucaucauacaaaaauuguuuuccuugcagauccuccuccuucuagcugucuaccugaauaagcacacuuaauucuguuuagccguuccuuuugucuuguuuuucaccuaugcauacuuuugucuuuuucccccuaaaugaaguuauauuuuagagugucuaaaguaguuuuuguccacucuauuuagcuuaccccacauucuguuacuuacuuucuauguuuuacccagcagugagugacacaguuagcauuaggccuagugcuguguaucuucacuuuauguggggaugugcugcuucggcaucccccuauuccuacucaugcugucuauauggguuguugcaguuaagucuuacacugacuuccaggaggaaggcacaagguuauauuaccaguauucauaaaaaugcccaaacuugggaggcugagcauguucugaguguacuggccaagagucgucaaccggauguuuuaagucugcauccaaaaugguuuguagcuuuucucccucaaacuuaguuuuaggugucagguuguaucucccuaacaugcagcgaucuuucauuucuuuauguuuuaguuccuaacaaccaagugacaucauuuacucuguacaaggaacugugcuaacuaguuuauauucauuaucuuauuuaguucuaccaacaacucuaugaauuaguuucuacugccauucuuauuuuguggaagaggcaacaguucugauagguuaaggaacaguuugucuaaggccauacaguuggaagagcagagaggcagaccuaggucugguuacucccagagcuuuuaacugcuaucauauucuagcuccacgugcuguucuucucugccuagcauucuuccuuuuccuucuucguucaguuuacuccuauuuacuuuuauaacacaguccaaauaccaugccuuuggaagucuucauugcuuacuuaaucacccuaacacacuuucucaaauaccccccaaacaauacuagaguggauuagauuuucggugcuuaccucuguuauucaauguaccauguuuuacuauuaauauguuugucuuccuuacuagauuguaagcucccucugggcuugggccaucauuuauuugauuuucuguucccagugccugacguauugccagaacauaaggaacucucagugaaugcuugaaugaaugccacaggauucuauguuaaggcuugaccuauuaaauauuuagaaccaaugacuuguauaaggacacauaaacaaccuaugaaauuugccaauaguagaaaccgagaggacuaacaacucauuuuaugucaggagguuaggagaaugggccaaauguaucaugaagaaauuuagcugauagaaauauacaauucuaugucugaauuacaaaaaucaguaacauaccagccuaggcaauaugaugaaaccccgucucuacaaaaaauacaaaaauuagccaggcauaguggcacaugucaguaguccuagcuacuuggaaggccaagguaggaggaucacuugagccugggagguugagucugcagugagccaagauugcaccacugcacuccagccugggcaauagauagaaugagacccugucuugaaaaaagaaaaaaaaaaaucaauaguguaagugugggaggggagaaauacaguuuggagaauagcaaauauaguaacaauuaggaauuuuuguugacuccaacucaauguguauuaguagcagauuugagugccagaaaaauguauguagcccaaaauagaauguacacugcaaagaauguucagccuugauugaagugcccccaaaaugacgggaaaaugucaaaaggauacaggaaccaaguugaaggaaccuccuaauggccaaauuuggggcaguuugagccacagaguaaauaauuauaguaauggauuauaacugauggaauaaaauaaauaugcauggguucauacuuaauuggauaaauagaggggaacauccucuuuguaguagauuccaauucaugcguguaaaagcaaugaggaaaauauaaaaaucaucauuucuaagucaagcauaauacugagagaaagc

SEQ ID NO: 17700 - RNA, 439 nt, Homo sapiens
cuaaagccucauuugauccaccaacaggcuccuuuaucuccucuccagggaaaggguggauccauuuucuuccuaggaggaguucugagcuucuccacccuagggaccagggaguauggcugggaugagccagcccucagugcgaaagacauaggccaccuggguggccauggcacagguuuguaccacagcacagaggccccuggagccaggugagcucagacagcugcucccaggucagcagagaauaggccuacuguucccacaccugggcuguguugugauaaauggcuucagauggagugugcagagaggucaccaggcuuuucugaagugguaguggguggucuccuagagacugagaucugggccgcucgcugugcccggugugggccucugggggucccccacagcaggcaucaugggucuccucauuuca

SEQ ID NO: 17701 - RNA, 6643 nt, Homo sapiens
agucucuuuauuuacgccuaccucccagcccuuggcaaucugacuaauaacaaacugagcuaacaagaaauacuagaaaaggaggaaggagaacauugcuguagcuuggaucuacaaccuaagaaagcaagagugaucaaucucagcucuguuaaacaucuuguuuacuuacugcauucagcagcuugcaaaugguuaacuauaugcaaaaaagucagcauagcugugaaguaugccgugaauuuuaauugagggaaaaagggacaauugcuucaggaugcucuaguaugcacucugcuugaaauauuuucaaugaaaugcucaguauucuaucuuugaccagagguuuuaacuuuaugaagcuaugggacuugacaaaaagugauauuugagaagaaaguacgcagugguugguguuuucuuuuuuuuaauaaaggaauugaauuacuuugaacaccucuuccagcugugcauuacagauaacgucaggaagagucucugcuuuacagguaagaugaauguuuccaggcuuuucuuauacuuauuuuugcauuauaguaaagugauugaauuuguauguucgcuuccuuuaaauaaacaacuuugcauuaaaggauacucaauuucauucuugcuuacuggcacaacuaacacuggagcagaugccuguauucucugagaagcagacauuuagucuaacagcuggcuacagagaagaacaaauauaauauuccacuauuucuuuugcaacaugcaguuuguuguuagaaacuaaauaugugugcuuucugaaggaaggaucacuuccaaaugcgaauguugaauugcaaauauaagcagaauauugaauaauucuuugcauuuuguaugcuacuuauuuucugauuugaaaauacguauucucagaaaacaugucaaugaguaucuuuugaccucuuuaccacuguaucagauauugucaguagagaaccacuuuucacaucuguguguguuucugaaaagauuagaaacuguuuccuagcacguuuugaagagcauaaaauucauacaggauuuacaaaauaacaagaguuuaucacugaaaaauuauuuacuauuuucucugaugcuauaccuggugaaauaaaucuuauucuuucuugguaauuuaugaauaaguacuuuuagugauuguggaagcuaauccacaaguugaagacuccaacuacaagcugcuuguuuauaaacucagcacacaaagcuguuuaaaaucaaauuauuuaccuacagaaaaauaaaaucuucuaacuuucccuuuacacagaggcaguauguuguuuuguuucuucaguugccuuuugccuuucaggaacuuuguacuauauguguuuucaauaaaacacuauguuuucagggaaugcaaguuuacuuucaggauuguugauuggguucugguauguuuuaccugauugugaauuuuaauuugauucaguuacuguucauauuucaaacaacaaaaaugaaaacugauuacuauuuugaaaaguugaauagucauaagauguguuuauauuucaauuuaguuuauauaaguuuaaaguauaauauuuaaaggaaggaaauaaaauuagaucucauuagagcuauaaauguuuaccuugcauaacugucauuuaaagggcaaaaccuuuuuaagaauugcuguuucagaugcauuuguuauguguuucaggauuagaauacgugauguuauucugaaccauccuuuuuuucuuuuacugaauuugaaauaucaucaaaaaguuuaauaugguacaguuuguuucagauuucauuguuugcgacuuuaagccuuuuaauaaaggcuuaaagcugcuuaauuaugugaugacauuccgugcccuaaagacuguuucaagaccucauuaggaagucauuugcuagaaguuuauaugaagcauuguuuauucuuuuacaacagccugaaauguguguuaaagauuaaucuugcuucuuuaguuuuuaucauuuccaccucaucuauaacguaauuaagaagcaguaagcaauauacugcuucuagaaauucaauauuaaauauaaugauuuaagugaaauuugaauggucacacuuaaguguauguaucugauacuauuacgcuuauacaaacuacccuugauugaauaguuaaaagaguucuuauaguacuguacuuuauaacaugaucaaagacgcauuuuccucaagguuuucaaaauaaacaauaaaauuaguauauauauauauauauagccaaaaccgaagcagguuaaaacacagacacaguuauuagauguuauugugugacacccaguucaacaauauaaagacaaugcaugcuacaugcguacaugcauacacacauacacauaugcacacauacauucuuuuaucauuuuuuacauucccuacaguucucuaugcuuacggcuaauaacuauguaauugucuuuuacuauaauccuccagccuuaaauguaugaccauaagguuaaaaaauauuuucaaauauauaacuuugcaucacagugaaguaucagugcucuaaggcagcaucucucucaucuguuaaaaugcagguuauucaucagaugugagcacaaauuuuaugauauaauauuuuaaaucccccuugaccuaaauuuuauauuuugaacacaaugcaaguuaaaagucagccagacuugccugucugaguauuaggaaaaaaaaaaaagaaacaaaugauguaaaugcagcaagguacccauauuuucaugguaauccgucauuugcuuuuuggagaaaaaccuauuauuuugaaaauaucagcuucaucuccuccccaguucugcccacuaaagucccuugcuauugcguuuuauuuuacagaaucggauuucaucacaugacaacaugaagcuguggauucaucucuuuuauucaucucuccuugccuguauaucuuuacacucccaaacuccagugcucucauccagaggcucuugugauucucuuugcaauugugaggaaaaagauggcacaaugcuaauaaauugugaagcaaaagguaucaagaugguaucugaaauaagugugccaccaucacgaccuuuccaacuaagcuuauuaaauaacggcuugacgaugcuucacacaaaugacuuuucugggcuuaccaaugcuauuucaauacaccuuggauuuaacaauauugcagauauugagauaggugcauuuaauggccuuggccuccugaaacaacuucauaucaaucacaauucuuuagaaauucuuaaagaggauacuuuccauggacuggaaaaccuggaauuccugcaagcagauaacaauuuuaucacagugauugaaccaagugccuuuagcaagcucaacagacucaaaguguuaauuuuaaaugacaaugcuauugagagucuuccuccaaacaucuuccgauuuguuccuuuaacccaucuagaucuucguggaaaucaauuacaaacauugccuuauguugguuuucucgaacacauuggccgaauauuggaucuucaguuggaggacaacaaaugggccugcaauugugacuuauugcaguuaaaaacuugguuggagaacaugccuccacagucuauaauuggugauguugucugcaacagcccuccauuuuuuaaaggaaguauacucaguagacuaaagaaggaaucuauuugcccuacuccaccaguguaugaagaacaugaggauccuucaggaucauuacaucuggcagcaacaucuucaauaaaugauagucgcaugucaacuaagaccacguccauucuaaaacuacccaccaaagcaccagguuugauaccuuauauuacaaagccauccacucaacuuccaggaccuuacugcccuauuccuuguaacugcaaaguccuauccccaucaggacuucuaauacauugucaggagcgcaacauugaaagcuuaucagaucugagaccuccuccgcaaaauccuagaaagcucauucuagcgggaaauauuauucacaguuuaaugaagucugaucuaguggaauauuucacuuuggaaaugcuucacuugggaaacaaucguauugaaguucuugaagaaggaucguuuaugaaccuaacgagauuacaaaaacucuaucuaaaugguaaccaccugaccaaauuaaguaaaggcauguuccuuggucuccauaaucuugaauacuuauaucuugaauacaaugccauuaaggaaauacugccaggaaccuuuaauccaaugccuaaacuuaaaguccuguauuuaaauaacaaccuccuccaaguuuuaccaccacauauuuuuucagggguuccucuaacuaagguaaaucuuaaaacaaaccaguuuacccaucuaccuguaaguaauauuuuggaugaucuugauuugcuaacccagauugaccuugaggauaaccccugggacugcuccugugaccugguuggacugcagcaauggauacaaaaguuaagcaagaacacagugacagaugacauccucugcacuucccccgggcaucucgacaaaaaggaauugaaagcccuaaauagugaaauucucuguccagguuuaguaaauaacccauccaugccaacacagacuaguuaccuuauggucaccacuccugcaacaacaacaaauacggcugauacuauuuuacgaucucuuacggacgcugugccacugucuguucuaauauugggacuucugauuauguucaucacuauuguuuucugugcugcagggauagugguucuuguucuucaccgcaggagaagauacaaaaagaaacaaguagaugagcaaaugagagacaacaguccugugcaucuucaguacagcauguauggccauaaaaccacucaucacacuacugaaagacccucugccucacucuaugaacagcacauggugagccccaugguucaugucuauagaaguccauccuuugguccaaagcaucuggaagaggaagaagagaggaaugagaaagaaggaagugaugcaaaacaucuccaaagaagucuuuuggaacaggaaaaucauucaccacucacagggucaaauaugaaauacaaaaccacgaaccaaucaacagaauuuuuauccuuccaagaugccagcucauuguacagaaacauuuuagaaaaagaaagggaacuucagcaacugggaaucacagaauaccuaaggaaaaacauugcucagcuccagccugauauggaggcacauuauccuggagcccacgaagagcugaaguuaauggaaacauuaauguacucacguccaaggaagguauuaguggaacagacaaaaaaugaguauuuugaacuuaaagcuaauuuacaugcugaaccugacuauuuagaaguccuggagcagcaaacauagauggagaguuugagggcuuucgcagaaaugcugugauucuguuuuaaguccauaccuuguaaauaagugccuuacgugagugugucaucaaucagaaccuaagcacagcaguaaacuauggggaaaaaaaaagaagaagaaaaagaaacucagggaucacugggagaagccauggcauuaucuucaggcaauuuagucugucccaaauaaaauaaauccuugcauguaaaucauucaaggauuauaguaauauuucauauacugaaaagugucucauaggaguccucuugcacaucuaaaaaggcugaacauuuaaguaucccgaauuuucuugaauugcuuucccuauagauuaauuacaauuggauuucaucauuuaaaaaccauacuuguauauguaguuauaauauguaaggaauacauuguuuauaaccaguauguacuucaaaaauguguauugucaaacauaccuaacuuucuugcaauaaaugcaaaagaaacuggaacuugacaauuauaaauaguaauagugaagaaaaaauagaaagguugcaauuauauaggccauggguggcucaaaacuuugaacauuugagcuuaaacaaaugccacucucaugcauucuaaauuaaaaaguuaaaaugauuaauaguucagguggaagaaauaagcauacuuuuuggguuuucuacacauuuuguguagacaauuuuaaugucagugcugcugugaacuaaaguaugucauuuaugcucaaaguuuaauucuucuucuugggauauuuuaaaaaugcuacugagauucugcuguaaauaugacuagagaauauauuggguuugcuuuauuucauaggcuuaauucuuuguaaaucugaaugaccauaauagaaauacauuucuuguggcaaguaauucacaguuguaaaguaaauaggaaaaauuauuuuauuuuuauugauguacauugauagaugccauaaaucaguagcaaaaggcacuucuaaagguaagugguuuaaguugccucaagagagggacaauguagcuuuauuuuacaagaaggcauaguuagauuucuaugaaauauuuauucuguacaguuuuauauaguuuugguucacaaaaguaauuauucuugggugccuuucaagaaaauuaaaaauacuacucacuacaauaaaacuaaaaugaaaacucuuuuuua

SEQ ID NO: 17702 - RNA, 2100 nt, Homo sapiens
uuuuuuuuuuuuuuuuuggagggacugguucuuuauuucaaaaagacacuugucaauauucaguaucaaaacaguugcacuauugauuucucuuucucccaaucagccccaaagagacgacauaaaaggagaguacauuuuaagccaauaagcugcaggauguacaccuaacagaccuccuagaaaccuuaccagaaaauggggacuggguagggaaagaaauuuuaacagaucagcaaacugccagcccacggacugcagaggcugucacagccacaugggguggccagggugccacaaacccaaagaagcaaaguuuuaaaauaauauaaaauuuaaaaaguuuuguacauaagcuauucaagauuucuccagcacugacugauacgaagcacaaugagauggcacuucuagagacagcagcuugaaacccagaaaaggguaaugagaugaguuucacauggcuaaaucaguggagaaaacacaaucuucuuucuuucaaggaggcaggaaagcaauuaaguggucaccucaacauaagggggacaugauccguucugugagcaguugggaggggguagagaugagagaaaguuuuggucucagaggucuuaaccaucuuaauuugaucauuucuaaugaaaaaaauaaaaaauagaaauaauauuauccaaagauaucuuaaagcugaaaacuugaacagcacauuuuuguuuuuguuguuguugggcuaacuccuccuggaaucaccuuucugguuuagcuaguacuuuguacagagcaaugagguuucccacaguggagucucccugggcucuguuuggcucucagcaaggcaagccuauaccuuuuccucuccucuauggagaggggaauaugcauuaaggugaaaagucaccuuccaaaagugagaaagggauuugauugcugcuucagggcuguggaauuauuuggaauguuuuacaaauguuugcuacaaaacaacaaaaaagguaauuacaaaauguguacaucacaacacgcuuuuuaaagacauuaugcauugugcucacauucccuuaaauguuguuuccaaaggugcucagccucuagcccagcuggauucuccgggaaaaggcagagacaguuuggcgaaaaagacacagggaaggagggggcggugaaaggagaaagcagccuuccaguuaaagaucagcccucaguuaaaggucagcuucuggcaggcuggccucaggcggagucugggucacagggaggagcagcagcagggugggacuggggcauucuacaucucauucaggucaagcagagucugguccagcauccuuuguguacagaggugcuccucuuuggugcauuucaguuuaucuuccaagucaucaauugucuuuuccagcuuggcuaccgaucgcucagcaaacucagcacaggucucugccuccuuggguuuaucaguaaaaaucuugauuucuuccucauauuugucuucuuuuugagaguacuuuucuucagcagcacucagacacuucagguucugguccaucagucuaaucugcucauccaucucucggcaacgggacucugucagcucagcucguuccucugugcguuccaagucuccuucaauggucaccaacuuacgagccaccucuucauacuuccuaucugccucuucugcaaugugcuuagcuucuuugaguuggaguucuuggaguuccaucuuuucuucaucuuuuaaagcccgguuuucaauaaccuucauaccucucucacucucaccagcagcuuuuucugcuucuuccagcuuuugcagggcaguggccaggcgcuccugaggacgauccagcucuucuucaaccagcuggauccuacgguucaaggaggccaccucagccucagccuguuuccgggcccgccuuucucccucaacuucuugcuggaggcgcucagcucgcuccucugcaucaucugccugcugcugcagaaccuggaucuugcgcuucaccgccucaaugguggugaucccagccguggugcccacccagcuacugcucgcgcuccgguuccugccuccuccgcucgguguugcagccuccucuc

SEQ ID NO: 17703 - RNA, 2099 nt, Homo sapiens
uuauugguuuagaauugauuaauugaggagcccugauuuucugauccagggcaaauaggauuucauugucaguggauacguagcuccucugaauuacugcaaggauugcuucucacauuuaacacuggucccugaaauuuuccaugaauuuuccagaagugcaaaagcugcagaugcccaaagaugguaccuuggcaguuccauugcuucuaagcaggccuggaucuuagagaucucagacaaguugauauugaucuuugaagaaacguuauguacaaaggaaauauaucugccaaccuccuuuagaaacagggucaaauaagcaguuggaaaauuuucuaaaugugucacauuaaacuuuaauaauaccuacguuuuuauggggcuuuuaacuuugcaaacugcuuucacaugcauuaucucauuccaucuucuauggcaaugaaacagugucuaggcuuuagggcugaauuacaaugacaucgauaugaaaauguugacagggacaugcaaaaaaguuauuacuaugccaagcagaagaauucaacaggaauuggauggauucaagaucaguaauuacaaaggguuaagauucugcuugugguuuaucacugcuauuuugucuuuuuuuccuccucuuuauccuucuuauuuuugauuuucuuuuucuuugcaauaaaucugcaggucagcccaaccccaggguguauccgugcccucaugaagaugcuguacugcccauacugucgggggcuucccacugugaggcccugcaacaacuacugucucaacgucaugaagggcugcuuggcaaaucaggcugaccucgacacagaguggaaucuguuuauagguaagaaguguuuaaauggauccgagaacagagacgggacaacagcaaguguuuauggggcuugaugggugggucagaaguuauaagaaaccagacacagugguucacaucuguaaucccagcacuuugggaggccaguacagauggauugcuugagcccaggaguuugaggccagccuggacaacauagugagauucccaucuuuacaaaaaauaaaaaauaagcugggcgugguagcacacaucuauggucccagcuguuuaggagaccgaggugagaggauugcuugagcuucggagguugaggcuacagugagcugugauugcgccacugcacuccagccugggugacagagugggacccugucucaaaaaaaaaaaauguuaugaugacuuuuagagacuaggaugguuuuuaaaaccauguuuagcaaauuauaaacauuauuuuacauuuuccuaauguuuuuacuguauguuauaugggacaguccuguuaaagauugugcaacccagcuauauugagcuaacuguucucucugaugaaaacaaaaguaaucuuguugaaguuccaugcacucccgugagaaaggacgcuuuagaaaagaaucuuguaaaaaaaaaaaaguccacuguacuauuucuuuuuuauuuguauuaccucagcauagccacacauauuagcaaacaauucuuuccuugaacuccuagaaugaaaauagaucaauacuuuggcuaaaauaugcaaauuuucuaucucauucuguggaaaagaaggcuuuaagcacacaagcaugaaacagccuuccagucucuagagggcaggaggcagggagguggggagaauggaggggaaggucucugaaucaaggcucuguucuuggguugcagaaaucauucaagugguugcauggcccaaagacaguucacaaauugccauccaaggauaaaaggacaaauuucauaggcaggcuucucccaggaaaauacacaggccuugaaagaguaaauguguuuucucccccucugucaaauagccuucaaauaaaaguacuuucaauugcauuuacugcaauuacacagugacaagcagaguggugaaaauagcaguggcauuugucagccucugagggccuucgucauuuaugcaaaccucuaaacgagcaugcacaaguaaaguguucugacaacuaagauuugcauaggauagaaaaaagauguuagaauucagagaaacugaagcuca

SEQ ID NO: 17704 - RNA, 713 nt, Homo sapiens
uucugggugucacggaauggaguggccaauggccugcagagcaacaugcccaaguuuuauugugacuacugcaauacauaccucacccaugacucuccuccugugagaaagacacacugcagugguaggaaacacaaagagaaugugaaagacuacuaucagaaauggaugaaagagcaggcucagagccugauugacaaaacaacggcugcauuucaacaaggaaagauaccuccugcuccauucucugcuccuccuccuguaggagcaaugauaccaccucccccuagucuuccagguccuccucacccugguaugaugccagcaccccauaugagggguccugccaugaugccaaugaugggcccuccuccuccugggaugaugccagggggaccugcuccuggaaugaggccgcuuaugggaggccacaggccaaugaugccuggguccccagugauaagaccuccugccugucccaugauggugcccacucggcccagaaagacuugaccagacagauaaggauaaaggagagggcucauuaugucgguuuuauauuaccuguucugcuucaccaggagaucaugcugcugugaugcuggguuuucuaaacagcauaaggaagucuugcuccccucuccuaucaaagagaauaguuuuggaggggagaagugggacaaaaaagaugcaguuuucauuuguauugggaa

SEQ ID NO: 17705 - RNA, 3850 nt, Homo sapiens
auuuuucuuuucccugguucaggcuuuauuuaaacucuuuguucaaaaaaaaugaacagagugauagucggauucuaauuuacagauauaccuuagacgucuaauauuaaauuagaaggucacacuagaaaaucauuuacacauaaagguuaaaaccauauuuaaaauuuuaaaaacuuuauauuacauaaagccaaaaugaaacuaaauacauguuagccaacuucauucacaaacauuagucaaaauauauacauuuaaaaagaaacaaagcuaauaauugaagguuccuuuuuucuaaaauguguuuuauugcaauuugcaaaugaauugcaggugaucuaaaaaauaagccaauugaggagggaaauccaaaacacauuaaaccagcucaacuugggagagaaaugcuagcugaaaaugagagacaucuguugaaacaauucugugcuuuuuuucuucaguuuugcuaaauaauaaauauauaauuaccagacaaaaaagucugauuuaaucuucgauaaaauugcgauucugaaauaguuucgcaauuuuuaaaaguuaacuuugauauucgcucaaaauguuuuugagucuaaagucgacucaaacuuagggcaacgaaaauaacacauuuuccaagccucaauguuuucacugacauauacacauuuacaaucuuaaggugaacucagccauaagggaaaauaggagcagugccuuuuuccuuuuuuguaaacugugucagaaauccaagcgaguggacucagggagacuucuaguaguuuguuguuguuguuuguuuaggaagaaaauccaauugacaacuuucaucucacaaauauuucuuguuugcguuucuugcccuugagaaagagcucuugcucugauuugcaaauggcgugauaaacaaaagaaaccgugaucaucucacacaaaaggccagauucgagccggucacuggucaagaauggaucugguugggaguucugcuugagagaacagagaucugcaaaguucaaauaguacaaacagggaggcgaggcugcucagagccaucccacucccagaaacgaaugacacaagcagcuuuucccgugugccagccauuucagaccucacauuugaacagcgugcaugcaacacggaccgggaggggguuggggguuggggggcugaggggcgaggaagaagaaugagaaacaaaaacaaaaccgaccaugaaacuuccaacaaaacuggaaaggccaacaugucaaaaaguuacuccuccaccuccgugggucaaaacgcaacagguuccgaagugcaaagcaaacgccaacugcugccgcacacaaccgccugcuuucgaguuggcugccgaagugcgggucugaaaugauccugcgaauucacaggccugcucgcccgcgcccuugcgcgcuuggccacuccugccccgccuggccucucugccucuaccuggcaccuauacauucuauguacauacaaaccgggcccccggucgcgggagggcgcacggggaggccgcagcgcucguaccuauacauauguacacgugugcacaccgguccucgcgaggcggccccgcggggucauagcgcggcagcguaggccgcgggguagggguccagcuggggcuugcccaugcccggcagcaggauguaggcgagcggcggcugcagcccggggcugggccacgcgcugcaguugcacgggaucauguagcccggguugcccgggcuggggugcgagugcgugugccccccggcggcggcggccgccgcugcagccgccgccgccgcgccguggaaggcgcccgcgcccgcggucggguagcccagcgacgacgcguacgggaggccggacgaggacgacgagaucucugccauuuuggagcccaggucgagcagcgaguaggggcugcccgcggcggcggcggcggcggcagcggcggcggcagcggccgacugcgggaagaagacgcgugcggcggcagcggcggcggccgcggccgccuucucgggauuggcgagcagcgacucaggcaccaggccgccgcccgcccccgcgugcagcccggcgcccgccuugagcgcagggugcucggcguccgccacgccgcccaggccguagggcaccgggaaggcgaacuuguccuucuugagcagcgucuugggcuugcgccgcggccgguacuuguagucggggugcuccuucaugugcauggcgcguagacgcuuggccucgucgaugaacggccgcuucuccgacucugugagcaguuuccacucggcgcccaagcgcuugcugaucuccgaguugugcaucuugggguucuccugggccaucuugcgccgcugagcccgcgaccacaccaugaaggcguucaugggccgcuugacgugguccaccggcuuggacaugcucucgcccugccgcggcugcagcccgccgccucccgggcccucgcccucggcccggaggaaaucaauguuggcugcccgcggagacccgcucggccggccggggcucgucgcgccccggcgucgcucccgccccggaggagggggcugggggaccagcccagggccacgccgcgccccgggccgccuuagugucuccggccgagcgcucgagcagguugucucugggacacucuaacuucucggcggugcccccuccccgcggcggcaguuugcccuuuacguucuuuggguccuucgucugcaguggcguuugcuggugagcuccccgcagguagcggcggccgggcagagcgcuccuccuccucggucguucucucuuaaaugcaaagcguccccaaaaguugcgucgcggagacuccucgaaguugagccgaggagcccgccgccgcgugcugccaagugccaaagggggcucucagcggcuggaguguuuggguucuccucggugacuuucucauuugacagaagcagauggggguggggaaggcggggagguggcccuggaggaggaagaggagggggaggcggaggaguguccaggcgugccacgagaacgcagagcgcagcaauggauauaaauacaaauacagcagcaccagccugucuucuuggcuccgggcagggugcgccgaugggaaacccccaaucggcugggugauuuuuuuuuuuuggaggggggagcugucccccgcagcaccugccucucgagucuuccucucccgcugcuggacugacggguggggcgaggaaggaggguggaugaggcuugagcaagcguuggucgcccggccucagaggaaguucucccggcucgccgaggagccgcguccggccguccccugggccaugccggcucuguucgcuccgagccccuucaggcgcgccugccgacuuagggcucccggagcucgccggccgcggagggcagcgcagccuccacgcggcgccgcaggccuggcaccggccgcguccccgccucgcucuucucggcagccgccuggcacuugcaacuaacuucgcccaaguuuccugcgccgcggcgccccucucggcgcgcuccugggagcgugcgcccgcgaguccgccgcgcccggggccccucuguccucgcugcuguggccagagccgagccggcgcaggggcggaggugcugcaggagaguuaaggaaaacgggccaucaccucaguucgcagguccgcgcuguggcaccucccgcucuccccacucccgcggcgcagggggccccuucccagcccaggccgcccucugcaccggcucaggugaguguggcuaccugcaugugugcgcgcccggagccggcacugggugugcauguccagccgcggcugugugugua

SEQ ID NO: 17706 - RNA, 3850 nt, Homo sapiens
uacacacacagccgcggcuggacaugcacacccagugccggcuccgggcgcgcacacaugcagguagccacacucaccugagccggugcagagggcggccugggcugggaaggggcccccugcgccgcgggaguggggagagcgggaggugccacagcgcggaccugcgaacugaggugauggcccguuuuccuuaacucuccugcagcaccuccgccccugcgccggcucggcucuggccacagcagcgaggacagaggggccccgggcgcggcggacucgcgggcgcacgcucccaggagcgcgccgagaggggcgccgcggcgcaggaaacuugggcgaaguuaguugcaagugccaggcggcugccgagaagagcgaggcggggacgcggccggugccaggccugcggcgccgcguggaggcugcgcugcccuccgcggccggcgagcuccgggagcccuaagucggcaggcgcgccugaaggggcucggagcgaacagagccggcauggcccaggggacggccggacgcggcuccucggcgagccgggagaacuuccucugaggccgggcgaccaacgcuugcucaagccucauccacccuccuuccucgccccacccgucaguccagcagcgggagaggaagacucgagaggcaggugcugcgggggacagcuccccccuccaaaaaaaaaaaaucacccagccgauuggggguuucccaucggcgcacccugcccggagccaagaagacaggcuggugcugcuguauuuguauuuauauccauugcugcgcucugcguucucguggcacgccuggacacuccuccgccucccccuccucuuccuccuccagggccaccuccccgccuuccccacccccaucugcuucugucaaaugagaaagucaccgaggagaacccaaacacuccagccgcugagagcccccuuuggcacuuggcagcacgcggcggcgggcuccucggcucaacuucgaggagucuccgcgacgcaacuuuuggggacgcuuugcauuuaagagagaacgaccgaggaggaggagcgcucugcccggccgccgcuaccugcggggagcucaccagcaaacgccacugcagacgaaggacccaaagaacguaaagggcaaacugccgccgcggggagggggcaccgccgagaaguuagagugucccagagacaaccugcucgagcgcucggccggagacacuaaggcggcccggggcgcggcguggcccugggcuggucccccagcccccuccuccggggcgggagcgacgccggggcgcgacgagccccggccggccgagcgggucuccgcgggcagccaacauugauuuccuccgggccgagggcgagggcccgggaggcggcgggcugcagccgcggcagggcgagagcauguccaagccgguggaccacgucaagcggcccaugaacgccuucaugguguggucgcgggcucagcggcgcaagauggcccaggagaaccccaagaugcacaacucggagaucagcaagcgcuugggcgccgaguggaaacugcucacagagucggagaagcggccguucaucgacgaggccaagcgucuacgcgccaugcacaugaaggagcaccccgacuacaaguaccggccgcggcgcaagcccaagacgcugcucaagaaggacaaguucgccuucccggugcccuacggccugggcggcguggcggacgccgagcacccugcgcucaaggcgggcgccgggcugcacgcgggggcgggcggcggccuggugccugagucgcugcucgccaaucccgagaaggcggccgcggccgccgccgcugccgccgcacgcgucuucuucccgcagucggccgcugccgccgccgcugccgccgccgccgccgccgcgggcagccccuacucgcugcucgaccugggcuccaaaauggcagagaucucgucguccucguccggccucccguacgcgucgucgcugggcuacccgaccgcgggcgcgggcgccuuccacggcgcggcggcggcggcugcagcggcggccgccgccgccggggggcacacgcacucgcaccccagcccgggcaacccgggcuacaugaucccgugcaacugcagcgcguggcccagccccgggcugcagccgccgcucgccuacauccugcugccgggcaugggcaagccccagcuggaccccuaccccgcggccuacgcugccgcgcuaugaccccgcggggccgccucgcgaggaccggugugcacacguguacauauguauagguacgagcgcugcggccuccccgugcgcccucccgcgaccgggggcccgguuuguauguacauagaauguauaggugccagguagaggcagagaggccaggcggggcaggaguggccaagcgcgcaagggcgcgggcgagcaggccugugaauucgcaggaucauuucagacccgcacuucggcagccaacucgaaagcaggcgguugugugcggcagcaguuggcguuugcuuugcacuucggaaccuguugcguuuugacccacggagguggaggaguaacuuuuugacauguuggccuuuccaguuuuguuggaaguuucauggucgguuuuguuuuuguuucucauucuucuuccucgccccucagccccccaacccccaacccccucccgguccguguugcaugcacgcuguucaaaugugaggucugaaauggcuggcacacgggaaaagcugcuugugucauucguuucugggagugggauggcucugagcagccucgccucccuguuuguacuauuugaacuuugcagaucucuguucucucaagcagaacucccaaccagauccauucuugaccagugaccggcucgaaucuggccuuuugugugagaugaucacgguuucuuuuguuuaucacgccauuugcaaaucagagcaagagcucuuucucaagggcaagaaacgcaaacaagaaauauuugugagaugaaaguugucaauuggauuuucuuccuaaacaaacaacaacaacaaacuacuagaagucucccugaguccacucgcuuggauuucugacacaguuuacaaaaaaggaaaaaggcacugcuccuauuuucccuuauggcugaguucaccuuaagauuguaaauguguauaugucagugaaaacauugaggcuuggaaaauguguuauuuucguugcccuaaguuugagucgacuuuagacucaaaaacauuuugagcgaauaucaaaguuaacuuuuaaaaauugcgaaacuauuucagaaucgcaauuuuaucgaagauuaaaucagacuuuuuugucugguaauuauauauuuauuauuuagcaaaacugaagaaaaaaagcacagaauuguuucaacagaugucucucauuuucagcuagcauuucucucccaaguugagcugguuuaauguguuuuggauuucccuccucaauuggcuuauuuuuuagaucaccugcaauucauuugcaaauugcaauaaaacacauuuuagaaaaaaggaaccuucaauuauuagcuuuguuucuuuuuaaauguauauauuuugacuaauguuugugaaugaaguuggcuaacauguauuuaguuucauuuuggcuuuauguaauauaaaguuuuuaaaauuuuaaauaugguuuuaaccuuuauguguaaaugauuuucuagugugaccuucuaauuuaauauuagacgucuaagguauaucuguaaauuagaauccgacuaucacucuguucauuuuuuuugaacaaagaguuuaaauaaagccugaaccagggaaaagaaaaau

SEQ ID NO: 17707 - RNA, 68195 nt, Homo sapiens
cagaggagccgggacaccgagggaagaggccggagggagaucgcggaggggagggggcgggaggggggugggguauccugagucguccgugguccggagucuggaaggcccuagagcggcgccagucgacccgccucgccacaacuugcccagaccagacacguuucauccugcgcccugcaagaaggagccggccugccucucuccgcuuugcugcuccucggccuccgcgggcccggcccgcgucagcagcgacccuggggucuggguccccugugucgcccccgcccgccugcagcgcccggcacccgcccaggagcgcgcagcuggggugagccgagaccggggaugcgccaggcgcccacaggagguggcugacggggcaucccgauacccgcgaagccggcccuccugccucuccaggcugcgagccgagccucugcagauccagcuggaguagccgccgcugcccccacugccuguuugccuuccaaggaagggcgccgagguuccccuggaacccgcgucucucggcuuuugucugcugguucggcugcccggcggugccaugcgccugggacuugaggcgccgcgcaaggcugggggcccugcccgggaugggggagggagggaacgggaaagcaugcccccuucuuuccuguuccggccaucuugugaccgagauccacgcaaggggaaagggguggucagcggcacgacgccccacgauggaguguggcggccaacggagauggguaccucgggcccgcaggccucugcgcccagaucucagcgggggcgcgcgggccacccccacguucagcucugaagcccuuggcccagaucauggguuaaucguucuaacaggccagaggcagcaaaaauaggagggauaaagggccaggagcugauguuuccuuaacuaagcgccuaagucauucgaucguucuucauucacguguccauucagcaaauucugaacgccuucuccgugccuguccucugcuagguucuagggacguauacuugagcaagagagaccacagcucuuguucccgcugauccugcagcccaguggauggaguccagaaucuacagaccugccaggucggugucuugaugcucuuaaacagauggaggaagcuaagucuuagagcugacaauuuguucuagaucagggagcaaguaagugacagaaucaaacuuugaaacuauuuaugucuuuagcacuuuuuaugccugguugcagggaauaaaggccaauuaacuuggacauaugguuuauuugaaaccauaugaagugcguguuuuauuuccuggauguuuuugcauggguuuauuucuaguuaacaauaucuugaaagugcuaaauauauuugauauuacaacuuugcuuccaguuacucugaauuguauuuuccuuucuucuguucacauauuuggauguuaggaaagaaaaaaaaauuccugaugucugguccaagcaggaauuccccgguggauuggggaaugucuggcuuuuccucagcuuauugaucucugugguaaccacuggaggcccccagaagacccauagaaaugagaggccugaggucuacaagucgcugcuagaaauauuuuagccucuccaaagcccagaaugcagccccgacccaaguuuguaagguaaauaccauggcccuguaaaacuuguugguaaagcugauggcuaaaaucccccuccaucuguuucuaccuucagcauuuugaguauguauccuuuuggaaagacaggugaaguauuacauauuuuggggaguucuuugguucguacuuuuaucaaaauguuauauuuaggcugcuaaccuacaaaggaagaaagacuccauuuaaaaagcaacuugggugucagaaaucuagaaagccugccaucaaauaugauuaacugcaaauuucauuuaaaaaacaacuuuauugagauauaauaaaaauguacccuuaacuuuaaggacacaauucggugaauuuggccaaguguauauugcuggguaaucaacaccacaaucaaaaugaaaaacauuucuguuaugccaaaagcuuccucaugcccuuuugcagcgagucccccucuaucacauuuaauuauauauauuuuauugcuuaauguuuucuaaaucguguguaaaagaugaggaugaauagauacuacuuuuuuuuucuuuuucuauuaaugauggaaugaauagauauuucuaauuucaaagccuaaggccagggcuacagugaauaaauaaccaggggauggcaguuaagaccaaagguucccagggauguggcuccccacgccugccuuagggacauggaguguccagccccaaacgccagggaggguggcgcccuggggagccgguacccaggagguacccucuucgggugaacggcuguguccacucgggcucguccaagaggucuucucuggucccgcaggguucugggugcacgcugacccugcgcgggcagacgcgcccuuugcuccagguccggaccugggcgcugcuauagcaacguccuggacgcccagaccuuaggccgccgccgccgcggaagcgaggaacccggccuucucccgcuccugagggcuguggcggcggcggcccgggaggcggcccaggcuggguaaagaccgcccggcuccuccuaugcaagcugaggcagcggauugguuuucaagcaugguaagaggcgggaggccggggcgcccccgacggggaugccgggcuggggagaaccggggcuuccccggacccccagcuccccagccugcccgccccccauccccgccucccgccgcgcucucuuugugccccccgcagcccuuccagaagcaugucuacuacccgcucgccagcggcccagaggggcccgacgucgcuguggccgccgccgccgcgggugcggccuccauggccugugcgccccccagcgcggcuucggggccccugcccuucuuccaguucaggccgcggcuggagaguguggacuggcggcggcugagcgccaucgacguggacaagguggcgggggcuguggacgugcugacgcugcaggagaacaucaugaacaucaccuucugcaagcuggaagacgagaagugcccacacugccagucggggguggacccggugcugcugaagcucauccgucuggcgcaguucaccaucgaguacuugcugcacucacaagaguuccucaccucgcagcugcacacccuggaggagcggcugcgccugagccacugcgacggcgagcagagcaagaagcugcucaccaagcaggcgggggagaucaagacgcucaaggaagagugcaaacgccggaagaagaugaucuccacccagcagcugaugaucgaggccaaagccaacuauuaccaggugggcagcugugugugagcacgauucauaauccaguaaacaacucaguucccauuugauaggccugucccguaucaccacucuuucuucuuaaagauuuauauuguauaucagaagacacaguauauuuaagcaaaaacagucauuuaaccaacaaaugucaugguucauuaccuucugcagacaaucaggggauuaauaauuaaacaacaaaugucgucuguggugcuuuauggaaguuaucuaaaugcugguuguugaaacacuuuccuccuccgaaucaaccucaacaugaaaaaaccauauacaaauugcuguugaagccaguccccaaacgaugcagaauguuuaaauuuguagggucuuuuucucauuuuuauaaauuuugaaauacuuucaaacugacagaaaaguugccaggagacuguaaggaauuuucaugcgcccuucacccagauucccccauuauuaacauuuuccacagucccucuauuucuguauacauauuauuauuacuuuugaaccauuucacagugaguugcagauccuaaauauuucgauguguauauuuucuaagaacaagaacauucacuuacauaacaguauuuaaagaauaaaauauuuuuaucuucuggucuuaaucuucuacuguuuuggguuagacauugaguccaagauaaauauugcaauuuuugaguauaacauaaaccaauguauuuuuuuuuuauugacuaguuggaggaagugcagaagguauaaacaaugauugagaaagauauugaaguaagcaacagauuaacaagauugaugucaugcccuuacuuucuaguccuuucggcugacuauggcuuaaaaggccucacuggauuuaggaauaguggagcugaugcaugaaugcuggagagaacugggugcagggcagagaaaauggugcaguuaauauugcucaggacugacccagcaggaguguugaguguucuuaagauaggggaacaguggccgggugcaguggcucacaccuguaaucccagcacuuugggaggccgaggcgggcggaucacgaggucaggagauugagacccgagaccauccuggcuaacauggugaaaccccgugucuacuaaaaauaccaaaauucgcugggcuugguggcaugugccuguagucccagcuacuugggaggcugaggcaggagaaucgcuuaaacccaggaggcggagguugcagugagccaagauagcgccacugcacuccagccuggcaacagagugagaaucuaucucaaaaaaaaaaaaauaaauaaaaauaaaaaagauaagggaacaauuaggaauauuauuagaaggacuuaguguuuggucuuggguagacaacccugagguauaaucuucaaaugacacugggcauugcuaauugcuuauuuguuuuauaaaugcugcuuaaaaauuaaauauuuacaaauagugcuaagaugguuuuuuucuugugcaacgaauauaauggauucuauuuaaacauuuuuaaagauuuauuauaguccagcuuuagcagccaucuagugaaauguuaaaaccucuaacauacagaaauuguauguuuauaaacuuuuuuuuccuuuuuugggguuacuauagaaauggcuguuauaagagaagauuuucuuucuuucucuuucucucucucucucuuuuuuuuuuuuuuuuugagauggagucucacucugucgcccaggcuggcgugcaggggugcggucuuggcucacugcagccuccuucucccgcguucaagcgauuuucccaccucagcuucuugaguagcugggacuacaggugugcaccaccaugcccagcuaauuuuuguauuuuuaguagagacgagguuucaccguguuggccaggcuggucucaaacuccugaccucaagugauccacccaccucagccucccaaaaugcugggauuacagacgugagccaccacaccuggccuaagagaagauuuucaaaugugaaugauaaguaaugauuaaaagguaaugacucaauuuaucaaaugagugacaccuacuacuuuuucagcuaccagaccuuggcaaguugcucaaccucccugugccucaguuucuacucugugaaaugggaauauuaauuguaccuaccauauagcaguuguuaauggggauugaaugacuuagugcauagacugugcuuagagcagugcuuggcauguaguuaguuauuguuuuagcuaauaccugggaaugagggaaaaacguuuuguggcaugacaaauacuaaagcugacuuacuacaaaaugugaacaaucauaugacugcuaucaugugaguuuuucuuucuuccccuauacagaaaauccaaagccuagacuccuuguucugacacaaugauuggguccaccgcauuaucaguuuuaccuuugagaaauuguggucucauucucauucucauaccacuucucuuugucucuacucccuuugcuuuaagaaaucauaagaacugaguagcugagacaaaaaaaaauuaaagaugccuguucuugaaggcuugaagacacagacagacagacacacacacgcacgcauccuaauggguuuuuucccccauggggugugcguguguguguguguguguguguguguuguguauaagggggguagugauggcaauguguaaggucuuuuuccucaauauuuuauuuaaaaaauuuaaaaugcagaaaaauuaaaacaacaauauagugaauacccauauaugggggauuuuaaaagaaaaaucucaucgauuuucaaauaaaaauuaguacugaaauauuauaaacauacaaaaaagugcauagacuaauguaagacauaccauauacccaccucuuagauuuaacucagguuaggcugggcgcaguggcucacaccuguaaucccagcacuuugggaggccaaggcaggcagaucaucugagaucaggaguucaagagaagccuggccaacaugguauaaccccaucucuacuaaaaauacaaaaauuagccaggugugguggcgcauaccuguaaucccagcuacuugggaggcugaagcaggagaaucacuuaaacccaggagguggagguugcaaugagcugggaucacgccauugcucuccauccugggugacaagagcaaaacuccaucucaaaaaaaaaaaaaaaaaaaaagauugaacucagguuagcauuuugcuauauuuccaagauagcaaaauguuuaaagaguuuuaaacaucuuagaaauaaauaauuuucccuuccucgauucucagagaaaaucuguuugacuauauccuuccuauuuauguuuaugaacauauaaaauauuuuuaugaacauauguauucauaagacaguguuuuuaaguuugaaaauuuucuauaaaugauauuauacuuauagaucuguacuaaucugccaaggcugccauaaaaauaacacagguuagaugguuuaaacaacagaaauguauuuucucacaguucuggaggcuggaaguugaagaucaaggugucaacagggaugguuccuggugaggccucucuuccuggcuuguaaacagccaccuucuugcuauguccucaucacauggccuuuucuguguuuggagagagagagagagagagagagagagagagagagagagagaucgcuaaugucucucucuuuuucuuuuuuuaaagugaaggggucuugcuaugugcccaggcuggccuuaaacuccuaggcucaaauauucuuuccgccucagccuugcaaguagcugggacuacaggugugagccacugugccacacuuacccuaucagauuaggccccccgccuuaugaucuuauuuaaccuuaauuaucucauuaaaggccucaucuccaaacacagucacaguuggagucagggcuucucucccaguuuggagaguuacacuauccagguugguaacauucacauucucuuacucagccauaaugucuuacuuguuuuuuucauugguuuuauauuuaugugcucauucaaaauccuuucaccucaacaucuccauucuugaguuucucauuuugaauuaucucuuaauucauaggauugucaaaaugauuugucuuacccagaaggcccaagagugcugcauuucuucaacucuaucaaguuugaaagacauauuggaugaagaauauucuuagucacacuuucccucugaacuuuuugaugugguuccuuugucuucuggcaguaaauguugcugugagaaguuugaggguggccuaaaguuuuuuucuugugagugacuugcuuuuucugccugcaugacugaagagucccuucuuucugcuugaagccuaguagcuuucuaggguaugucuugguguugaguguucuguaucaguuuucccuggaaccuggugaauucuuaaucugcagauucagcuuucacugcacuucagagaaacacucuuguauucagucuuuaaauuuuguuucauuuuuggcuucucuacuucugggaaaccaguuaccuuuaugcaguauugauuuuguccauuaguucuccguacucuuugguuucuuucucauugcuuuaauucuuuccuucuaaucuacauucacugugauaaauuaugucagccuuuccuuuagugagcaauucaguuuucaacagugucucuuuuauuccuugcuuucucuuuucuuuuuuucuauuuuuuuuuuuuuuuuugagucaaggucuuguuuugucacccuggccccgagugcaguggcgcaaucuugucucacugcaaccuccaccucccagguucaagcgauucuccggccucagccucccgaguagcugggaucacaggcaugugcuaccacaucuggcuaauuuuuguauuuuuaguagagacaggguuucgccaaguuggccaggcuggucucaaacuccugaccucaggugauccacccaccuuggccucccaaagugcugggauuacaggcgugagccacugcacccggcccuauuccuugcuuuuucuuauuuauuuguucugcaaugauguuucagaucuuuuuuuuuuuuuuguauuuuaucuuucuuuuuaaacucauucugguuuuuuaaaaaaucauaucauuuuuauagaauguaugcuacucuuauguucugugaugugaauagauugugaagaacaucuuuagauuccuuucuuaauuuauagauccccugcaguaagcuuuauuuuugcaugccauguuuuuccucccuuuuccucccucccucccucccuuccuuccuucuuccuaccuucccucuuuccuucccucuuucccucccuaccuccuuaccucccuaccuuuuuuuccccuccucccuuugacagggugguguguuugcauccucuccaucaucacugugcauuucucucaucuuacacuuacaugggcagcccugcugaagcauucuacuugcccugauagaguggccguauugcaguuugaaggcuggauggucucugucucuguuaggaacaguaucguuagaacaccuucuggcaacaugugaacucuggggugggguggggagagagggaggcauagcuuccucuuccuuuccuuucuccagugcuguacacagcccgagagccuauaugacuuacaucagagcuggugugaggggucccuaaaguucuauaggugaaccaaagcugucaugagcccgggagguugaagagaugcuuuagggauucucugagaugcaauaccaagaaauauaccagaauaugacugggcaccguggguuacaccuguaauuccagcacuuugggaggccaagguggguggaucauuugagguugagaguucgugcccagccuggccaacauggugaaacuccaucucuacuaaaaauacaaaaauuagcugggagugguggcgggcaccuguaaucucagcuacucaggaggcuguggcaggagaaucgcuugaaccugggagguuaaagcugcagugagccaugauuacgccacuguacuccagccugggugacagagggagacacuuaaaaaaaaaaaaaaaaaaaaggaaauaugcagaauguuaguuuuagaaaccaaagccugaagucuggaugcaguuacacugauuaagaguaaggcagcauggugaacaaaagaacauguucagugacacaaugggcaugaaaagagcaaaauccaaauggagggaaacucugcaggacaagcuucagccccuucagcaaaaggauagcaaggaaaaaaaagagguggaggggaaaccuauagacuaaaagaguguuaagagacauaaccaucaguuacaggauagggauagggucuuauuuggauccaguuauuaauaauuauuccaaaacaaaccgaauguuuuuucuaagacaauaugugaaauauuagggaaaaauaaucaaauuaauaaaaauuaaaaauuauccaaauaguugaauauuuguuuuuuaaaaaggauuuaauuuuuauauuuuauaagguggaauaaugguauuaugauuuguguuaaaguccugucuuccuuuuagagauacauucugaaauauuuacaaaugaaauauauaauauccaggauuuacuucagaguaauccaggggugaguauauagauggaacaaaugggauuuuugcuuaaaauuucaaucaguguaaaaguagaaaaacagagguauacguggaauugacuucuuuuuucucagaaaauuuauuuuaauagguuauacuuccaagcuuuuguucauucauauauuaagccuguguucuggggagaaagcuagaggcccugcccucagaaaucuauauucuaaaaccuggagggacugggcuagagacaauaaacaagugaaguacacaaacgugaaaauauuagccagugagauguaugaggaugaaaagaagacuacgugaugugacagagacugugacaggcaggaggaucuugaggauuuuguugaggacaugcugucauccucagcguggaagaugcuugaugaaugacaucuugaaugucaggagaaggugccagccaugggaggagggucuggauaagaucaggcaggggcaacaaugaaugcaaagccucugagauuggcauggcugcaggacagaaagaaggcugguguggcuggaguggcaggggcagguuguuguugauagaguggaagcugucagucuaacaagagcagcaucaggggcuccagaaagcagcagaagggcuccuuuaacugucaagagguaguuuucacugccuugucuucaguuugggaggaaugcccugguuuuauuuuuauuuauuuacuuauauuuuuacuuuuuguagagaugggcucucgccauguugcccaggcuggucucgaacuccuggcucaagugaccccccaacugccuucggccucgugcugggauuacaggcaugagccacugcacccagccugguuucaugucucgucuauuagucaugcuuucaguaucucuugcuaggaugguaucguucagcgagaaagcgcccaagagguagugcuucagguaccugaauuuuuuuuuuuuuuuuuuuuuuuugagauggagucucgcucuguuguccaggcuggagugcaguggugcaaucucagcucacugcagcaucugcuuccuggguucaagugauucucuucccucagucucccuaguagcugggacuacaggcacaugccacuauaccuaauuuuguauuuuuuuguggagaugggguuucaucauguuggccaggcuggucucaaacuucuaaccuugggugaucugccuaccuugaccuccuaaagugcugggauuacaggcgugagccacagugccuggccagguaccugaauuuuaauugcaauuaagugggacgacagucguuacagacacuuggauuuguugcucucuccuuuucagugccauuuuugugacaaggccuuuaugaaccaagcuuuucuacaaagucacauucaacgccgccacacugaagaaaauucucauuuuggugaguaaugaguucuguuugaaagcucuuuucuuccugcucccuuuuucuuuuggcaaugagacuugguccagugcauuucccaguccucuuaaaagaagcaucacggucccugucaauucaguaaguaaauauggagcccucaggaggugcauacagugcaccaggugcuggagauacagccacaagcugaacggagaagccccacucucucucgaguuuuacauucuaaaggggguugaggagacacauuuaaacagauaaaugaguaauuaaacagacaaaugaguaauucuucucaaaugguggcaaaugcgaugaagaucauagcgcaggacaaugggguagagagugacuccagguggggugaaagucucagaaaagugugucacaggccaaggaacacugacuguaagggacgugaggugugcugggaugauguguuugaggaacagaagggcugguggaauggaauagaauaggugaggugaugguguguggugaggcugaagugcugggggccugaucacaggaagccgugaaggcgugggcuggaauguggaguuuuuauaugcguaagguggagccacuggaggauuuuagguaggggaagggcaugaucuaauuaauguguaccuuagcaugacccuucuagcuguggauagagacuacuguuggggcgacaguggaagcaguggaugagugaggggaggaggcugcaaucgcagccgaggugagagagacgggggccuggaccagcuuuguccccaggcaggugggcaggugaaguuguaacagauaaguuguggacccagaagcuacagaggacccuggguuucuguccuccauguuugggugaauggugaugcuuucugugauggagggccagggucgggaggcaauuucaaggaggaagagggcugagaguuuguacuugccaugggugcguuuacaucacaugugcaacagacaugcagguggggguacugaagggcugcagcuuaagguggagacccaggcuggagauuuaaaucugggaaucacuggaguagagcuggucuggcugaggucaccuagauagagaauagaaagugaugaggucagccccaaggucuucccaaugcuaggagcucagaaagagcagcagcagagagugaggaauagucucuagcaaagcuggagggaaaccuggggaguguguugucauggaaaccaagggaaaaguauuucacagaggaggcaguggucagucauaucaaaugccgcugagguacagaguaagaugaagacugacaauggacggcuguugucaagacgguuguuggugaccuuggcacagcagcuucaguagacagauggggacaaaagucugauuccccugagcugagcugaguaucaugagggagugguccuacuguauccagacauugguuucaauaacacuuauugggaaggaaagcagagacaugaggcuucaucuggacagaaaugugagacccagggacaacuuuguuucauuugaugugggagauacuaagauguguuugggugugcaccaccgacaauauagaugguaugcaaaaugaagacgcaagagaggggaggggacucugaggcuuaccaaggagccagguuuucugccauugaaguauucucaaaagcaaagaauguaagggcucuuucuccaugggcagaucaaagcuuccugcagauugccacaguaacccacagaaauucuuauuuuuaucguuuuuuguuuuuuuuuuugagauggaaucucccccuguggcccaagcuggagugcaguggugccaucuuggcucacugcaaccuccuucuccuggguucaagugauuccguugcuucagccucccaaguagcugggacuacgggcacucacuaccacaccuggcuaguuuuuguauuucuuuuuuuucuuaguagggauugggguuuugcuguguugcccaggcuggucucgaacuccuggccucaaguaauucaucccccuuggacuaccaaagggcuaggaauacaggcgugagccacugugcccgaccucauucugaucuuaaauguucucaguaucuagacguggguacuuggcuuauauacucaguaccugcauuucccuccaguuugggccagguuguuuccauucuugcccauuucaguuaaauagauuacuuaggaaauagcuaagcuucguagaaacaaaaauaacagcauaauaaucucauuaauaagucuugaaucacugauaaaauuuagcaauauuuuggaaagaugaaauauuuuaauuaaucuaccauucuucagcgugaaacugaccuucuuucucuucuguuucaguaucuuauucuaacucauacucguuucagagaggguuucagacucugaaacgaguauuauuucuucaggucaucuuugagauucugacuuucuacuuugguuuccauaccuuucaugucuacacucacagacacauguacauccauucagucauguguacaucugcauguaaguacauguacauaaguauucuuccuuucacuuguugcuuccuuuuacaacuuuucaguaccucacuucuaccccaguugauagacuauggcccaaguuugcauuuugaaugccccccaaguccucugcuuguauuagcacugaugggguccucagaagaguucagcgggcaccuaaaggauggugaccacagagauuucaguaugguggugccugcagaggaagcuguugcuugccuucugugauugagacaggcaccucuaagaaaagcccagagugccacugggucaaagcacccuguauuauuccuuguuaccauuauugcucccugaagagggcucucauguaucuauguaggauaauccaaccucaacacagcggcugaaagaaucugcuaaaaaauaauucagugccccaaaauacacugggcuccaaauaaacuaaagagcaaaaauuggcucauguggcaugaaacaaguaaucguaucccaaguaagaggacaguuuccuucguguuaucaacaggacuguaccccauaaguuuccagguacauuugguaagagaugguguuuuaacacgauuuucuguugcaacagaguaucagaaaaaugcacagauugagaagcuccggagugagaucgucguauugaaggaagagcugcagcucaccaggucugagcuagaggcugcacaccaugccagugcagucagauucuccaagguaccaggcagaauucugugguauuuuaauuacaauuaacuguauguaauucaauuaugccauggacucuaauaaacagaggacacuuaagaguuugugaauuugacaagaugauugcauuuuuuauugccaaucuacucuuuaguaucuuacuacaaagcacaucacuggaaauauauuucucuauuuuuugaaagccuuuuagaaaauugggguggaauucauauaacacacaauuaacuuucuaaaauuuugcuuagaacagaagucugacacuucucauucucacugggcuaaagucaaggugucaggaggaccaugugccuugguagaggcuauagaacagaauauuucuugcuuauuugguugcuggcagaguucaguuccuggcagguguagaccagaggucuacacuuucuuccaggcuguccauugagggagggcugcuccuaauuuccuugugaggcuccccauacuccugggcuccugacccucuuccuccauacucaaagccaccaacagaggguugagucucccucaugcuuccgaucuguuuccuuuuuucuuuuuucucaucuaugugacccuugugucagcccauugggugcuuggaaugacuuguucagagauacucggggugaugaagggcccaagaggaaagaggcccaugauucauugaguucugacuucugugggucacuguggguacaccguggguaccacguaugccauuguuuauccaacagaggguugaccuugguguaccuaauggagagaguaaggccaucaaagagcauuuauuuccuugugacuguuggagugacagugugcuuggcucuuccuuguuucccccauggggacagcaagugugacuuucuagggauaacagcagucauuucacagaaucauugacagaggcuucugucuuccacaugggcucacucuuucucuuucuuuuuaaauuguaauauaccuauaauguaaaauuuaugauuuuaacuauuuuuaaguguacaguucgguaguguugaguauauucacauuguuauacagccaaucuccagaacuguuuuguauugaaaaacugaaacucuacccauuaaacagugcuccacuccccccuccuuccagcuacuuucccucucugugauuuugccugcucuagauaccucauaugaauggaagcauagaguauuugucuuuuugucaucauuggcuuauuuuacucagcauaauguccucaaaguuuaucuauguuguagugugugccagaauuuccuuccuuuuucaggcugaaugauaguucaugguauauguauguauaccacauuuugcuuauucaucuguuauuggacacuuggguugcuuccacuucuuaacuauuaugacugaugcugcuaugaacaaggguauaccaacaucucuuuuagacagucauuuuacaguguacaauccaguagcguuuaguguauucacaauauugugcaacuaccaucucucuaguuucaaaacuuucaacaccccagaaaaauaacccauacccauuaaauaaucacuccuacuacccucaucuccugguaaccacgaaucuuuuuaugucuaugaauuuuccuauucaguauauaucuuuuaaaaaaaaauauguacaccacgugugguggcucacaacuguaaucccaguauuuugggaggccaagaugggaggauugcucgagcccaggaguucaagaccagucugcgcaacauggugagacccugucucuacaaaaaauuaaaaaauuagcuaagugugguggcaugcgcuuguggucccagcuacucaggaggcugaggagggaggaagauggcuugaguccaggaggucaaggcugcagugagcuguguucacaccgcugcaccccauuuggcuacagaaugagaccccaucugaaaaaaaaaaaguaaugugugaccuuuugugucuggcuuuuuucacuuagcaugauguucuugagguucaucuaaguuguaacauguaucaguacuuugucggucuugcuaauauuccauuguauguagguaugcauagacaauuuguuuauccagucauccauugaaugacauuugauucauuuucaccuuuuggcucuaaugaauaaugcuacuauaaacauucauguggcaguuucuauguggacauauguuuucauuuuucuugauuauauacuuaggaauggaauugcugagucauaugguaauuuuauguuuaacuuucucaggaaccaccaaacugucuuccacaguagcuguaccauuuuacauuuucaccaguaauguucuuauuucuccacauccucaccaauacuuguuauacuuuucuguuuucuuaauuaaagccauccuauugggugggugggaagugguaucucaucggaguuugauuuguauuuccuuaacaaccaaugauauugaacaucucuucauguuuauuuuccauuuguauauaucuuaguuggagaaaugucuauucaaauccuuugcccauuuuuuaauuggguuguuugccuuuuucuuguugagcuguaugaguuauuuauauacacuaauaguuucaucacuuuagcucuauuaggucauuggucuauuuugaguuaauuuuugcauguagauugagagaggggcccaacuuuauacuuuugcaugugguuuauccaguugucccagugccaauuuuucaagagacuauucuuuuuucauugaauguuccuaacauccuuguugaagaucaguugaccauagauguuuggguuuaucucuggauucucaauuccauuccccuagucuguaugucugucuuuaugccaauaucacacaacuuugauuacuguagcuuuguaguaggcuuugaaauagauaagugugcaucuuccaacuuuguuuuucuuuuucaauauuguuuugguuauuuguggccucuuacaguugcauaugaaauugaggauuggcuuuuccauuucugcaaagaagguuauuggaaugggauuacauugaaucucuugauugcuuaggagaguauugccauuuuaaccauauuaaaucuaccaauccaugaacaugggaugucuuuccauuuauuuaaguguucuucaauuuuuacaacaaaaauuuucaguguacaagucuuuuucaccuuuuagguuacauuuauuucuagguauuuuauucuuugggaugcuauuauaaauggaauuguuuucuuaauuucuuucuuggauuguucauugcugguauauagaaauauagcugcuuuuugcauguugaccuuguacugugcaacuuugcugaauuuguuuauuacuuuagucguuucuuauggauucuauguuauuuuuuuaaaauaguugguagaauucaccaguaaagccaucuggucugggacuuuuccuuuuuaggagguuguugauuacuaacucuaucccuuuauuuauugaaagucuauugaaauuuccuuuguauugggucagucuggucauuuguguaggaauuugucuauuucaccuagauuauccaauuuguugcuguacaauuguucauuauauucucuuacaauccuuuuaauuucuccaagauugguagucauguccucacuuucauuucuuauuugggguggcugaagguuugucaguuuuguugaucuuuguaaagaaccaaauuuuggcuucaucuauucucucuguugcuuuccuguucuuugcuuuaucuuugcucuaauuuucauaauuuuuuucuuucugcugccuuugaguuugguuuguucaucuuuuucuagcuagguuauuuauuuaagauuuuucuucuucuucuauauuuguuuuuuggagauagacucucucucuguugcccaggcuggagugcaguggcacaaucacagcucacugcagccuugaccucccagguccaagugguccucccaccucagccuccuaaguagcugggauuacaggcacguaccaccauaccuggcuaauuuuuuuuuuuuuuuaauuuuugguagagaugaggucucacaauguuucccaggauggucucaaacuccugagaucaagugaucguuccaccguggccucccaaacuguugggacuacaggcauagccaucacaccuggaccuuucuucuuuuuaaauguaggcucuuacagcuguaaauuuauuucugagcacugauuuggcugcaucucaugaaucuugguauguuguguuuucauuuucauuaaccucacaguaucuuccaauuucccuagugaguuuuuccuuaacccauugguuguuuaagagcacguuguuuacuuuccacguauuugcuacuuuuccaguucccuucuguuacugauuucuggcuuaauucuauugugaucagagaagaaucuuugcaugauuuugaucuuuuuaaaucugagaaacacuuuauggacuuaaaaaaaggucuuccugguaaauauuccaugugcacuugagaagaauguauauucugcuauuguuggguacagaguucuguauauguguguuagggcuaguuggcauauagugucguucaaguucucaauuuagauuuuaaaaacccugaaggucauugagaaaucaagugcugaccuugaauuuagcuccuguaaaucugaauuuguauuuucugggggugggaugaaguuacacuauccaaauuguuauggugccaacaaauguucuuuuauugcucaauauauguuuucuuuaaaguauauuuacauuuuauauauuauggcaugacuuuuauacaaguucauagaacacaaaaagcuggaggcuuugggcgucuguguugguauuuuaagggauguaaggacaagaggauucugugugcugccuuuaguuuagaaaaaucauugugcacagaccugccaugauaggaaauguuguuacaagccucacugaaauaagcaauacuagcuaacauuuuugaagugaugcuaugaacuuuuauuuuaaauauugcuuauuuucuucagaccagaacuuuuaaagauguguauuaaaauaauuucaggaauaugaaaugcagaaaacaaaagaggaagacuuuuugaaguuauuugacagguggaaagaagaagaaaaggagaaacuaguugaugaaauggaaaaagucaaggagauguuuaugaaggaauuuaaagaauuaacuucgaagaauucagcauuagaauauguaaguauuaaaccuagaaguucuuaugguauugauugccuugagaggugguguuaggauggcauuaaggccaggggauccagcaguuacuuuauguuacccucgugcagacauucuucucccugagagucuugagggaggcauagaggagacagagugagucagagauguuuugcugagaaugggagcuuuggccuuaaacuucagugcagaacacucguggugagauauagaagacccucuucuaugauggucccucuuuucuuaucugguuagguuagccuugaacuguaaacuccucccugaguuuuggaacuuuccauuguccagugggaagggaaagaagcagacccagaaaggcuaagaaccuuugccaggcucccuccucaacccaggcccagguggggucucuaaagcaagcaaguuauggcuaagugagccccucucccuugugggaacagcccugguccauacagccccagccucaugcauagaugauaccugagcugcuucuuuagaaagcagccaaucaaucaguguccuucuaagaauucuaagcucccugguuagacuugaccugagucuucuuuggggaaaacggagaaaggaagggagcugagcgaagguccuugagcucccucuaggggccaacaaguuuuauaaacgaaaauagagauuuuuggaauucaccugagggcuuuccuaaaacucuuuaaacucuagcgugagauuuggcgaauggcccaugaaccaaguccagcauaccaccuguuuuugaauggccucugacauaagaauaguuuuuacauuuuuacuuuuuauuuuuuucaagacagagucucucucuguugcccagucuggaguguaguggcacaaucucagcucacugcaaccucugccuccuggguucaagugauucucgugcuucagccuccugaguagcuggcguuacaggcacaugccaccacacccagcuaauuuuuguauuuuuaguagagacgguuucaccauguuggccaggauggugucgaacuccuggccucaagugauccucccacuugggccucccaaagugcugggauuacauuugugggccacugugcccagccaguuuuuaaauuuuuaaaacauuggaaaaaaagaagacuauuuugugacacaggaaaauuucauuaaaguucacauuucagugucaugagugaaguuuuauugaaacacagccauguuugguaauuuacgcucugucuguggcauuuuugugugggagcaguagaguugaauguuuugucugagacuuuguguuacgaaucugcaugacuuauaacuguugcuauugaccuuggcuaccuggcugugguaguguuugucagguuucuccacugaagauuuucucuuuuuuccuccuuucccugcuguccuuucugaaaugaagucacuaugagcagccuacacugaggagaggagacgugcgcucccccauacuuuuguuuuugaaguuaauguguuaccuucugugguuuucugaggguuuuugccaugaguaacauugggaauaauaugaaaagaaaaggguaaaauuaaaaacguuauguccccaguggauuuacugauguggucccuggacaguguuggccucucacuaaacuagcuuaagaaccaggugcauucaguucuucuguuucugguaccuauuaagugcccauaaaaaauuuuaagccccagcugggccugguggcucacaccuguaaucccagcacuuugggaggcugagguaggcagauuguugugugagcccaggaguuugagaccagccugggcaacauggcaaaacccugucucuacaaaaaaaauacaaaaauuaucugggugugguggugcacgccuguagucccagcuaccuaggaggcugagguggaaggauugcuugaacccaggggguugaggcugcagugagccaugaucauaucacugcacucuagccugggcaacagaaugagacccugucuccaaaaaaaaaaaaaaaauuagacucguuuaagauuagaaaguuagauuuuccuuccccuuuuuucacccuguacauauucugauaggaagaccagcaagcaguagaaacaaaccaguaaaaccacagggaagcagaagcaggagaagcguccaagagcguccaggagcguccaagagggcagucagauuuaaaacacagcuaugugcucccugauuuuauucucuguuuccaucuuaugaaagucuaacuguaguacugagcuugaauuuuaucuuauagcaacugucagaaauccagaaguccaauaugcagaucaaguccaacauaggcacauuaaaagaugcacacgaguuuaaagaagaccguucuccauauccccaggauuuccauaaugucaugcagcuucuugauagucagguacgugcaagugggugacagcugcaguggaugccuuccuuuuucuuagugaaguaauuuacagugagugucaucugcagaaaaaguguuugucuuuuuuaguaacccugaaggugacuagcuguuauuuuucuccuacagcaugccuaaaucauaagagguguuuguuacaugcuugcuguuggcaaauagcauacacaacaguuggcagaacuguuuuguuucuucucuccauaaagucaauuugaauugguuaguauaaccuagcuauucauuuuucaucuuucagauguagcucucaauuucaaaagguguagaagggcauauugaagcaccagauuuaauuuuagaguuuaaauauacugcuaacuguauuuuuaguagaaacgggguuucaccauauuggccaggcugaucuugaacuccugaccucaggugauccgcccaccucggcucaauuaacugggcgugguagcagaugccuguaaucccagcuucucggagggcugaggcaggagaauugcuugaacccaagaggcagagguugcagugagcugagaucacgccauugcacuccagucugggcaacaagagugauacucagucucaaaaaauaaauaaauaaauacacacacacacacacacacacacacacacacacacacacacacacacacugcuaacuggucagcugaugaucuguuacauuuaucaaacauaaucacuuucauuuggaagugacagcgguuuaggggaacaauuuuuuuaaacuaggaagcaaauagagaugagagcuuaugaauucaggauucuuuuuuaaaagccugggucauucuaaaaaagguaaguagacuuuggaaacagggaccacugcuucuugcuucagugcucacauguuuccucccugacccaaaucuaccugcuccacugcagucaggcugaccaugucccuguccugucugaaguccuucagugacccuuauuccggacuuccuaccagcacgcaggguccuucggauucugggcccugggccaucuuucucuguucuuugcuuuccuggcacuccagcggcccagcagcccaugccucucagaacaugcccuucugucuuuuuccucgguucuggcugcuuuccugccuguccugcagcucccaguuuucgggaccugucuuuuacucauucuuuaguauucagccaggggggcagguaccgcuuucagaaaguucuccugagccucuaggcuauagcauuucuguagucccuaagugggaucugaugacauacacauuauauguggauucuccauggcugugucuacucgccucccgugcagagcagggccugucuuuuuaucuucuuuuagccugccaguggccauccagugaggugccugguauaugguaggaaaccaggagcuguguccugaacugaacuguugacaguugcuuccagcaggcuguagacuacagcuggucgcucaugaacugaaggauguggcucuaaaauccuaaggucccaccuaaauuucuucuguuucuguccugugaguuguguugucaguucagaacccauggccucagaaaccuugguguuuccuuuuggccucuuagguuggcaaacuagcaccuccuuuugcaaauaaaguguuacuggcuaugucccaguaacauuuuaugagugcuaguucauuuacaucuuauccauggcuguugucccaauacaguuguggaaugacacagcuguauuguguuguguugugaccaaguugucuggcccccagagccuaugauauuuacuguuagcuccuuacuaaaaaauuuuuccugaccccugccuuaugguaaaagauuaaaaccagaugcaaauguauuuaagcauuuuugacuguguauauucuaaaaaauaccagcuguauuagucuguucuaauacuacuguaaagaauuaccuaagacuggguaauuuauaaagaaaagagguuuaauugacucacaguuccauaggcuguacaggaggcauggcuggagaggccucaggaaacuuauaaucauuggcagaaggacaaaggggaaccaagcacgucuuaagaugauggagcaggaaagagugaagagggaagugcuacacacuucuaaacaaccagaucuugugagaacucacuaucaugagaacagcaagggggaaguccacccccaugauucaaucaucucccaccaggcccuuccuucaacacaugagauuugaguggggaccgagagccaaacuguuucacuagcuaaaauuuuaccagauagauaguuggguuucauagguauucacuaaaaaggaagcucccauauugcauagaucucauuguuacaguuguacauaaauuauucuuuuauucuuuuguaggaaagcaaauggacagcucgaguucaagcuauucaucaagaacacaagaaagagaagggucggguaagguuaagaaaccaguggccuaaagugggccauuuuuuaaagaaauauuugcuuuccuuuuuaauaaacauaauauuuguccacuuaauaacauuuggggagaaauguguagcaaaauuaaaauuaccuauaauucuaacaccaaaauaaccacugcuacuacuuucuuauaauuuguuuucuuuuuuuuuuuucucaugaaacuuuuuuaaugggucucaaaauucugugacaaauuuuuggucaaguuguucccauuaaaaaguacugauuuuaaaaacuaauaacuuaaaacugccacacacaaaaaagaaaaccaaagugguccacaaaacauucuccuuuccuucugaagguuuuacgaugcauugguaucauuaaccagucuuuuacuacuaaacuuaaauggccaauugaaacaagcaguucugagaccauucuuccaccacugauuaagaguagguuggcagguauuagggauaauauucauuuagccuucagagcuuucugggcagacuuggugaccuugccagcuccagcagccuucuuguccacugcuucaguuuucuuguaugcauuucuguaaguguagaaccucauauauacauaguuuuacaacauucgaauuauguuuuguagguuuguacacuuuucacuuuauauaucauagaccuuuccuaaguuuuaaaguauucuucaaaaucaugacuuuuaaugacuuucaugaugaucuuauuggauguaucauaagugacuuaaucauuucuucauugucaaauacauguuucugauuuuuuuguaucacagaacugcaauguaaguaauuuuuuaaaaaggcaagaacuguuuacauuaaaaucgcuuuaaugaaaacaaacuuuaauuaugacacugauucucuuucaccugaguacaucagaaauuuaaguguuaaaauguguuuacacuagugcaaaacaucuaaaguagauguauuugagaaggucuuaaaauaggaaaacuucuguuuauuuuuucacuugaaauuguguuuuguaccuuaguauuucuuguaaaucuuuucugaauggaaaaaauguuuccucuuuugcacauuuucuaauauuaccuuucuuaguagaauauuaaacgacaaaagaucauauaauauguauguguauaauugcaaggaugaaguguguucagaugaucaaaaaauuuaucagcuuauauuucuccaaaguggaacaaauacugaggaagacggggagagaaaaagaaacugggaacaauacuagagccaaacuaaagcaaacaaaaaauaaaaauauuucacaaaacaccugcaguucuugaggaacuucgaugggaaaguuagauauuaaucuaccuuuaagauuguaucauugcuagaaaaggaaguaggaagcacuauuuuuccucuauuccauuuaaaauaucauuucaucaugcaaauacuuuauagugauaauacacagacauacacccaauacacauaucuauagauauacacauauacaguaguuuauauugaaaauuguaucacugauguggcaguucaauuuaggagauauuuacugagcaucugcuauguacuacacuuuauaaggcuaaaaagagauguggaacaaugccugcccucagaccgcuuacaguacagaagggaguaggagugaggcuacagcuaugggaaucaggaugggauaaaugcagagugcccuagggacugaacagagagaguuucuugaagugggauuagggcuguguguggaucaugcccauguuuacaucuucagccuaaacaacucuucugaguuccagaucagguagccagcucaguacucgacaucuccaugggcuucucaagugcgacaugccuaagaugaaguucuuggguuuguuccccagacuuggcaaauggcacccucguuccuccagaugcucaucuugauuccaccuuucucucucaauccccgaguccaggcugucugcagggcccacucuauggaaccaguucuucuguacuuuccuguugcccugcauuaacuaagccuccauuucugaaugggccccagggugggucuccucaauuccagccuuccccuuccuuagucugcucuccacagagccagcaaaauaaccuggcugcuggccgccauucuagccucagccugacccccccgccccacccccugccuuucggaaccuccucuuuccagcuaugaugacuuucugcuaauuucuagaacauucuggccuuuuccucuuuuauaccugguuuucauuguuggcaagcccuucgacuugcucuucacauggcuaccuccuuccccucaguaugaguuuucuauucuguguagcaaaugaccacaaauugagugggugaagauggcauguauuucucuucucaauguccgugggauaggaguccaggcagggcuuggcugggcucagggacucacaggcugcauugagagugucaucugggcuguguuccugucugagguuccuugugguuauuugaagggcugagacuaucagguuccagaggcuacuccuucuccauagcagugcacagcauggcuguugacuucaaggccagcuagagugugucucucuugcuuucauucucccgcuucaggaagggccugggacuucuuauuucuuuuuuuuuuggggugagacagagucucacucuguugcacgggcuggagugcagugaugccaucuuggcucacugcaaccuccgcuuccuggguucaagcgauucuccugccuuagccucccgaguagcugggauuacgugccaccaugcugagcuaauuuuuguauucuuaguagagaugggguuucacuguguuggccuggcuggucuugaacuccugaccucaggugaucuacccgccucggccucccaaagugcaaggauuacaggcgugagccaccaugccuggccuggaacuucuuucagggggcucaccugaauaagacaggcccacacaggauaaucuuccuuuucauaaccucaaaguccacagauuugggacugcuauugcgucuccagagucccuucaccuuugccguauucugugguugagaagcacaauggagguucuccucagaccaagggacagcaucacacaggggguguacaccagggguacaaccuugagggcccccugagaacccugccuaccccauugccucuggccucuggguccuggucaccugaugucacucuauccaaguagguagucccuuuucuuuauuauucccauaauaucucaaacagaguucugagcacuauuuuaaauaguuuacuugcuuauuuguuuccuuguuuauugucuaucucuccaaucacgucauuggcccucugagugaagggcucugucuauuuagcucuccauugucugcccagcauccacucaugugucugaaaugugguuggcacucacuacacacuugcagaaugaauguggaagguagcuagcuagggcaucauucagccuuguuuucauagauggagaaaggcugauuguaggguucagaagagcaggguuaccagaguugucuggaggucuaagcaccaucugcuguagggaggacacuaguccacguuuccacccugcacccagggagcuucccccguggcaaugacuauguaguuaggacgauggcguucaccucccagcauauuuuaucuauggcagcuaagaugcaggaucccaggagcaguggaugguaguuucucugcaccacagguggcuccacugugcaaggaguguucuccuuugucccccuacauuacacugaagcaaaaguggccuguucuuacaguucauguccugguguccuggagcugacucauaucggcucucagcugugcacauuucuccucaucaggguguuuuuuuugaaagcugauuuaaccagcacaacuuugguuucaugggaacauuuagaaauaaauggauauuuguaguugccauauacuuaagccuucuaagaguucugugaaguagaugcugucacucauuuuacaggugaggacacaggggcuuagacagaugcuguguugcccacggucacugguauuugaaugcaggcccuguguacuccagggcauacuacacugcuggccugucuagcuccaggcacucaccugugaagcucccagccgggaaggaaaacaggcagugacagcuucaagugguugcuuuucuguaaggacgcaggaucuuuucuuuggaugcucugacaugguaaucccuaaccagggaugcaccucagaauuaccugagacucuuuuccaaaguacagguggccagcuccacucccugagaucuugauuuaguagauaagucuggaacacauggauuuuggagauaaacaaaccaaaagccacccaggcuauccuguuuuggaucuaugguuugaaccacugcucuuagaucauuaaaaucccuacucuuauucuucaagccaucuuucuagcauugguauuuagggacagaauucagguuucuuuauuaaucgggggugggaaggcauuuuuaaaauccuggcuccuuuaaagcugucuguguuucagacaguugugggaauuucaguggccucuggcuggaauagaaagcgaguuacaguuuuuauacuuugucauugcgaguugugauagagagaaagacggacaguugucauggaggaagaaggugaggccuuuccugguucugaguggggcgcaugccucacauacuagguaugugggggcggauuugugccaccacuaggcugcacuccuuccucgucuguugguuugacuuguuuagaagcugcuuaccucucccuucuuugcucuuaaacccuaacagaggggugaauucaaucagguuuaguaaucucugccugagaccuaacuauuaauuauuccacaugauuggugccugcuguucccacaaugcacauauuguauuucucuguuuagggaaaguugcauuugccaacuuucuauugauuuacuuagauucuuggcaauuuuuuuuguuuuaaauaacauugguaggaguucacaggcagucacagauaagcgauggcaugcccuuuuuacccaacagaagacucuugagagcuugggagguugucagauggucacauaaugaaggaagggaggauggggugaugugggccaguagggaaaaaugcauagugcuugaaaugggaucacagaaaaugggcucaugagcugcaaacuucaaaauaauuucuggcuauguuugccuagacccucuccauuccuuucuccauguacucuuuuccgugccuuucugauucauucuuaacucuucuauuaagaaugauguuaucccuuagauauucccacaucuccuuucuuccuggggccuggagcaacuccccauguaguugaucaaggccgagauccuaaaccuccauccagcagccuggacauuuauacuggcuuuuccuucuauuuuccagcucagcauuucccagacugcuuuggaggccacuuuuccaggggccuguaaagauguagugaaagcucuugacaaugcccuccuugggggagguucuuaguauccacuaggaaaggaaagauucuuuuuagguuucacucggaaaaucuuucuagauugguuccacccaguguuuguccagccucauaggagcacagagcauuucagaggcaaggcugugcaggaugcuaagacacugcuuuuuuuuuuuuuuuuuuuuuugagacagggucuuacucugucaccggggcuacagugcaguggcuugagcauagcucacugcagcuccaaccuccuggggucaagcaacccucccaccucagccucccgaggaacuaggacuacaggcuaaccccaccacaccuagcuuaauuuuuaaaacuuuuuguagagacagggucuuacugcauugcccacgcugaacuccaacuccuggacuccagugauccucccuccucggccucccgaaagagcacugacuuugaaacuugcaugugaaaguuuaagucugggcucugcccaccuucggcugucucaauuagagccagugacuuuaccuuucuagacuugaguuuuccuaucuguacgauggggccaaaacauguguccauaacauugugguguggauucaacaaaaugaagugcaucuaguacacaaugaguguuaauuuucuaaaagcaagcaaaugaggaaaugcuggucuaggugcccuuauauacucaucucaggcacggacacuuccugcuccuuuauuugaucaggauacccugucaccacuuccaggacauagacuuggaauguucuucaccccaauuaugaagccuuuuuuuuuuuugagacggaaucucgcucugucacccaggcuggagugcaaagacaugaucuuggcucacugcagccucugccuccgggguucaaaaauucuccugccucagccuccugaguagaugggauuacaggcgcccgccaccacaccuagcugauuuuuguauuuuuauuagagaugggguuuugccauguuggccaggcuggucugaaacuccugaccucaagugaucugccugccucagccucccaaagugcugggauuacaugcacgagccaccacaccuggccucaagccgcccccccuuuguuucuuuuuagccuucuguguuuaaacaacuacugaaauugcuuuaagcgccuuuccuucaauuauugaaaacaaauucuucuugaauucuuuuuguccagucuaugaucuuccaugacauuaucucuaaagaugaauaugucugugugucucuguaucucuguccucugcaucucucccuuucuuucccucccucccucuuucccucuaauccccaccauucccccucuuuuucucgguaaacaucuaucaguaaacauuucucagagaaccugcugagggccagggauugugcuaguuucugggaauauaaaauaauuaagauggggcugggcacgguggcucauaccuguaaucccaacacuuugagaggccaaggcggguggaucgacugaguucaggacuucgagaccagccugguuaacauggugaaaccccgccucuacuaaaaauacaaaauuuagccagguaugguugugugggccuguaaucccagcuacucaggagacugaggcaggagaauugcuugaagccaggaggcagaggcugcagugagccgagauugcuccacugcacuccagccugggugacagagcgagacuccaugucaaaaaaaaacaacaacaaaaacauuaagaugugcucucuggccuaggauggcccaugugggcaucggaaggacaggacugcaggagaaauuuaguacuaagggucagagccacucugcaggagaagccugaauccuuuaucguugcucaucauguguuauuucguguuaugugcuguaguuggcuaagcugcucccauuaucaguguugucuauuuggggacgugagcucccuugggaacacagaugaagcaccuagagcagccagggccaggauauaccaugaucaaagauuuauucaacgacuugaugcgcacggauagcaucaggcuagcaaaacaggcagagcauguauaccugaaaucuggagaaugaagacauuugacaugcagcuuacagauggaugccuuucuuaacuuuuuuucagcuccugucacauauagagaaacuucgaaccucaaugauagaugaucuaaaugcaagcaauguuuucuauaagaaaaggauagaagagcuagggcagagacuccaggagcagaaugagcugauuauaacucagagacagcagguaugucuggcggcaguguggcaccgugcuucuuuaagcaacgcagucuaucuaagaacauguguuuuuacuuuagagcauuuguaagugguauaaggugaggaagauggaauauuuuuccccuugugauugcuuguaaaaguuagugcaauaaaauacauuuuuaaaagguauuuaaaaguaauauguugaagauuuauacaguuaaaguucaaaauuaauuugauuugaagguaaguaagaauuucuuucaguaauuacucugagaagcagccaaauacaaaugcaacuuuaaaaagauuuuuuguuauuuuauuuuagauucaagguguacauggacagguuuuuuacaugaauauauugugugauggugagguuuggguaauaacuucugccucuaugcuuuuaaagaccacaugcccuaugucccuggauaauuuagugaaaagguuaauuuacuaacaacauuaucuguccauuaucccaugugugugucccuaucuaauuucaaauguaucacuagaagacuguauuucuuugcagauuaaagacuuuaccuguaauccauuaaacaguaucagugaacccaaagguaaguggaugggaucccgguacuggcggcaaggggaaccuccccaauugcacugggcuucagaagaaugugggccccacuuguuuaugugugcuaagauggcauucuucuuguuguauugauuucguagaucuguccucuauuauuuuaauuugagagauuuguuaccacaacccagaaaggugaagaauuuaaaaaaucuaaacuaucauguaguuguuucauuuuuuuaaucagaguacuauuaggcacauaauaccugcuuaggagccauuuaccucuugacuuauacacuguaaaacagaguuaugcauguaaaagcacaaggucugucgacagacuggguucaacucccaucucuggcacuucauagcuuugugaaucucugccucaguuuccucagcuuuauagcaggaauacgaauaguguuucagucuauuuucucugcuauaauagcauaccacagacugguauuuauaaagaaacaagguuucuggaggcugggaaauccgagagcauggugcugacaucuggugagggucaaccuauggugcaaggcaucaccuggccagcuaaugcaugagacagagaaaggaaauugggucaaacgcaucuuuuuaaaucagaaacucacucucaauaacuaacccacuccugccacuguugccguguaauuguuacaauggcaguuaaauuucaacuugcauuucugaggggacauucaagucauagcaaauaguaacuauaucauaggcuuguuaugaggauuaaaugggauaauauaccuauuaagcccucauuaaguuugccauuauuauugauauuaagcucuuaguaggccaggcacaguugcucacauuuguaaugcccgcauuuugggaggccaaggcaggaagaucaccugaggccaggaguucgagacuagccugggcaacauagcgagucccccuucucuaaaaauaaaaaaugagcugugcauggcagcaggcaccuguagucacagcuacucaggaggcugggauggaagaaucacucgagcccagaaauucaaggcugcagugagcuaugauugcaccacugcacucaagccugggugacagagugagacccacaucucuuaaaaaaaaaaaaccaaaaaacucuuaauuauucuaaagugcuauaaaggcuugcugcguuauucucaacuguggcuguuuggggguuacagguuuguucuaaguuuaaugggaauaugcacaaccuacugacugcggcagugauagccugccugucuccauaucauucaagaacucucugucugucucugucucucucucucugucucucucucacacacacacacacacacacacacacacacacacacacacacacacacacacacacuaaaccagucaagaccagggcaagagcugacuuugcaaaagaaauaaaaaaagagaccagaagggagacugggagccauagguucagggucuuacuucugccuaguuuucuucccagugauuccaguccugguuccugcacgucucagguuguugaggaaucuuugucuauuugagagaugccaacuaggggugguacugggguguaugagcuggguuuccucccucuuguuuugagauaaagaguucgggaaagaggguuguuguucccuuuaacuccucuucaaauaacaagagcucagguuagggaggaauauuugcaaaauuaacuagauaucauaaauauuugacugaaaaguaauucuggggaaaauuuagcuucaaaaagauguauguuacacauauuuauucuccuggugaugugcuauauauugguacauuucauuuauguuuuuuaugggggcucaaauuaguauaagggcuacaaaaauuuaauccauagcuugugauguuuuuuguucauuuauuuuucugucauuucaggaaauccuuuagccuggcaggcuuuugaaucucagccagcugcuccagcugugccuaguaaguuccuauaauagaugcagggcuccaaagguaucuuuaaaaugcuaaaccaaaacauaacuuuuacuuacuauuuuuagaggcuuuucuuugaaaaccaauguauuuagagaucacauaaugauuuauuuugauucuuaguuuugaccuaguucuaaaacccaagacuacaaauauccacaugauguuguggugauuuugauuagcuauagcuauuauuucacaauuugucuaaaaagggaugacuaaaaauuccuuggcaucaccuuaguuuauacuuguagacuucucaaagugauacacuaugcgacugugugacuguguguggugucaccacacuuugaaacugcugacacuuuuacugcugcaggcuuugacagguggccugucuguccccacuuguggucagccuggccaucugcucuaucucccggagcugucaagauucugcaguaaaacaaaaggacauaaucuuuacaguugagaaacugagagaugguuguuuaaaaauacuagcuaaauagcugagauaguuuugcuuccauucaggaaggaguaagggcagguaccugugccaugugcacagggaucugacugugagaggaguaugggcugaggcugagcacagagagacagcaccacgcucaugggcccagggauugcgagagcacuguguagugaccaaaggacguucuugagcguguuuuggaauuuggcacuauuggcuggaaaaugcugaugguuuuaaccucucagucuucuuggaggcuucuugaagcugaagaaguuaagcaguaguuaaggagaggagaggaguuuaagugcccagaguaggguugagagaggaagagaugcugaacuuacaucuuaugaaaugaaggaaaaaaacacauuucagagaaggacagaaaggucaaguacuaaauuauucaaacaaacaaacaaucuucagcagcugaccaaacucaaauaucuaugcaggaaaaaaaaccaaaaaaaaaaaaaacccaagucuauauuuaguuagggugguuuucuccaaauggaguaugcaaaauuaucuauuggaaugugggaaaaaauuauuagagguucuuuuuauauauuaauaaaucucauccuuuuaauuuuuucauuuuuuguuuuaaaauguacacauuuguauuauaguauauauaaaauucauuuaaauaaauauguguauuucugggggaacuuuuacugauuggggaauguggucaaaaaaauauggaugccacuggcucuagaaaauuccaaaaauaauuuaaaaaaauaggcccauagccccauagguagcggucccuuccgagugaggcccuggcuugucccauuccucuucccagcauacaaaaggaucuaaaagccaagguucuaaugauggcagggaaguuuucaucacuuaaaagaaaacauacauucuaaaguuuaagaucagaaaguaaaucacaaggugaaagucagcuuaggagauaugcaauaaauaaaucagaccuauagccaguaaaaugaagauuuguaaugucuaauauaaagcagauauggucaaaccuguugauuccaccugucuauacccuuggugauuuagacacuagucagucauuuacugauuuacuacccuuucauaauaagggaaugaauucuguaguuuagagaaaagaccaaauugugaucaauuuuaauagcaucagaucuuuugauucuguaagcuggaaaaauaucuagaucaggaauaguuaguauucuguauuuuuuuuuuucuuguaaaaagucagacagugauuuacauuaggcuucacaggcuagaugaucuauuuugcaacuacucaccucugccauuguagugcaaaaucagccauagacaacacguaagugaaggagcuuggcuguauuccaauaaaaacaggcaguggacuggguaugucucaugggcuauaguuugccaaaacuugaucuagauuauacaaguugcaaauggguacaaaggcaguauuuccagaguuuguuagcaauuuacaaauaggaauugaacacuuucacuagaagccauugugaagauaaaaaaugcauaccuauagaaguagcugauggccggguaugguggcucaugccuguaauccuagcacuuugggagaccaaggcagguggaucacuugaggucaccaguuugagaccagccuagccaacauggugaaacccugucucuacuaaaaauacaaaaauuagcugagcauggugccgcaugccuguagucccaguuacucaggaggcugaggcaggagaguugcuugagcccaggaggcaaagguuguagugagcugagaucaugccacugcacuccacccugggcgacgggaguaaaacuguguuuuuuaaaaaaaaauaaaauaaaaaaguagcugagguuuguggccaguauuuuuuaggguaagauuagaauuaaaagucugucuugauaaaagaaagaagcgguaaacuaauagaccauacuguuuagugaaaacaaacuggauaaauaaauaguccagagaggacuuucagauaagaauugucaaauauuggaagaaggccguggaaucuaauuuucuguagaaauuuaaauuagagaggauugagucuuacuuaaguuagguaaaccucuuuccacaggcugugccuaaauuaauaccuucacauaaugucuuccagcccagugauuagaguacuuuuuaaaacugguuuauuuugcaugaauguucauugcagcauuauucauaacagcuaaacaguggaaacaacuuauauguccaucaccuaaugaaaagguaaauaaaauguggucaguuuauaacacagaauguuauuugcccauaaaaauacauacugauauuuauauacaugcuacagcauggaugaaccuugauaacacugugcuaagugagcaaaaccagacgcaagggaccacauacuguaugauugcauuuacuauaugaaaugucaagaauaggcaaauucauagagauggauaguagauuaauuguugucuggggauagggaaggggcagaaaugaggugugauggguauggggcauggguauuuugagggaggugaugaagcaaauguucgagaauuagacagugguuguguuugcacagcccugugaauaugcuaaaaacccacugaauuguauauuuuuaaaaggggaacauaucuccauaaagcuguuaugaauauaaguuuauguuaguuguguaauaucuuugucacuugaaauauuuguuccuuauggucuguauguaucuugacuaguuugcggcauauuuggcuaccaucauguucggaugcuuaugcuuuaauuauggaaccucugaguuuuuccuuuuuaugcuguuucagugaaugccccagcccugcacacuuuggaaacuaaaucaagucugccaauggugcaugguaaguuucaguaauagucucagcguuuuaugugcaguugccacccugaguuggauaacuuauuaaccaaaagugauuauguggagguaauuaauaauaaaacaggaaacauuuuagugauugcaaaacaguuauuaaaacugcagucuucauguguaauauuguuguaaacuggacauaccucccaaagucuuaaaguauaaaagguguauauagguauaaaagguugccagacucacaaguagagauuuuaacuuuggguagugucuugauuauuuaugauuuuuguggaaaguaguagguguuggguaagaaugagggugaccugcuaccagaccagccaaccagcacaugccacagggcguaugugguuguuuuuauaacuuucaauguggcagcaagucaccuuuucuaaacaaacaguuugaaugacugguugggaaaaucuagaaaagacaugugauggaaacuaaaggaaauagguaggaaccacugggugaaaucauuaccaggguucaguucuuggaccagaucaaaagggugauaauuguuauuaacaugauccaauagaugggcugaauauuuguagccguauuucacuuuuuauacaguuaaagugcuuacaguuuuuauaguauguucuuuaaugugauguuuuccugugcucuguuggauauuacaaaugaauuaagacgggagaagggccaucuuuuuccagucucacauacaguugcucuggaauccaaggauuauuucacucuuucauuuuuggucuuuuaaaaagauuacacuuaaauccaugaucuaacuggucaguaugguggcacuuuuugucuucauagauauugugaucuguauaccaugaacuuuaguaauaauccuuuuuacucaucacugacucuugaaguguuuauugcaccuuauuuuuuucccgaagaucauuucaggugggucaguugucuugaguaugugaucacaauacguaauguguaaauucuccacauauugaucuucuuauuuacaaguguucagagcaugcaguuuuuuccuuuagaccaguaacagauaaaagcacacuggacauaaauaaauuugcuuuaauauugaauauauaagaaaaguaucuagcaaucauucuguauucauauuauuuuaugucaggucuaaaaucucucuguugcgucccuuuguaaagcauugcuggccauuucucuuuuguacuucaacaguguauuuuaguuucuuuuacuuccccaccccuccacuuuguuauuguuagcuuucuguaugacaucacacaagguuccuaguuucuuugucauauauuuuuguugcuaacuaaaggacacccugguagguacauuaaagcugucugggguugauucaaggguccggacaaaucgaucauuucuaaagcauguguucauggggacccuacccucacuagcccagagcugcaugaaucagucaugcccccuuccuggcaucugcugggauugaaaugcuaguuuuaaaugccagccagaccuggcacagggccuacagcccuuggauggggaucaaagcuuauuugugagcaucucagugggcaggagcuaggaagagacuuggccagggcccgccaacgucccccaccccgucaggccagcuuccccagggcggcaggggcagggcagguuagucauggauugcguaauguuuauucgccuguucacucucuguccuuuguuccaucucgaagcuugaugagguucuuuaccaugaaaaaucucacaauuucuuaccauuguaggucggguccccugggaaacagacugaugcggaaguuuacaggugggaggugggggugcccuuggacagcaccugugagagaagcaggguugggcgaagggaacguugaaccuagacgcagccacaguggaggccucagccagcccugcuucagagcugcagagcugggaugagugcucuggcuuguccuccacugaggcaggggugggccauugccccuugcacugauuugucaucugaugggggcugccccaaagagagggugagcuaaagcagccuggaagggacuccacugugagcugcuaggagccaacauugccagcacguuuguccugggaggaucuagguaaaaugggaacccugauggcucccugcuuucaacucugcuacacaagcuaaacgguacaggcaguagguucugauccuaaggcaguugauaggaugaaacacggguucuggagaagauaaacaaucaugcuugauucccauccccaguaugcauuuuuuuucuggacaaaccucaaauaaauuuuuguaguauuuucaccacuggagaccacuuugcucuuugcucauggaguagugacuaaauggugguauuaggaugcccagaaaauaaaguauacuuuguugcuguuaaacugacccauacaccaauugcuuagguugccugggcugauaauguggcccacuuuuagagcgacgagugcagugaggaugcaaaauaaccgcuuuucccaaagucugugggcaccugcuagguucuaucuacauguaaagcccuccuuuaauuuggucuauaaauugugaggggcuuauguaugcaugacuuuaauuguauauagcuacagugaggaccacaaaaacuggaaacucuuuuuuuuuuuuuuuuuuuuuuuuuuuuugagacugggcauuucucugucgcccaggcuggaauguggugauaugaucauagcucacugcagccucaacuuucugggcucaagugauccucccacguaguugagacugcaggggugcaccaccauaccugacuaauuuuuugauuuauuauauagacggcauuucauuauguugcccaggcugguuucaaacaccuggacucaaaugauccucccaccucagccuuccaaagugcuaggaccacaggugugagcccaccgcucccacuuagaaacauuuuuauuagacuuuacaauuauuauuauguuuuguucucaaagcaaguauucuacaucuugaaauacugaaaauuaacacaagcaauaguuuauuguccaauacaugacaggugguaugcucuagacuucugguguauugugucucuugauggaaagaaagauggcuucccccucuggacaccacuggcccaaauaguguugcagaagugggauggggacuguugaaaggaagucucaguucagugggauuccacccucuaaaggagagugggccugaucccugucaggugaccaugcuuaugugcagucacaaggggaaauguuuggaugugccaacaggaucuccuggacauacauccuggaaaagcucaggagagucuucagugaacaugucuuugacaggaguuaacaugccacauguaguuaucuguuucuccagcgguguuccgccacucuugccuuccuuccuucacugaccacuggguaaugacaacuguggaccacuccugcaugacagagauauagaaaugaaucagaaacgaagccuguccccacggaacuuacagcuuauaaaggagaccacaugcuuauaauuauggugcaaggugagagccacugagaaaugaaauggguauccaggcaggggagagauuuccuccauuugggagacucugggaagacuuccuggcguagcugacauuuggccauuugagccgaguaggaggugaauaugucgggauggcauccuaggcaaagcaaacaguaagaaggaaaagguggcaggaaagcacuagaugugaauuagcaguuuagaguaauuacuuggccaugcauagagaagaggagaugugagggaagugagguugguugagggcguucauggcagcuguugagugccaggcugcagcuguccagggucguucuuggggcaguuuguagccgcugaguguuccugaggcugggugugcagaauuggagagcugggcuaugggaggcuuggccugaccagagcgucuccaaagcuccccaucugagauggggagaccaguugugggugugggugauccuacacuugagauuccuccccgggagucugcuuuguggugaugagacuggagaaagaguggacagaccagcgguuugguggaguuggcagaaaggcugagcaggugacuggggaccagggccaggaccaaggaaagucagagcacagugaacucugauaauggguggacagcgguggcauuuggagaagucagaaagacaagcccagugagugccaguaggcaggcaucaucacuuuguggacaaguccccagacuuuggaagcaggcaguccggauucacagcccaccccuaagcugugggcuuaggggcuuugccugccaagugcagagaacagcuguggcuacugcaguggccuuugugaugguccagaaagguacaagccacugaguaagcucuggccaguguuggcuucuaagguaggcacgaugaaguccagccaaagucagcuaggggcaaaagggcagggcuaguuagaggaccaagauccuuucuucuggagacaauggcaggaaacugacaaggauuuuuuugaaagccucccacaaguucaugggagacucagaccucugaguguuuugacugucacccugcaucucagcucaggacaggaucugggacguuugaagucuagacugguggcuuacaaagcacaagcagggcagguccuucccuccugaugugggacaucagccugcuuguuuugggagcugggguuuggccagccucacuuccccagcccuuguuaugggagccacguucaggagucuccccuucuaccagaacucuuccucuguacacagagggaaacacaucagaaccuggcaguuuauccugacucuagagaaauaagucauaggaguaucccuguuauaaaauaauaaauaugugugagauuauuucaugaaaguuuuauuaaaaguuuccuugugaccuuauuuugaucacaaguaaauaaaauacagugugacuuuuuaaaaucugaaauuaguuauccuccuuaaaucuguuuucagcaguucaaacuaguaauauagccuauuuguauaauuuuuaaaaaucuugaugcucuauaacaaauuugaaaagcauauuuuugguggucagcaguugugguaccugcuggacuuaaaugcuucuucauggcuauguccacacuucagcaguuaggugauuuuacucagucauaggcuguauuccagaaguuaacuugaaaguaguuuaagaugcguuucucccauacagccaauguuacauacauugacuagguugcuggcuaagcuguaagaaccuauuuauauauaccuaagccugucugucugucugucugucuaucuaucuaucuaucuaucuaucuaucuaucuaucuaucaucuaucuaucuaucucuaucaucucucucucucucuaucauuugucuaucugaaauagaguacuagaaauacuuuaaugaauaaaaaaccagacccuuuaaaguaagaagcauuaaaucugagauaccacacauguggaucccugcccagccuccuggugagcacucgguaacuguuggccauuuuuacccuggcucaucacccacucccaggucuggugguagaaugaaaugaccucccccuuggagguaaaaguggagagcugguggggggaagugcacuguaucagucuccaagaugaaggugagugaaccaugcaccaacuuugcugguugcauuucaucccauaucuaaugccugaccaccaucauuaaaccuucaccuaaaaccugaccuucaccaugaaggaaauuuccuucaguugguaggauagggcuugguuuuauaccugcugcuggcaggcuuccuuguguaugcauauaacauuucucugggaauagucacccaaagaccucaucuccccugagugcgguugccauucuggggugagauugggaagaguccuuccucaucugcccagcuguggggcuagggcauucuccagccccagaacuaggucgugaaaugcauccaugcaggugucgaagaauggcucucauucuugcugcugaccucucgccugucguuccccuuuuauauucugggucuuaccacuugaaaaccgugggguuagcacccagaacaagugggaaucccaggaccuugggaauuuuuaauguuuuuguaguugaaauauuuucauuaauuuucuguuuagccacuugauugaaauacuuuauaaguaaugaagaucuuuugcaguugugcccuugugucuuaaaaggcuaccguguacuagguugaugaaugagaaacuuuaacuuaauuauuuaaaacuauaauuucuguagaguguaguuaauggaaaguacauagaaaucgaagauaugaugaaaaggugaccaucuaugacugauugccucaacguuuuuuccucaguaaauucuugcuauucaggcaugacuaaaauaccauggaaugauaucuuucaaaaucauuugaaaggaaacuaauguaacuuugcuguuguccuguuuguacuguucuuauuuuuccuuguuaauagaacaggcauucucgucgcacauacuggaaccaauagaagaacuuucagaggaagaaaaagguaacaaagggcuugaucagguuuaccugcacagauuauauuuauaugccaaaaucuaggccuggaaaauaugagccagugguuuuuauuccacuacaucaaaauuaggaaagacauuuagauuuggauuuuacuuucaacccacauagaguauccuguuauccuauuccccuaauauucuguucuguuuuccccugcuuugugguauucuuaugcaagcagauaaaauaagaaauuuuuugugucagagaacuugaaaaaaaauuugucuuuauuuuaaugcagauuuuucugaugagaugauauauagacacacacguguuguguaccagaagaucugaaaauauuuguaucauaguggugauuuaucauacccuuaaucugaaaugaauuggugaagugcuuauuuccaaauuauuuuuaauagcaagaaaagcaucaugucuaaguucuggauguggaauauuuaugugcaaaacaguauuuuuaugguggaauuugggagcuguuacagguguugggagauaauuauuacugcuuacucauuucauuugauaguccuaaaaauuauuuucugucaauuaguuuuuaaagucuaugaagaaagguuuaauuaugaggaacauuuucuaaugcuagauuuguagauuuugaaaacaauuauauuugaaucaaucuaucauaauuuuuuccuauuaauaauaauaauaauucaccauauaucacuucuuuaggagaaagcaaauugucaauacuuauauggguucugguuuugucauuuuugucaggaaaagaagucaaaugauauauauccuaauauauaaauucaguauuuauuauaacucuucccuuguucucuagacauuuaccauuuuauuuuuauuuuuauaaggcuacaaauugagaauugacuacaucaggcauauucauaauaccuauaugauauacacuuucaagucuuauuuugcuaugcuaaugaucaguaacuuuuugauauuuuuauaggguuuguuuauuuugcuuccauguaucuuuguaauuugucuugauguuguauauuuuagacagaccauuuaguuuaggauugcauaucuuccugucccaauaguuguucauguuuggcacugauuuugaagaguuugguuuuaguugcuucauuuccuccuuauuucuuuguaauugcuguuccaauguuuagaaaccugcuucuuucagaaacaagagugacuauagguacauuaaauuacauaaagccauaaaaacuuguugagggaaauuuugggguacucugaugagcauaacuuuaaaagauauuguuaccuucuuaugggguccucagccuuguuccauugcuaaacaaauaaauugcuggaggggucauucccagacacuuccagcaccuuaaagaccaccacagcccaggcaucaaacgagauccugcaggcugaaucgauuccacagacgcugacuuguucaagcugcacuauuagcaacuauuguacaguagguugccaauauuuaauuguagugcaaucucuacacaauuuaauuaucuaucacuaggugauaaagucccuuccaacucagaaauucugguuguuguuuuuuuaaaauuauuugcuuugugccacaauacaauacccuggaaacccugggcgcauggucuacuuagcaacauuuagcagggcugagccgccaucacuggcuauggaagcaaccuccgguuugccauaaucccccucaacucuuuugccccacauugccuucuuugcuuuauguaggcguuuaagcuucugagcccuauagguugaagagaaauagugcuuaaaaaauauugucuuuaagugauuuucaaccaucccuauugguuuuccagaaacggaagaacaaaucuuacccuauuugaguucugaauaaugacacaucauuuugcuugcaaguaacaugcuuccgcucuccuacauacauaucauuuacugauguccaagauauaaaaucccauauuccuugaagaaucugugagacaugucaggagguucauagaaaacgucgcguacuuucaaaauagaacuucaggucauguaguucacacucauuugaaaaacgacucagugaggguuccuauaggaaucaugauuguccaccaucacccagaguggucuuguaacuuccaguuccagauuucacucacugcaucccucugccugugcuuuuagaguucuuccagucaauguaagaugguaguuuggaaucacugacagcaaacaccaccauugggugcugccacauuuagggggcuggacuggaaaagaaaauaacucuugucaugcuccauguguucagcucugaugguagacaggagagugcugaggaccauagaaaacaccccaggguccacgugcaccacugcagaaaccagugacugccuccuuccagcaccucuguggaguuaacauacuggcagcagauuaauugccaucaauaaauuccucagcuugugcuaacauuuugcagauaagugccugagaagcucaauuuuggcagugguuugcaaaaacacuguggcuuuuacuaagaaguaauucaugcauauuucuguguaccugcuuuuugagcaaaggcauaguugaucuugcaguuuuauagaugcuagaaugugagggccagaagggaucuuagagggcauuuuauuuuccagaaagaaaacauagggggauuaagagccugcuucagguuguugaguuuaauuagugacaacauccagguuuucuacuguccauaguuuagugcagagagcaaauggagaaagggaagcugauguggccucuacaggaccaucuggauggccuuuggggaaguuacugcuguuucuaguauacucaugucaaaaaucuaucauuacuaggugguagauaaauucccuuccaacucagaaauucaaggauuuuuaaaaaucauuugcuuccugcuacaauuauuuguuuaccauaaaugggauguuguaugucugauaaaacugaucccauguauggacuguugugcauuagccugggcgucugcuuguuuguguuugaaaauuuguauuugaaggaaaugcuagucuuuagaaaguuuugucuuggucuuggugagcaauaugugcuuuaacuaaaauccucagcugugauugauuuucaagugauuaauuccacuucuacauaaaaacuuuauuuuucccugcuuacucuacauucuuucucuugcuuccauuggccagccccacccuuguaagaaucuuuaccaagggugcucuaauuauucauaaaugguuucccaaagcaagcaccaguauauaaggugaauuugaggacagggggaaaugcguaaucugcaguaguuuggggaacucagucaucaaaaugaaccugucaucagagcugaggaugaucacagacacaucagcaaaugaauucaacaacuaacggcaaaggcuuuacagcucuucuaacugcaaccaagucauuccaggcaucgcuugccccuguauguggccccaagucccagagaaaacagggcccagagccucuuuuuaggcaacgcuucuguguacguccuucauuaucugagauauuggccaaaagagucuucacauaauugggguaggggguaugucuauuucaaugguagcaccaagacuuccaggcucucucggugccucuuuuuauuuuuggcccuagacaguugcacacuugauggccaccuagaagccaaagccagugacauaguggcugcagcuaugauuuugauggauuguucauagaagugcuuuuuuuggugguuucagaauauuuguaaacauuggugguuaaacagcagcaugauugcugauaauauaagauuuaagauuaguucugacuuuuaauauauaauuauaugcaguuuuaucacuucagcuuagcaagcugcaauagcaaaacauagaauaguauuuuugugcaggauuuuguucuucuauuuaauguacacaaaaguaauuugacuaauuuugcuuucaauaaaaccaucuauuuauuuaauagaaauauuuuuuaaugugggaauugaacugguguuuagaaaacaucuuaaacaaaaaggcauuuuguucaagaucuccugcaaauccaaguaguauggguauuaagaauccugucugcugagaugggugaggcagcagcagaagggagagucucucggguggccuggagcccuacaccuaggaaauggcauuugaugccacccuuuggugggcaaaaugccccuguuaggagauuagacuccaaaaugguaguauaguugucacauuucucccagaucaggcuuuugacagucaguaagggucugaacugccaaacgucgcaucucuuuaaugaagucuucuguuccuuuguacauaaggacucagauuuuuaaagguuaugccaucauucuucuccaaacugucuugaacuugacuuuuuuuuuuuaaguggggaauaaaaaagggauagggauggaagugaggagaauauguccuauuguuuuugguuucuuuguuuuuaauuauagguuguuuuaaacaaaauacacuuuugcuaagacuuuuguuauccuuuuucauuuugguaaauauuuugaaggggauaaugauuuucacaucuugaaauuuuauauguacuuagcuucuaguaacuaaaaaacuuugaaaaaaaauuuuuauauuuaaaauaaauugaaaugggaucucgcuauguuguucaggcuaaucucaaacuccuggguccaagugauccacucaccuuaaccuccgaaagugcugggauuacaggugugagccacugagccuggccaaaaaguuuuaauuauuuaaaguaaauugggcuuuuucuucauaagaugauacauaaauucuaacugagugagcuuggagaugaauuuuucaggaaauagugauauaauucuagugauaaaacauuaaacuccuaaauaaauuuuuuuuccaucaugcuucuauagauacauauauaucuauaguugucaucugauuaagugauccagucuuugaaaauacugaaguuuugaagccgacauaaaauaguuuuaaaagcugcauaacuuaagcauucuguauugugcugagugacuaaaauauccaaaaacuuuaaaacaucacaaauacuuacuugcugcuuaaaagcugugguuugccauuuucugcuuagagauuuuugauguauuugcuuaauucuuuuuuuaacacauuuuuaaaaccuuauuucaggaagggaaaaugaacagaaauuaaauaacaacaaaaugcauuuaaggaaagcuuugaagaguaacuccucccucacuaagggacuaagaacaaugguggagcagaacuugauggagaaacuggaaaccuuggggauuaaugcaguauguucauucauuuuuggaauauuuguuaguuuugcuguguuuuguuuucuaaauuagaaaugaucauggaagagaagaaagcacaucaauucuguccauguuuggagaacagaggcuaaugugaccuacuuuauuuaucaaacacuugaauagcauucacugugugccuggcacauuucuacgaccuuaacaaauauuaacucauuuaaacauagaaacaaaucucugaaauaaaugacauuaguaucuugacaguuuacagaaaagguaaguaacuugauuaaugucucacagcuaguaaugaaggagccaggguuuguaucuaggcagucacagugcugcuuacauucugauauuaaccucaaaucauugccuauuacaaaaccagcacuucauuaauacauguugaaugaauggaugaauggauuggauuucauauuguugccagauugaauaauuuugguauaucauauauagauucuuuuugcuuuuuauaguuuuauugacauacauaaaagacacaaaucuuaauugaacuucauuaguuuauauguuuauaaaaaagugcaucuacauaugcauauauacacauauaugcaaagcuugugagcacauaugcaugcaugggcacacacguggauguguauaguguguaugugugcauguagcuauguauauauacauguauguauccauguguguaugcagauaucuguguauguguauacacauuuguguauaugauauguguauacacauuuauguauauguauguauauagaugauuguguauguuuucagaaguauguguguauguggcuauauuuguggguauacauguuugcauaauuuuaucuauauagauggauuuguauguacauggauguguguguaugaucuauaaccagcacccaaaugaugagauugaacauuuccaacacucuggaagacucucuuuuacuuucugcuagucaguaucacccccuacuucccaaucggagggaaaggguauucugacuuaguuuugcuuguucuugaaccucauaaaaguggagucauacacuguguaauauuuuauaucuucuuuugcuuaaugauuuuaucuauaugauucauaccuguuguuucauguagcaguaguuuguucuuauuuauuaccuuauagcauucuauugugugaauauacuacaguuuaucucuucccugcugauggacauuugugugucuauuuuggggcucuucuuggcuauuaauucuuguacaugucuuuuggugaacaugggcauuucuuuuucuugaauauauaucuagggaugaaauugcugagucaaaggguaggcauauguuuaguacaguagcuguugccaaauaguuuuccaaaguccuuguaccaacucacacugucccuaacgguguuugagaguucaguugcuccacaucuuucaucaacucagucagucuuuuuaaauuuccacauagacccuuuuuagguggguuuugaccacccuuugggcaguggaaaucaaagacauucauggaaugugugugguuccugugcagauuguuucuuaaaauuguaguuuuccauauugguuguuugcaagugguuuuuugaguuuuaauuuuaauugggacauuuucauuuauccuaagauuauuaaaacauucuuuuuuuucucuaaugcuuggagagguuuuccuaguuuuuuguuuguuguuuugcuuauuuuguuuuugucuaucugggcuuuaagaguuagguuuugaaacagugauuuggagagcuaacuuaauuuccaguuggaucaggugucccaauaucauuuguugaauaauccauaguuucuccauuuauuuaaaaggacauuuuugucauauaagaaaucccuauauacauuuggauuuguuuuuggacuuucaacuguuuuaccuuguuuuuuuguguguuccuuuucccauaccauacuaauuuaauuguaguagcuuuguccuguguuuuaauaucuuuuauaggccaugccuucuucauuagucuuauuucaaaaauuuauugguaauucuuccauguuuuguuuuccaaugaacuuuaggaauaacuuuucaacuuccagaauaacccuuguugggauucugauugaaauuguuuuaaauuuuguauauuaaguaggaaggauugacauuuguacaguauuaggucuuauccuccagcuacaugguauaggaagacaggcaugaaacaaaugauuucccagacaaaugggagcucucuaauuuagauuauaugaggugaaauaaaggaaaaguagaggaggggguugauugaauaacugaggucagagaaaacuucuucuuggaggugguacuuaauuugaugauggagauuucuguccugggcaacugggugggugguauggccacucccugggacugggaaggcugagggaagcaagggggaugggaacaaagaugggagguagcugugugugugagacacuguuauucaacaaauaucccuuuaacuaguuuucuucugucuagauucucaucaaaucuagaugacuuuucucaaauugucucuuuaauuaugcuauuuucauaguuaaaugucaccucuagcugggcacgguggcucaugccuguaaucccagcacuuugggaggccaaggcagguggaucacgaggucaggaguucgagacuagccuggccaacacggugaaaccccaucucuacuaaaaauacaaaaauuagcugggcgugguggcgggugccuguaaucccagcuacucggaaggcugaggcaagagaaucauuugaaccugggagguggagguugcagugaacugagauugcgccauugcacuccagccugggcaacagggcgagacucugucucaggaaaaaaaaaaaaaaaaaaaaagaagucaccucugaugcucugaugaccuauuguuccuuguagaauaaccuuucagccuuuuggguuggcauuuagucucuucugcugguuucaucacccaggucuuuuuaagcauuagccugugggacgugccuuaccuguuucugccucgacagcuuccuuucucacaggugucccuaucucaugccuacccaucuggaaauuucuccuuguuuuuacuuguuugacuccaccuguccuucaggccacagcucagccuccccuuucagccuucucuggccacuggggccuucgauggccucccucccuggaauucuucuagccuuuguagacucauuggguccuuaugacacacagccucgucggucagccagucauaaacauaugcaugccuuaugugcccaacugaacacauggccccuuuggggacaguguguuacuuguuggggcacccuuacccucuacacacaacuggagcccuguaaggauggauugaaauguuggcacaguuaaugcugauauaugcccaugaaaugaaaccucccaggauaacuggccaacuuaacaucuuauucuuucaggauauacguggcauuucaagugaucaguugcauagaguacuaaaaaguguggaaucagaaagacauaagcaagaaagagaaauaccuaacuuucaucaaauucgagaauuccuugaacaucaagucagcuguaaaauugaggagaaagcacuacucucuucagguaagcuuguuacccacugcaaaugggagcuuaauuuaacaacuuuuucuuuuuuucuucuuuuuucaccacaagauaucauuaaacaaauuauuauaauuuuaaaugguuaacaaacuucgccacuucacuggcaacucuuuuacuguuuguacuauuaaaugcugggucuuggauuuuguuuuuacaguaaaaacaaaacaacaacccuagagucuggcuuuaaacccuagagaugggauuguucauugccacagcagcauaggggguauuauaccguuuaccuuugcuuuucacuuacugaucauaaagguaauggagacucaugaaugacacuauauuccagaucagugcaguguuucucaaauggauacccuuucaacuggagaaguacccaaaaugauacaacuuccuuccaaaaacagacaacugauuagacaaaaagcuguuucuacugauaggacaucuguuccaaagugaguauuucagcccucagauuuauuuuaucaguguuugucuuagcucaggcugcuuuaacaaaauaccauagacuggguggcuucacagaaauuuauuuucuccccauuuuggaggcugaaaguccaagaucaggaugccaguauagucagguuccggugaaggcugucugccuugcagacgacugccuucuugccaugccuccagaugguggagauaccucugaaggagauacaucgcuuccucuucuuauaaggcaccaaucccaucaugggggcccccauccacaugaccucaucuaaacuuaaucaccucccaaaggccccccagaugccaucauacugugggucaggucuuuagcauauguauuuggggcagaggggacacagacauugaguccauaacaguguuugguccaacugagaaucacacuuguaauuccuaccagucucuaacugacgcugggugacuuuuguugcugcucuuccucguuaguguaugucaaaagcaaaaaucaccaguuccauagaaauguaugugaaauuauauuauuaacuuaugcaauuuaaaaauauuuuucuguuguuuuuuuagaauuaagaaaaaugucauggaagauccuuuucccagaaagucuucaacuauuacgugaguauugacagggaugggagggucauuuaaaaaauuauuuucacugaacauuccuuucauuuuaaaguagcgugcucauuaugguugaaugaagccguaauuauuuaauaucauaauuugucauuccuuugugauauguuauuugugacaugucuuuguuucuuuaucaguuauuacauaagucaauagcccuuaaccacauguggacuccauuaagaagcaagacaccugagucauucuuauguccaucccccuacaauguugaguaauuucucaauaaguacauuuaacuuaaauggcugauguugaguuuuuauggcuaggcucaugacaguguaaguuuguuuuaaauguaauaauuuaguguuuccaguuuuuuguggaaguuaauacugacccuaguagauauuccugucuuagguucucuuaggauacuaaaaacccuagcccaguuguucaucaccugugugcuacugauuuaguugauuacuguuuuaagccuguuuucuuaucuguaguaugggauguuuuaagucucaauuuccuuaucuguaauauggaauaaugcugccuuuuucacgagauaguucuacaaauuaaaugggaauguaugaagagggcuuggcucagugcuuggcacuuguggguacucaauaaauuguagguauauuguuacuaauuaugaguaagacuaauuuuaucaugaauaauuuaaucaucauugccuuauucuggagauauugaugacauaaauaucuuuucauugaggcacuguguauuagagacaauaaacaaugauucacccuucaaaagcacuuuucuuauacguaaucucauaggaagagcauuauuucuugggauguggugugaaugaaucaacauguacaagacugacacguugucuggaauuuaggugcccaauaaauauuauuuaaaugaacgaacacugcuuugaacuucuauuucaccuuaaaauggggguaauaauucaugugauaauacaaaugagauuguguauguaaaagcucuuugcaagaaggugcaguauaaagaagcuguaaguaaugacacaauuuuaaaacauggagugguuuuacugaggaaauguuuuucuuaggugugugaaaaccaaaauuauuaagaauauauacacauuuggguuuagaggagacaggccccggcuucagcccauuuugauaaacaugccccguggcuggcagagaucugggcgugggaggaugcuacagccguggguauaaccucuggccucgccgccaucuuggccauagccccaaaggcacuugugcccacugagaauuaccugagaaaggugccaccacuuuaagaggcacaucucuuaauauuauaaauccuaaagcguuacgaaaacagcgccccuaucucgguguugauuuguguaggaccccuccuuuuaguucagaggaggagcaggaggacgacgaccucauccgggcauacgcauccccaggcccacuuccugugccgccaccacaaaacaagggcagcuucgggaagaacacagugaaaagugacgcggacgggaccgagggaagcgaaaucgaggacacugaugauucucccaagcccgcaggugagcuguuaccuuggaaaacucucuggaaacuguauuuaggacaguuguccucacccguguguaccgagcacugggagucugagcugggagggugugcaaggaacagaugcagcggaucccaaaggcacccacggaaaaugggcaggguuuagcacauuccaguugaaggagaggaaggaguugggaaugauaccugguguauuaguuugcuagggcugcuauaacaguaccauaaacuggguggcuuaaggaacacaaccuucuugccucacaguucuggaggcuggaaguacaagaucaagguguuggcgcuguugguuccugugagggcugccagggagggucuguuccgcgccucuguccuugacuugucuucuugugcauccucacaucaucuucccucugugugcaucucuguccagaugucucguuuguauaaggacauuggauuagggcccacccuaaugaccucacuuuaccuugauuuccuuugcaaagacugugccuccaaauaaggucacauucuaagcaaugggguuuagaaauucaacaugugaauuuagagggacacaagucaacccaggacacugggugacuaugagaauggcuguucuaauacacugugcugccucuuggagcuggaguaauacuaaaggaagacaagaucuuagccugucacugcaaauauuugcugacgagaaguagagcugaugggucauuauuuuuuuaaaaaauucagcuuaaugcaauuuuaaaauuauauauuuuaaacauaucagguguaauuuauuauauuuaauauauuguguguaauuuauuauauuuaauauauuguuggauguaauuuauauuguauauaauggguauauacuauguauuuauauaauuagauaaaauauaauucauuuaaaaauucauauuguuuuuguaaauacccauaugaauauuccacucaugcagguuaucucacugaaauuaauuucugaccacacacuugaaugagauccucuuucuuugauuuaaaauguaaacuuuaggccaggcacagucgcucucaccuguaaucccagcacuuugggaggaugaggcaggaggauugcuugagcccgggaguucaagaccagccuaggcagcauagcaagaccucgucucuauuuuuuuuaauuaacuaaauaaaaugaaaauguuauauagcucauagucugaaggauuaugauuuuuuuaaggauuguguguuaaauuuucuaaccccaaaguacaucaacugauuuuauuuuaauaauacauaauuacuuccaaagcuuagacucuuucaaaguuuccuguaagguuauuuuggaacuaaagauagauuaaauuuuuaaauacuuaacuugccuaauuuuuauugaucuuauaggagucgccguuaaaacaccuacugaaaaaguugaaaagauguuuccacaucgcaaaaaugugaacaaaccagucgguggaacuaaugucccugagauguuuaucaaaaaagaagaauuacaagaacuaaaggugaaaucacuuuuacuugcuagauauacauaaauuugucuuuggacagcaccuuaauggucacacuuuuuguagugaaauauaaaacagauaguuagcugguagaguagagguugagauuuucaccuuucuuguucucaguauugcauuucuuuccauuccauagacaaagauauuggagugauaacuguaacaauacauaauaagcaugacacuuuacagguuuucaagauccugucacauguauuaucugauacuugcagauaucaaaugguuuguacaaagaaauuugugacuggccagaauuggggcccuucagaucuucuucacuacccuggcaugagaccuuagguacuuuugaggguuuagcuccacuugggagccgaagugaggguggaggccaagcuccucugucugcauuagagaagaagcccaaacauuuucccagugguucuaacagccaggacgccagagguguuucuguggauggagcucuaucauuguauuucugggcacagcucaucuguguugacugguccuccaguccagggcauuuugucaaauuacuuuuauuaguuaauacuauuuguguuacacaagccaaaaaugacagaaaguccuaugacauucaagagagagcaaaagcaucuuucuuuaggaagggcaugguagaacugugugcaccuuucaguugggggcuauucgguuggucugauguacccacaguuagaugucauuauuaucacagagguaagaagcaagagcaagccucacuccuacucuggagcacccugacuuuuagaguuucauaccgcuacaguguaguauuucuggaauuuucuacauucaugauugguagaguaggaaacauauauuuccauggcagaaacgaaaaagagaugauucagauuucaaaauaccaacuuccaaaucuauuucauugcccugcagaaaugacuagauuuggaaguauuaauaguuccccacuucuuuccuuaugguucaguguuagaugcucagucuaaccaauaaaaugauugagggacaccauuuuuuucuaagcaacauuaauuauucuccaugccuuucuuuuagugugcggauguggaggaugaagacugggacauaucaucccuagaggaagagauaucuuugggaaaaaaaucugggaaagaacagaaggaaccuccaccugcgaaaaaugaaccacauuuugcucaugugcuaaaugccuggggcgcauuuaauccuaaggggccaaagggagaagguuugcugcuuuccccucuaauacaagcucgauccauuuucuuauuaguuguguuucaucuuuauaaauaucuaauuaacuuaugcugguauaucaucagacaaaaaagcugucagugcuuucuuuauguuauuuaaauaaggauuggauaugcauaacucacugauucauauauauuuacuuguuauuuuuauuuaauuauaggacuaaucuuuagucuuuaaauuuuuaauuuauuuuuauuuuuauuuuuuguuuuugaaacgguguuauugucacccaggccaucauggcucacugcaaccuuaaccuucuaggcucaaacagcccucccaccucagccuccccaguaacugaggcaguccucccacuucggccucccagagugcugggauuacaggcaugggccaccgcucguggcccccaaauuguuuguauucuuuuauuuuuuuuuuuuuuuuggccaggcgcaguggcucacgccuguaaucccagcacuuugggaggccaaggcgggcagaucacgaggucaagagauugagaccauccuggccaacauggugaaacgcugucucugcuaaaaauacaaaaauuaguugggcaugguggugcgcgccuguaguccuagcuacuugggaggcuaaggcaggagaauugcuugaaccugggaaguggagguugcagugagcugagaucacgccacugcacuccagccuggcaaaagagugagacucugucucaaaaaaaauuuauuauuauuauuuuuuuauuuuuuuuaggauauggggucucacuauguugccuaggcuggauucaaacuccugggcucaagcaauccuucugccucagucuccugaguagcugugacuacagaugugcaccaccaugcccagcuuuuauauuauuuuuaaaaaugucuauacacguauucucuucaugaagaugccuuuuaggaauuaaaauuucugaucauauaccugaaugagaccacucuucuggcagucucucuguauuagucuguuucccuauuaaauauuuuucuucauuuucucccaagggagguuucucuuguagccguguagucagugggaugaaauacuaugagauaauuacuugaaaugauuuucauaucccccaaucuagagccuagauaagcccaauaacuuaguaauuuuuuuuuaaauuagaaaauuguaauuuuuuugucaaaguaauucuugcacauguugaaagcugaguuguucagaaggcuucucuaugccaucgcaccaccuucauuagugguagcucugugccucucaguaauggccuuaaaccacucuuuguugauucauugacuuuagauauuaacuguugauguccugcaaagacagauggggacuuggcucauuuucaccacccaccgcaccucucacgccuucuucacuguuuuuguacuccuacuuauaauuuuauuacuuuuuuuuuuuuuuuaagagauggggucucaccagcuugcccaggcuggugucaaacuccugggcucaaaugauccucccaccccagccucccaaacuguugggauuacaggugucagccacugcacccagacuguaauuuuaaguuaauaccugcaugucuccacccuugcucuuuccauuuucagcagccucucgccccuuuguaagauaagauguugcugccugucuccuucacgcuaccuuuucucucacauuguccaguuauaacauagcuguugcauaacuggcaucaguuaucugugcuaagcaucaacucuaauuauugaaaaccaggagaccuguuggcauuagagugacucuuuacagggccaagaggaugcccuaaggacaucuccugucucuuuccuccaacaucauaaaccugugccccuggaggaacacauuucuagagucaaacuugaguggaauucucugcacucuauuucacuggcucaaaaucauggcauuuuaaaauugacuucguuguuaauccuaucuaccuagaaaauauguuuuuaacacuuuacuuggcuugcuaauuucauccuucuuucuuuaccaucuauucacucagagucaguaacuacaacacaaauguacugagcaccuucaacauccaggcccugagcugaaugcuggggaaggagugggaagcaggauguggucccugcuguuuguaggcugcagggcagaagcuugcauccaaggguccugaguguauccuagagaugcgaccaguucacaguuggauuuuaaaguggcguccuauacauagcucaugaggguugggagaugaggauucaugaacagauuuagacacugagugauuaaugacaauaugaaauuauggauuuuuauagacuugacaaugugcuuguuuaaccauugaggccuucucuucugccucuacccaccacuuacaggacuucaagaaaaugaaucaagcacauuaaaaagcagcuuaguaacugugacugauuggagcgacacuucagaugucuaauuccacaugucagaagauuauuccagaagccagcaguauuucaguaucacaguguuucaguaauuugccuccaugauucuagugcuucugccuuaccguguuucccacagcaacacagagacugauucaaagaacaauggucucuuuaauggcacccaauacaguauugaaaaucagaucaucaacaguauuucgaagcauguaaagguguuuaagacuuccgcugcugcuuaaaaauaacaugucauugaagucauaaaaaguuuuuucuucagaaagguacucuaguguuaaguguauuuuuuucaacuaauuuuuuagugaauuuuuuuuaaacuuacagcauguuuugguuugaauuacuaaaacuuuaaaaaauauuuuucuuauguaugcugucguaucguaggcguuuauauuauaaaauucuguuaguagucuuaaaauugaauugguggaaccacuaauccuuaaaaguuagucugguuauuuuucauauagaaguaaguuuaauccgaguguggugguguucaccuuuaaucccagcuacuugggaggcugaggugggaggauaacuugagcacaggaguucaagaccagcgugggcaauauagcaagacuccaccccuccacaccccaaaaaaguaaguuuaggauuagaauauagcuagguccaauguuaaauacauuuuccuggaguacauuugucacauucagcuuugagccacuguaagcauguuacuauuaaaugguugguuauuuuauauagcauauucuuuaucuuggauauuuuaugaauaaaguauaguuauuuuaagugccaauuaauuuaucagacuaaauagaaaauauuugagccauuacugaauucacauauguauguuuuuuuuuacuauuuaaaauacccaacauguauuaugaaauaccucaaaaguaauuuaguuacauucuuaaacaaugacauugucgaaagaaaguucuuauaagcuguuuuuugcauuuuuauaacuugguuauacuauauucuguuuccaaguaaccuuuuaacuaaaagauuuguuggguuuuagaucucuuuucauuugucaaccuuuucaguaaagcccucuguuacaucacugugacuguggcuguguuauuagagaugaauucugaguuaaauuuguacuuauuaggggucuuacagagggagaaucuggccuugauugcuaugccauaugacauucuguccuaaugguuagaacaaaucuuuaucuguuuccacccacccugggauccuuuuuacuuguagcccauuccugcccucuaaaagaauccuuccaacuuccuauaggggccauuucaugcagauauacucacuuuauauguauguuucuaaaagcuuuagugaaggcugaauccaaguuucauguaguaggacagagaacagaaggccgaauccaaguuucaugugguaggacagagaacggcaaucuacaaaacuacaccaagccuaagauggcccaugugccacuuuguucauucauuuauuuauucagcagauauuuauugaaccacuuggucugguuugguuuugaacacgcacuaauucauuuaauuacaacaacuuugcgauguaguuauuguuauaauccucauccuaaaggugugagaaacagaguuauuaaguaaguugccagaagccauacaaguacaaagugucaaggggagacuuuaagccaggucucuauuccauguuuugugucugccauguuuucauuccugagcagaagagcuuggggaaaugaacuuuugcuaaguaaacccaguauuuaaauuaagucacuauaucugugucuuuuaagagccccuccuuuagcuuacaugguuaguuguaucuuuuuuuuuuuuuuuuuuugagacagagucucacuauguugcccaggcuugagcgcaguggcaccaucucggcucacuacaaccuccgccucccagauucaagcgauuuuccugccucagccucccaaguagcugggauuacaggugcccaccaccaugccuggcuuaauuuuuuguauuuuuaguagagaugagguuucaccauguuggccagacuggucucgaacuccugaccucaaaugauccgcugucuuguccucccaaagugcugggauuauaggcgugagccaucgcgcccugcugcauuucauuuuuuuguauaaaauuugguuuguucguuuuugaggggaaccauuccuuuauguugccccuuacugaugcccaacuaauguguuucugguuacuaacagaccuucaucccccacccucccuaaauucuucgguguaaucuaagcguuaucugcaccacuucugaauaauaaauguguuugaaaugcacaccuacacaacccugucccacacuggccuguaggaccuaaucuaccuucaugucuuucaguugauuuguauuucugcaaaagauauuucaaggauuaucaagguauggaauuuuuuuuauuuuuuaucuuuuaacaaacuuguucauuuccuuuucuuuccauugagcaccucugaacaaugugauucuuuuuuuuaagucuuucacacuucaggaaaauacuacauucacccacguugugauucauaucggacaguuucuuacucaaagauaacacaaauaccaauucuuauucauacuuugaaacuauauuuuacccuagacugccuugguucaaaggccuaguuucgacauuacuguggcaaauuauuuaagcucucuguuuucauuucuuuuucuguaaaugcaggaugaaaacaauauguaucuccuaggauggcugugaggagugagugagacaggacaugaaagguguguaugaacugugauaacuguugcccuugugggcauguuauauagggcuggcucuaggaagaagccugugucuuuuuucagaaaucccuggagcaacuuaaaugucuuuagaaaugacaagucucucaguuauccaguuagccguaaacagguucuggaagacacaccuagauagaacucggcccgucaguucugagugaggcacguaccacuugggcuugggauguccuuaacccauuuaugccugagguugcaauuuuuugaauuuuuccaaucacaccuuggcgaugaccuugagcaguaggauauaaauaacucccacaugcuuaguguuccaauaauggaacacuaggcauaaacagguuuuaauuggcuccucagucaaccaugaccaauaucucuaucucagcuucugcugaugcccuagcucagggcucugcauuccgugccagggacgccucagccccuuaacauggaugugccacaugacaggcaauaauauauuggccccauuagcccuuccuggagcagucauaaugaauuacagucaugacaggcacauguaagaaaccaaaauuugcuaaauauguacaugagucuucaucacagcaucguuuaugaaaacaacuaaauauucacuaauggugccaguggaauaaaucagagaacauccccugcuacguaacucucugcauacaucaaagagaaugguguggcuuugcuuuuucaacaaucuacugaguggccaugggcauguggauauggccaugaaugagcaagauccucucugauccuguagaaguuaaguucuaccagauaacuugcugcuucaacaaaaagauuuaccuuuuuaaauaaauguuguagaauacuuaaaaaaaacaaacuagaauuugccugugugcagccaguaacaugucuauuuaaccuggacaccuuuugaggaauauucucagauugcccccaugcuguuuauaagacauuguuccuuauacaccuguuuaugaaugaaaagaaacauaaggaguggguacaaagacuucuaucuaugaaugauuaaaaaggcuagaguacgaauacuucuugaaccuuugguacuaaaugcuuuucauguucuauauaaauguagaaaacauuuuacaaauccuguaaauaaacuguuuauuuuuuauagaaagccacaacagaaaaugauuaguauauaacuaacuauguaagaacacuuacauccauacaaucaacagaugcuucaaaugcauauuuuaaaaauaguuuugaguguuaauuaugggagggccuugaugggaucauuuugugaacaguucgcuuuuauaacaaacucaagaggcagcuugccagcgagcucuuuuagacauaagcauuuuuaucaaacuguuuugaaggguuuguuguuuuaaaaucuucuccaccaugauacuuuguccgagaagacaugacagauguggccccguuguauguguaucugaaagguaaaacauaguuugguagauucuauucuacacauagggcaaacaaaaaugggaagaaacuguuucggccugucucugccaauaucuaaauguaaaucuuccucuuucuuagauagcuuucuucucuccucuugccccaagaaguauuuucagugucauuucugagugggauggagaaucucugcagaagaaacucaugacuuggucauuuguucaguuauccucuuacaaaaccauguuuuaaaacucacccuccuggaagcuaggagacuuaguagaggccaucaacauuccugccuaccuagaggaaaauuaugaugaggccaacgugaagaacauguccucauauucagacccuuauuucuacguuagaauuuucuuuggaauauaguaaugguaaaacuuuaaaaaauuaacuguacugcuaaccuuuuccaauuccggauuuuggaaguuucuaagaaucauaugaacuaucuguaauuuguuccacauguaaugauuuaugauagcauucuacuuuuuaacaggucauuuuugucucuuuuucauaccuggguguuuuguuguugucagauauugaaaagcaaaauaugacaccaccaauuaugcacagugaggcuccugcccauccaauaaacagagcggcuccuaauucauaccugugagaaagcauuacacaaguauuacagcucacuuauuuggagaguaaacaguauuuaacacugauagucaacauuuacuaaaugcuuauuauguuuuuuugcuauugaaaauuguaaaggaaauaauaacaccuugugucuguaaaaugcuguaaacucuucccaaaguguuuuuauagccauuagaccaucccaacauccugaaaggagaugagggcauccacgggggcaaagucaaagcaaaaguagucacagccagggucuccugacucagccagcaccuuuccucugcacgcugccuuaaccuugccaagcuuuccaucuauuuguucuguucugcagcgcaaaucauuuaggcagacuguaguuaguuagaaaacaaaagguugcuuuugcuuucauguuaguucaauuuaguaaauguuuauuaagcacgugcuaugugcaaaucgucacuaaucgcugcagucuaguggggaaaugaaucaauagcuaucauuuagugauaaauuacuauuaaggaucucccauauggcaggugacagugcucugccgaugaccgcagcaggagcagaugcaaagauaaacaagacaguacuuccccugggaaggccacgaaacaaagguaugaacagugcuacugaggacaaaaaacaagaucacuugcaguagcggacuagaggaaauccuuucaggggagauauauucacccaga

SEQ ID NO: 17708 - RNA, 5312 nt, Homo sapiens
auggcagacacaaaacauggaauagagaccuggcuuaaagucuccccuugacacuuuguacuuguauggcuucuggcaacuuacuuaauaacucuguuucucacaccuuuaggaugaggauuauaacaauaacuacaucgcaaaguuguuguaauuaaaugaauuagugcguguucaaaaccaaaccagaccaagugguucaauaaauaucugcugaauaaauaaaugaaugaacaaaguggcacaugggccaucuuaggcuugguguaguuuuguagauugccguucucuguccuaccacaugaaacuuggauucggccuucuguucucuguccuacuacaugaaacuuggauucagccuucacuaaagcuuuuagaaacauacauauaaagugaguauaucugcaugaaauggccccuauaggaaguuggaaggauucuuuuagagggcaggaaugggcuacaaguaaaaaggaucccaggguggguggaaacagauaaagauuuguucuaaccauuaggacagaaugucauauggcauagcaaucaaggccagauucucccucuguaagaccccuaauaaguacaaauuuaacucagaauucaucucuaauaacacagccacagucacagugauguaacagagggcuuuacugaaaagguugacaaaugaaaagagaucuaaaacccaacaaaucuuuuaguuaaaagguuacuuggaaacagaauauaguauaaccaaguuauaaaaaugcaaaaaacagcuuauaagaacuuucuuucgacaaugucauuguuuaagaauguaacuaaauuacuuuugagguauuucauaauacauguuggguauuuuaaauaguaaaaaaaaacauacauaugugaauucaguaauggcucaaauauuuucuauuuagucugauaaauuaauuggcacuuaaaauaacuauacuuuauucauaaaauauccaagauaaagaauaugcuauauaaaauaaccaaccauuuaauaguaacaugcuuacaguggcucaaagcugaaugugacaaauguacuccaggaaaauguauuuaacauuggaccuagcuauauucuaauccuaaacuuacuuuuuugggguguggagggguggagucuugcuauauugcccacgcuggucuugaacuccugugcucaaguuauccucccaccucagccucccaaguagcugggauuaaaggugaacaccaccacacucggauuaaacuuacuucuauaugaaaaauaaccagacuaacuuuuaaggauuagugguuccaccaauucaauuuuaagacuacuaacagaauuuuauaauauaaacgccuacgauacgacagcauacauaagaaaaauauuuuuuaaaguuuuaguaauucaaaccaaaacaugcuguaaguuuaaaaaaaauucacuaaaaaauuaguugaaaaaaauacacuuaacacuagaguaccuuucugaagaaaaaacuuuuuaugacuucaaugacauguuauuuuuaagcagcagcggaagucuuaaacaccuuuacaugcuucgaaauacuguugaugaucugauuuucaauacuguauugggugccauuaaagagaccauuguucuuugaaucagucucuguguugcugugggaaacacgguaaggcagaagcacuagaaucauggaggcaaauuacugaaacacugugauacugaaauacugcuggcuucuggaauaaucuucugacauguggaauuagacaucugaagugucgcuccaaucagucacaguuacuaagcugcuuuuuaaugugcuugauucauuuucuugaaguccuguaagugguggguagaggcagaagagaaggccucaaugguuaaacaagcacauugucaagucuauaaaaauccauaauuucauauugucauuaaucacucagugucuaaaucuguucaugaauccucaucucccaacccucaugagcuauguauaggacgccacuuuaaaauccaacugugaacuggucgcaucucuaggauacacucaggacccuuggaugcaagcuucugcccugcagccuacaaacagcagggaccacauccugcuucccacuccuuccccagcauucagcucagggccuggauguugaaggugcucaguacauuuguguuguaguuacugacucugagugaauagaugguaaagaaagaaggaugaaauuagcaagccaaguaaaguguuaaaaacauauuuucuagguagauaggauuaacaacgaagucaauuuuaaaaugccaugauuuugagccagugaaauagagugcagagaauuccacucaaguuugacucuagaaauguguuccuccaggggcacagguuuaugauguuggaggaaagagacaggagauguccuuagggcauccucuuggcccuguaaagagucacucuaaugccaacaggucuccugguuuucaauaauuagaguugaugcuuagcacagauaacugaugccaguuaugcaacagcuauguuauaacuggacaaugugagagaaaagguagcgugaaggagacaggcagcaacaucuuaucuuacaaaggggcgagaggcugcugaaaauggaaagagcaaggguggagacaugcagguauuaacuuaaaauuacagucugggugcaguggcugacaccuguaaucccaacaguuugggaggcuggggugggaggaucauuugagcccaggaguuugacaccagccugggcaagcuggugagaccccaucucuuaaaaaaaaaaaaaaaguaauaaaauuauaaguaggaguacaaaaacagugaagaaggcgugagaggugcgguggguggugaaaaugagccaaguccccaucugucuuugcaggacaucaacaguuaauaucuaaagucaaugaaucaacaaagagugguuuaaggccauuacugagaggcacagagcuaccacuaaugaagguggugcgauggcauagagaagccuucugaacaacucagcuuucaacaugugcaagaauuacuuugacaaaaaaauuacaauuuucuaauuuaaaaaaaaauuacuaaguuauugggcuuaucuaggcucuagauugggggauaugaaaaucauuucaaguaauuaucucauaguauuucaucccacugacuacacggcuacaagagaaaccucccuugggagaaaaugaagaaaaauauuuaauagggaaacagacuaauacagagagacugccagaagaguggucucauucagguauaugaucagaaauuuuaauuccuaaaaggcaucuucaugaagagaauacguguauagacauuuuuaaaaauaauauaaaagcugggcaugguggugcacaucuguagucacagcuacucaggagacugaggcagaaggauugcuugagcccaggaguuugaauccagccuaggcaacauagugagaccccauauccuaaaaaaaauaaaaaaauaauaauaauaaauuuuuuuugagacagagucucacucuuuugccaggcuggagugcaguggcgugaucucagcucacugcaaccuccacuucccagguucaagcaauucuccugccuuagccucccaaguagcuaggacuacaggcgcgcaccaccaugcccaacuaauuuuuguauuuuuagcagagacagcguuucaccauguuggccaggauggucucaaucucuugaccucgugaucugcccgccuuggccucccaaagugcugggauuacaggcgugagccacugcgccuggccaaaaaaaaaaaaaaaauaaaagaauacaaacaauuugggggccacgagcgguggcccaugccuguaaucccagcacucugggaggccgaagugggaggacugccucaguuacuggggaggcugaggugggagggcuguuugagccuagaagguuaagguugcagugagccaugauggccugggugacaauaacaccguuucaaaaacaaaaaauaaaaauaaaaauaaauuaaaaauuuaaagacuaaagauuaguccuauaauuaaauaaaaauaacaaguaaauauauaugaaucagugaguuaugcauauccaauccuuauuuaaauaacauaaagaaagcacugacagcuuuuuugucugaugauauaccagcauaaguuaauuagauauuuauaaagaugaaacacaacuaauaagaaaauggaucgagcuuguauuagaggggaaagcagcaaaccuucucccuuuggccccuuaggauuaaaugcgccccaggcauuuagcacaugagcaaaaugugguucauuuuucgcagguggagguuccuucuguucuuucccagauuuuuuucccaaagauaucucuuccucuagggaugauaugucccagucuucauccuccacauccgcacacuaaaagaaaggcauggagaauaauuaauguugcuuagaaaaaaauggugucccucaaucauuuuauugguuagacugagcaucuaacacugaaccauaaggaaagaaguggggaacuauuaauacuuccaaaucuagucauuucugcagggcaaugaaauagauuuggaaguugguauuuugaaaucugaaucaucucuuuuucguuucugccauggaaauauauguuuccuacucuaccaaucaugaauguagaaaauuccagaaauacuacacuguagcgguaugaaacucuaaaagucagggugcuccagaguaggagugaggcuugcucuugcuucuuaccucugugauaauaaugacaucuaacuguggguacaucagaccaaccgaauagcccccaacugaaaggugcacacaguucuaccaugcccuuccuaaagaaagaugcuuuugcucucucuugaaugucauaggacuuucugucauuuuuggcuuguguaacacaaauaguauuaacuaauaaaaguaauuugacaaaaugcccuggacuggaggaccagucaacacagaugagcugugcccagaaauacaaugauagagcuccauccacagaaacaccucuggcguccuggcuguuagaaccacugggaaaauguuugggcuucuucucuaaugcagacagaggagcuuggccuccacccucacuucggcucccaaguggagcuaaacccucaaaaguaccuaaggucucaugccaggguagugaagaagaucugaagggccccaauucuggccagucacaaauuucuuuguacaaaccauuugauaucugcaaguaucagauaauacaugugacaggaucuugaaaaccuguaaagugu

SEQ ID NO: 17709 - RNA, 33897 nt, Homo sapiens
gcggcggcggcggcggcggcggcgggcggggaucugggcguggaggcgcgaggggcggggcgggcggcacugcgggcccgcggcucgggcggcaccagcggcucccggucucucucucugcucgcccucagucccacccggugccuacggggccgcaucgccgcccggcucggcccggcccaugcccagggccgcugcucccucaguugccgccgccgccgccggcgcccagggggccgccgcggcugugaggugggggcggcagcgggaggcggcggggcgggccgccggggccggggcugggggcgcagcgcggccggcguaggucuaugucgcgggcggcggcggcggcggcggccgcggagggacgaugcgcgaguacaaagugguggugcugggcucgggcgggguaggcaaauccgcccugaccgugcaguucgugaccggcaccuucaucgagaaauacgaccccaccaucgaggacuucuaccgcaaggagaucgagguggauucgucgccgucggugcuggagauccuggacacggcgggcaccgagcaguucgcguccaugcgggaccuguacaucaagaacggccagggcuucauccucgucuacagccucgucaaccagcagagcuuccaggacaucaagcccaugcgggaccagaucauccgcgugaagcggugagcgagggcacacgggggcuuggcggcugcaccccggagucaccgucccggggcuggaacuccccgcgcggggcuccggggaaggggcuuucugggggguggcuccaagcuggaggcuuuacuauugucauucugcuccuccuccucaaucucaaauuugagugcuuuguuucacaacuaaaauuuggcaucguguuagcccacagaacagcucuuugucucuuggacguuguuagcauugcuuguuacagagcccccaaggaaacaaaguuuaaaacuugcaggggggaaagggguggauagauuugucuugggaagagaggaacugugcagguauagucgagacauuugcagacugaacaacaacaaucugccuuggcaauguuugacaguaaaaaucgcucacacaccuauacaguaaagucaaguccagaggaaggagaccuuucucaucucguuaaagguuuaugguuccaaggcguuuuacaaaaauuaagucucuaauuuagugcaaaacuuuaaagacagauuauuaaauuauuugaagacaucauaagcuaaaugggguuucgagaauauuaacagaggaguacaaauaagccauucacaggaaaagaaugcagcuuaacuguuuguuuuuguuuuuuuguuuuuaauauagccgccuuaaccccuuccaaaaaaaaaaaaaaaaaaaaaacaccaccacaccaccaccaccaguuccuggaaacaaaacagaagcuucuucaaaagugugacacaaguauuagcuaauuuaaaguuaauguuaauaagccuuuauauauauauauaaauucuuuucuaaaguauacauuuuggaaauauggcugauaaaugauuuaaaauguuuguuuucucuuaaauucacugaauauauuuuuccguguaauuuuaagcauuagaaaugugauaauaucuuaguucaaaguuuuggcaaauuuuucuaauuaucauuuaauuacacauuacuguuucaucuaguucuuguuaguuaaugccugcugauaauuuugguguccuuuuuuuccugccuuauucuaccuagagccuaaaucugaagaccuuuacugaaagaugguuguaagugcaccguagacacagucacauuguaagucaguuugaguccacucauuuugaaagagcaaggaccaaguuauguguacccaggggaugaucaaaaauucauuacgaguagugaguuuuuaaugcaaccuaugagaucaaagagaaggcucucucucuauugcuccacccccccuuaacugaguaugcacuuuaaucgcugaacuaaaaucgugcauguuauucauccuuguguuaaauuccaaacuagaauaaagcagauauuuucguggucucugcugcuaagauuuguaaauuugauagcuuuguacuucuccaguaucauuuuccuaaaguuaaauguuuauaguuaagagaugaacaauucugguguuaaacuuaguaugaggauggcauuuaaggggcuacauuuaaguuacuuaaauucuuauuacccccucccccaaccacucaauuaaaaagaaacaaaccaaaccaacugcaggguagucugauacauugccacaugucaauguuaggccaaaugcauacaucaaaaaauaaucuaaguaaaugccccaacagccucacccuucacauuuagauauauaugcuuaaagauaugaagaugcacauauacacugauaaagccacauacccauggcuaacuucuugacacaagccuagggaacaaauauggcaaaauauuauuggauaauaugguccacauaauuuuguaguuucuuguaauuuagugcagauuacuuuucucaguuauaauaauagguuagucuaaacucagcauauuggagcaauuuguuuauuuucacuaugacccagaggaaaaacauagaguaaaauucugcaugcccaguaucauuuuacucacuagucucaguucuugauauaaaaagaucauugaucagcugaaguagaguucauaaauucucuucaccagaauucaaccguuguauacauaagaaccucuuggacccucacuugugugucuuuguaauaugguaguaguaagguauuuuacaccucauccuaaccccagcgucuggcuucccaucauugauggagaggacaugugaaugcagguggccucuucuuuaccagucuuucaguauuugauaucuacugucaaauucaguauucagcuuuaggucuaggucagcacuuuucaauagagauauaacgugagccacauauguaauuuuaacauuccuaguagcugauuuuuuaaaaauaacauaaauauauggaauuaauuuuaauguauuuuauuuaacccaccauauuuaaaauagaaucauuuugacaugucaguauucaaaaauuauuaauaagguacuuuacuucuuuauacugugucuucaaaguuugguauguguuugaccuaccacaucucaauucaaacaagucacauuucaagugcucaguagccguauguggccacaggcugccauauuggacaacagaggucuaagguguauaugauuuggggaaaugcuugcuuauuucucuaagcuucaguuuccuuaucugugaaauagagauuagcaugcaccuuccagaguccuuguuagaauuaaaugagauaauguauuuuaacauucccaaaacaauaccaguacacagaaauugcucaaaaaauucuagcugucauucuuacuuuaauaacuuugucauuuaucuuccuuaaauguuacccuugauauaaauguaauuuuagaagaaauaaauuuguaauugcauuuuggaauucauuacuuaguauauucaagaugagacuaaaaagcaaugagguuaaaauaauccuuggaagaauuguguugguauucucuugaaauuauuuccccuuaugaaggaucugauggaaaagggcaugagaaugaacauuuaacuucaaguacaguauagcaauaaugcauagcacuaaugcauagccaaacaacgaauggagcuuuucauuuuucauuuucauuucaaauaauagcagucauuuucaaggauugcuauuacuugaaauguuucacuuuuaagaaaugugaaacugacccauacucccuuaagugucuguaaguguacauaccuccguauacauacaugaccucuugucaaagccaaguggaccaacugaaaauggcuauauuuguaaauucauaugcuuucuuuucuuaacuugauuuugggugagaugacacacacaaagaagaguaacagggauauaggaaauguuuuucaguugaaauaaaacuagaauuuuuuucugauuuuguaauugcuuuuuucauuguuacccaugccaggaucagccaugguccugacaugaaguucuuggaacaugauauacaaggccucuuugcuguuaggaaaaaguccagaaaucuucaacaugaccuuucacaguccagcuugcucuuaucccucccugccugugcagccucaccucuugcacccauccuuuuauucuagcacccagaccuuaaguccuugaaaguaccuuucucugggcucuccuuuggccuguggaaaucuaccuuuuugcagaguuaauuccuacuccgucuuucacccucaccccugcuuaacccauuuauaccggagguugcaaauguuuuuugugaaauaucagaccuuagcaaugaccuugaacaguaggauauaaauaacucccacaagcuuaguguuccaauaauggaacacuaggcauagaugaguuaaaagauuuuuccccacugagggaagauguccucucaaaccaaaguaaccccuuuccugucuucccuuacuaaacuuuaugccucaccucuuugcucaaucacacauacccuguccuuucccuuuucuuugaagcacucauccaaauuuaauuauuugugugauaauuuauggguagccagccuuucucacaaaacuccaagcccacguaggugacacagcuccuacuagcacauaggaaacaagaaaaaauguugaaaaaaugaauguucagaaagaaaaguauuuguauuguuguuuggccucaguuucccuaaacauuuugauuucauagauggaggagaugaucuuuuaaaguucauuuugcagauggagaugaucuuccuucagcucgaacuuucugugagaacacuuccaguuggggcaguguuuaauacgaaccucaaagaaucagaaacaugauguauuccagauggaggaaauggcacaggaaaugcauagaauauguuuuuuggauguuaaauagagcagacuggccaaauggggaauguauauagaagugugaggggagguaaggugaaaauuuuuaaagcuaaauuacugaagguuaaagacuuaggaguugaucauguagucaaggaccauaaucacaauugucauagguauagcaauauguagugauaugguagaugucuuagugguaauagacuacucuguuucauaacaggaagaauagucauaaauguugugauaauccaguuuuuacgugaagugugaaaauccugaauuagcauggugucuguaguaacaggagagaaaggaugcaaggaauguuguaaagaaugaaguaaucaaacucagugguagaggaagaggaaaaggucagaaguaaccuugacauuuugaaaugaacaaauaggauuauggaggaauagcugggggagauuauuuucaguuuuggagaugguaauuauccagauagccagccuaauaaguaauuagaacauuugaauaaagccugaaaggucagguuauguaugaauaugaagacucaggaucaucugcguaguucagauugggagaguagaugaaaccuacuggguagaguauagagacagaaaugaauggauauggcuaacaauagaaaugaggaaugaaugaauauagccaaggauagaacucgagaguuguaagauacacaguggagacuuccuauauugcaguaggcgagaaggcgugggguguuuuaagauugggaaaaagauaguugacuagcacuacccaaggugaguaaguuguuuuuuuuuaagauuauuauuaauuuucuauaucacuuaaguggucacuuucaagugagcuggcugauuguuuacacuuucccccuuaccauaaguagcuauuaaagccuacucuaaaacagaagcauauuaccaauuguuacacauagaucuuuggcccaugacaguuuggugcuggagagccgaaacgagaguauacaucaaaagaugucugucccaaguaagugaaacuucuggagcucugcuaccguuuuucccucuaaaaauaccugcuuccccaguaccaaaacuuaauucaaagcuggaccucccagguacagagccuaauagcugugggucacuuuuuuuuuguuuuguuuugguacuggugaauuaguaggaaaaauuuuuaauaauaaauauauauaacaugaagaauugaugacuaaauccugaaagucagacauaaauccaaacaaagaauuuggguaugaagauaaggacugauggugaaaccucuauccacuuaaauacaaaacuaagauaaaagaauugugagaauuauggcugccaaacagaauauuaaaguuaaaaagacugacaauaugaaacaaacaauauaacuaguaagucaggaugagaggagggaaauaguuaugagugcucacuucaucuuucaugagagggauuuaaauggucaaaaaauugaaauuuguuuugaaaaugacucgaagagcucaguguuuuucaugaucuuuuuuucuuuaaaaaccacuuuauugagguaugauugauguacaaaaagccagacauauuuaauguguacaacucagugaguuuagagauaagcauacacuugugaaaucaccacaaucaaugcuguaaaacuauccaucaccuccaaaaguuucccccugcuuuauuuaucuauccauucauucauucauucauucauuuuuuuuguaguaagaacacaacauaaguucugucuucuuagcaaauguuuauacaauacaguauuguuaacuagaaguacuauuaccauacagaugucugggacuuacuuaucuugcauaacugaacuucauacagugaaucacuuuauguggcccagaaguuuuuccugaaaaggaaacuuuuguuuuggcugcauuguaaaauuacagguuacaguauauaguuuucuuuuugccacuccaggauuguaauuuuuaaagcucaauuuggaguuggaggagaugaugucucuuccucucuaacauucugugagagcacuuuugucuggccggggugaugagggaaggggucaaguuuaauaugaaccuuaaagaaucagcagccugugacccacaauuuugucuaguuaagauuugauaauuguaucaauaaaaucuacaauaaggaauaauuauacuaauacuuauuuuuuaauggagggcaaaaauaauuuaaauuauuaaacauuaaggaagagguagaggaacuaagaaaaaucacuggauuucacagccaacaggaagagccaacaaaguuggaaucuauuugcuaaaguuucaguagcaauauacuugagugauuuaauuucugugugugaaguucugggaaauuacauauggcacaauaaggugcauauauuaugcauguauauguacauauuuuuaagcaaggaucuuuacauaaaaccaaguacacuguacuuaagggaauuuuuuuucagggguauuuuuuucuuuucaguucucuuuuagucauugucuuuagaaccuuacugccuaggggagcauguaugccuuacucugggguuuucuuugcuucuguuuugauuuuucccuguuuucuguuucucuccaucuauucuuaccuacuguuuuuuuacacacuuauauuuuucaggccuauguuguaaaaagaguuuuaaguacucuaaguuuuuuuggaguaauaagaguuugaauacgagcagacuuucaaacaagguaaaacugauggugacugaauaguuacuaaaggaaauguauagauauuguguuuauguaggaaauuuaucuugaaauuuuaauggugugcagaaauaugccauauauuauauauugccauuucauuuguuacuuugacacuugugguucauaucauuaaaaauuauucucagccugacagagagaaguuuaauuucuuaaacauccuuucugcuuuaccagaucaaacucagccuuuuaguagaguaauaucaauaauaguaaugcuguaauuguggacaucugcauuucagucaaguauguuaaauaaagcauaaauauauuaguaaaauuuaaaguaaucaaaauaacuaaaaacaauauuugaagauucuaauacauaaucuagcuaagauuuugucaugguauguauuaaauucuuucucuggcauaauuguauagauggggauuuguuuuuguuuuuuauuucucuaauacauuuaagauuuuaaaacauaccaaaauuuauauuuagggagaaauaaggugacuuauaauuuuuauuuuuaaauuguuaucugucaaaaagccaaauauuggaaaaaauuaauaacuaucucuauuuuuauagauccacucagcaggggauuucacauuuucuuaaccagggcccucaguaagaaguacauuuuauauugugacuuagugcacacauaggaauaaauacaucuagccgaaaucaacauuucauaagacaguaaacuugcuauguugcuuguauuacuuuuucuauuuauuuuuuucuauuuuauuucguuguuuuuaagugcuuuucaugacccaccaaauugauuuuaucacacauagcuuggaaacugcuauccuaggacauuuuuacucuaagaaaacuaaauguaacuaucuguuuaauauuucaucuucucucuccugcuuuucugguucccagcaaugcuguguaagauuacgaaaaugaaguacuucccaaugugaguuaguaaauacuaccuguaauucagagaaagauagcauuuagucacugaacaaaaagauauagcauaucuuuugagaaagcauuuaucucuguugugcauauuagaaauaugagaauguauuucucauguaauguuguucauucuaguaauucaagauaacuuuugccuugugaaaacuuagaacagagaaagggagguugugguaguauucagacuugaauacaugagugcgggauuaucuauuucaagaacaguugcugaggagguucagaaaacucaaaauagaggucugcugcaucuauccaggauaacacugauucaccucucccuguaagacaguaaaacuauaaauaucuuaaaaucacuuaguaaaguuacccaagagaaacauugaaaaaccuuuauuuaaaacauuuaggaguguucucaugcuuuccugacccuuagaaauuaauaauucaaauguggaaauacuauauuaauaauucaaugcauauuaguauuuucucuacuaaguaucuuuacagcucucucucuguaaaugaaaucuuagaguauuuuaagagacagggucuuguucuguugcccaggcuggagugcagcggcgccaucagagcuuacugcagccucuaacuccugggcucaagcaacccuucugccucagccaucugaauagcuaggacuacagagcaggcaccaccgcauccaaguaauucuuuaaaaauuuuuucuagagaugggaucuuguuauuuugcccaggcuggucucaaacuccuggccucaaguguuccgacuaccucaacugcccaaagcacugggauuacaggccugagccacugccccugguccuaaauuaauucaucuuuagguuuccaaugaacauuaugaauacuguauguauuauaauucucgaauggaguauuuuauuguauauacuuaucuucucauccaugaagacagcgaauguuaaucucauuaaagcugagauccagcacuuauuaguuauguaauuaggagcaaguugacauuccuugcauuuuaauuuccucauuuguaauaugaguaugauguaguaacucgugagauaacgaacguaaaguguuucuuuacauagugaaccuaaaauauuaauaauaaaguuucaccaagaaucacagaaauaggaaugaaacccagccuuuuaucuguauacugccacgugacuucuuaggaauuaggcucaauugucuuacuauauugagaugaauuauauaccuaguauaguauaacauuucuguuuuucccauugcuuucuccucuguguuuuaagugcucuaacacuacguuauagaacuuauagcauagaccuugagugcuuuguguuuuugccuuccccuagagaccuaaauauauuggcuauaaaugguggcgguaaauuuuuugacucaugaggaauugugaugauuuuuaguacacauauuuuaaauauuaauaugugacauaaaaagcaaucagcauauuaguauuuguuaacacuucucuuuuuaaaaaaguuaauaaugacaguagaccucuuuaugaauaccaaauaugcauggggugaagauaauuuuaacagucuuuauggcuaguuauauauaguaacaugcuggcauagcuuuuuaauaaucaaauugagaaaaguuuugucuuuguauaaaagucaucacuaucaacuaauaucauuuaagccaccucauuugcauagcauugccuugggcauuauacagaauaagaacaagauacuaucuuuguccuucuggugugccaaaauguccuauaaauggguauauauuuugcaguauugaguuauacagaaauauauuuuuaaagacacuuucauuucuaaguuucaaaauauuuuugcaccaaaaacauugcucuuauuaggccaccuuuucuaaggaaguuuuuauucauuuuauggaaauucagaauuuugucuacaagacuaaugacaacaauuguauauuuauauauaaucgccuuuuuguauaugucuuagucucuucaggcugcuauaacaaaauuccuucgacuguguaauuuauaaacaauagaaauguauugcugacaguucuagaugccaggaaauccaaagucaagacaccagcaaaauucgugucacaaauggugccucuugcugcaucuucauaugguguaaagggcaaaauggcucccacaaaccuccuuuauaagggcacuaaucccauucaugaggguggagccaucaugaccgaaucacuuccuaaaguccccaccucuucauucuaucacauuggggauuaaauuucaacauaugaauuuuagggagacaagcauucagaccacagcaguauauuuaguacauuuuuauccucccuaucuaaaauauaauuucuccuucccucaaugauccacuuacacuccacugcuuucuuuuucuacuucgugaaccaacagucccaacaaacuuugacaaucaguaauguugacugguaaagugaagcacugaaauccuauuguuaaguagccacauacauacauacaugcauacauacauagauacaugaaagcuaaccagaaaaugaacuaaacuuaauuauuuuuaguuuauuuuuuaugagcaagugaugagaaaauaauuucuaaugguuaauccaguuuaugcauaauaccaaugauauaaaacuuuuuuacaauggucuagcauuaaggaacuauaauguuugcauaaacccuaugucuguucuugcuggauggucaacuaguuuuggagugcuguuaccuuuauugaagaaggauguaaacagagcauuaucucaauaggugcagcugcuguguggagcucugugcagggagagucccccagcugugugugagcucagucaugggaauacugugauccaccagcagcauuuguccugagagaggcagccaggauguuguauguuuaccaucccugcugaacaaaucaguaucuuaauuaugguaggaugccucccagagguauauacauuuuaaaaggcuacucuugaugacagaaaauguuuauuccuaaggccacccugagcacaucaucugguuuuauugaaggaaauacuuguacauuuauggagggaaggaaauuuauuuuauugcuugcaucagcauauccuacuaaguaaugaguccugaagcuuuucuuuauaggccacagugaguggcuucuuaacaaucacauaucuauuuuccuuugaauaaguaccauugcuucaaucuauucccuuuucuccaaaggugacuguaugucucuuuuaucugggacaguucaggucuaugcuuguuguucucuacauuuauuuacaguaccccuuuccaucuugaaaguaucucagugugggcaauaaauuuuauggucacuauagacuguuaccucaaacucucucuuuuuuuuuaaaucaugacaauucaaaucccauuugugcauauauuuuugagauaccuuguuuaaauaaacaguaucuuucuuugaccuggccagcuuccuuuuuuaaagcuuuuguuaauuuggguaaacaaauccucaugaacuggaaauguugcucaguuuugaaagaugacaucuuuuuuacuaaaugcucuugauuaaagauggcugcagauucuuugacacaacuuccauugagaaguaggaucuguuuccucucccuuugagucugugcugccuguuaagacuguguugauccauagaguaugcuggaagugauaaccaagccaguuuggggccuaaucucugagaagacuaacagcuuccgccuuacuuucuugaagcccugagcuaccacauaggaaguccagcuaugcugcuggaaaauucacggagaggcccggaggcuagauagagaggaggagggagcucccuuccagccauuccuaccaacgugccaggccucaagugaggccaucuuugacucgccagcccagccuugcucacuauaacuaaagaccucugaguggccccagucaauaugauguagaacagaagaacugcccaacugaguucugcccaaauuguugacccacagcaucaugcaauauaguaaaauggcuauuuuaagccccuaaguuuugggauaguuuuaugcagcaguaguuaucuggaacaauaacacauuuuuagauaaacauguuauuuuagaaauuauuuugguaagaguacuauugauccuuuugguuucuuugugaagaucuuuaaaaaaaauuuauugaagaugauugaauaaauuuuaacucuuaaaauaacagcaaauuuauggagcaccuaccaacugcccuugcaauugaucuacccgaugucauuugaccacucucacccaugcaugauuaacuguacuuugaagaucacauuuaaucguauuaagaauguaguguauuauggcuuaauuucagcagaaaauucaaauguauguaugugcccuuugcaacuguuuauacucauagucugaacugccgucucccccuucacucuacccacaggguguacuguuuauaaaaguaauugauguaaaccaucuaauuucuguugaugaagaaagagucuauuauuugguggugcucugccucaauuuugauaucuagcaccugacacauagaaaauaucuaguaaauauuuguugaauuuauaaguaaagaucccugcauucuguauuuugacaguuucccuccagaucccagaucucuggagaccccuuaugcaucaaaucaauuuaagcauuucagugucuaacacaaggcaugauaaagaaaaauaauaaagcauuuuagauaguguacauccaaaaaugcguuuuuagccugguggccauggacauguuugcauugauuuugugacauuuuuguuacuccagacaccauggacuacuuaaggaaagugucagauuugaagaccaucacuucauuaucucauucuacuuugugugucuauaagugucaagaacugauuccagcacuggggauacagcugcauauaaaacauucauugcccuugccuuccucaggucccagauguaacuuuaaagguagcacaccuggcuucaggcagaaacaagacuuuagcucaaaacuccuuauacuacucagaguucuuggguuuuuuuuuuuuuucuuuuuucuuuuuuuauuaacccaccuugucuuagcuaggccuucagagccaugguucacagcuagugacuugacuuaguauuuacugcaggaagaugaacagaauaaggaaagcuacuucuguuuggaaaagaugguauuagauauuagagggaaagguaucuauccuguuuuucucaaaucuuuuccacaagaauaaugguuuucagacuagaugguuaguuuuggccauccuuggccagaggaauggaagccagagauaggagauaaaacauaaauaacaguuuugguacauuuuuacagcuauaucaccauuaagauucuagaacugccuuacuaacagacgauuugagagaacuuagagaaggauaauucucauuucuguaguauuuuacaauauccacaguacuuauuaauucacguauggcuguagggcgggaggcuguaaaacaggcugauugcccaagugugguguguaacaccacacuaagcuguuaguaaagucaucaucaucaucuuccuuaacauuacaccuaaguaucaauuaauguuuguuucacaaauaaggaaccugaggcucagaaagcucaugacguauccaaggaggcagagcugggacuuauuucuagguccucuaacucuagauccagcucucucuugugguacacuucaucuuaauuuuccccagugaccaaauugugguuggccuggacuguuaaucuagaaauaauuuacccagaaaaaaacucagguucgcucacuugaugaguaacaaagaacuccccaugagaauguggguuuugaucaauaggaguuuuauuacuuggugcuaggaaguaggacacuguaaggauucuucaaggcacugccucccuaaggaaaagcaacaggagggcuuuauggggcaauggagaggagagaagggugcagccuugaauauggaggagggaucccaggugcacagaugcagugagccaucaugccagcacauaggucgcauguuaugguaaugaagcuguugccucucccacaguggagacuuuagcauaguaaguugcaggggucugucaggagcuaguuuaagccaacaaagugaccgcauuccacacaggcuguagggcaggagguuguaaaacaggcugauugcccaaguugaugaaauuccuauaaacccuggaaaccuccuugucugcuuacagauaggcuuuuagcuagucgcuguagaucugcuacauauuuuuaugggauaguugguugggggaaucacugaaaaagcaauguuuuaagguaauuauuacggaaguagcauaggauagaguagaagagugagaaauuggaggcaagaccaguuaggagacuguugcagugucuuagguaugaguuacuuuggaaaugaaagcguuuuuguagugggagugaaaaugaugggacagauuuccucacauccaguaauuccuguucuguccaucccuguaaucacuacuggacuagaccuguuguugcggccucucauuacaccugaucaugcuuagagacuauuggacacucuguugcuuaccauccacucucccuugccccacagugaauucuuaaaacuaucuuucugacuucuuucauuucaguguuggcuugaacccugucaaaauguaacucuucauucuccauuggcugcuguugagggccauaaccucugccaacaaugauaguuuucagcuccuuucuucauugugcauuuguuuuauuuuuuuuuuccaugucaucuguuacuucuccugguucaagugaaaagaccuuuuuaauaggcaucgccaauaaaucucaugccaguugaaccaaccaguuacaacaagccaugaauaaugaagguacuccucuuccucuucugaguuguuuauugcugggcagaagaaaugcuaauucuguuggccucauaaccugaguuuucuagaaagcuguauuauagagauucaguguuugggguuuuuuuuuuuuaaguuuuauuuaguguuauguguacugagugauuuagaaaugauaaauauucuaagaucuuacuacaacaauagaaaaaucuugcaggauaaauacucuucuguucauaauuuaaaaguuccuaaaaaucuuagcucuucauagcuuucaagcuucuuuauuuaaaucuucuucauucagagguagcuuuaaaaaaguaguguaauugaacuuuguguacugaauuuucauucaaaacauuuugccaaagaugcugaaaaugaagagguguugaaaagauauauacuauaauuuaauccagauguaaauuuagguagcaguuucaaauaacuugccuauuccugaguaacugacucaauuuaaucuuuucaaguacaauagucaggccuguuuuuuaaugcacagguuucagauuucaguucucaaaaagauaaaauggauguuguauguccgaauaccucuuccccuucgagagaugaaagcuguguguucuccauauaugugcccgagcuucaguuuuccuuacuauuuaaauuauguaaaaaagcaugcuuuguugacagauuuuuaaaugacauauuuuuuauuaaaauguacacucuagcuacacauucaaguaucaaauacagaucaaugaccacuuucguccaccuuauuuugaaugacuuagauauuacgcuuaaaaaaaaaaaagaaucaauuaguuuauucagauagguuuuuuacauuugguuucuaaaugauaagguuuggggcuucuauuugcaaacacuuccucacagauaacacauuacuggcacuuuacaguggaaaaucuccauuucuaauuaaaaaaacagauuaaauguaguuuuauuauauuccuuuuucuuaacauggauuuuugagguacugugacaucuugauaugccugaagagcacuguggucaauuggaugcaauauauagaucuaauagugaaggaaauguuuagaacuauuguuuuuauuuccaauaacauguuguacuucaguguuaauauucauuaugcuuucagucuuuagccaguuuuggauauaaauuaaacaguacugcauuguacagaaguuuaaaauugguuagugauauucugcugaguaagaaacugacugugaucagcuuaaucaugugccuuccgugauguaaacacacagccaacaggcaugugcaugcaauuugucuugaagguuauauuacuuuuccuguuuuaaugaagaaauuguuuauaaucuuacugauuuuuuuuguuuuuuuuuauugagguagaaauuuuaugcaguaaagugcacaaauuguagguuuacagcugggauguguacaccuguaaccaaaucccaaaugaagauggacagacauuucaggcaacaaagcaggcugccucauguuccauuucagccacuuccauacucagagaccaccauaaaugagucaugccuaguaaugaacuucuggcuuccaucauucagcauccucuaugggauucauccguguuguugcauggaccaguaguuaauucuuuuuaauggaggugcaggaugccccuugcaugaauauaccaggauuucauuaauuguucugucgauggggcaucuggauaguuucuagguagggguuaugaaugaugcuacuaagaacauucuaguacauaucuuuuggugaaugaauauguguauacuuucuuuugguguagcauuauuggaucauaaguacauguguucaguacuaauguauacugccaagugauuuuucaaaguaguuguaaacagcaagaguaacaauuauuccacauccuaaccaacauuugaucaagucagucuuuuuaauuuuaaucaauccgauaggauucuaggaaccucagugugauuuuuaucuuuguuuucuugguguauaaugauguggaguaccuuuucauaugcuuuaugaccauuuggguauuuucuuuggagaaauacccauucaggucuuuuguccauuuuaaaaauuggauuaucuuuuuuuauaauuuguagaaauucuuuauacauucuggacacaaguucuuuauuagauguauguauugcacauaccuuuccccaaucuuuggcuuaccuuuucacucacuuaauaguuuccuugagugagcauaaauucuuaauuuuauugaagucaaauuuuaaauucuuuuuaugguuaguuccuuuuuguguccuguuuaauauaucuuuuucuaccucaagguucugaggauccauucugcauauuuacuucuagaaguauuauaaccuaacuuuaguuucuaugauccaucucuaauuuguacggguggugugagauagggggucaggggauuuguuuguuuuguuuugcauauggcuauucaguugacccaacaucauuuauauaaaggaccaucuccccaguaaauuguagccguaccuuugucauaaaucaggcaaaucuaucugugugagucuguuucuaggcuauuuucucuuuugcauuucucccuucuuaugccuaaaccacaaucuuaauuuuuguaacuuuauaguaaguauugauaucuggugucuaauccuccagcuuuguuuuucagauuugcuuuggcucuucuagguauuuugcauuucuguagaauccuuugcauuuucaagaaucagucacacacacacacacgcacacacacacacacacacaaccaacggaaccuucuggcauuuugauugggauugcauagaauccauaagucaauuaguagagaaauuauguguuaauaauauugcaucuuccaguaaguaaauguuauauaucuuucauuuuauuuagauauuuuuacauuucuguaagcauugguuuguaauucuuguugugaaggucuuuuacaucuuuaacuagauuauuuucaguauuugcuguucuuuggugcuacuguaaaugguucauuuuaaauggauuuucuaauuguuuucuaauucuaauauguuugaauucuaaguguagauuaaccugguauccacaacccuuacuuuuuaaaacacuuuauaaguuauguuuauaguuuuuguuugugucuuuuuuuucuuugccuuuuugcacugucugggaacuuaauuguacauaacauuuccuuuuuuauacuuaaauauucuuuuaaucauuuugauuauaaagcauaaauuacauauguaauuaccuuuuuaaauuaaguguuuauaauuacaugcaguuuuaugaaauaaucaauuccauguacucuuuacccaguuuuucccagugagguaacaucuugcaaaacuguaguacaauaucacaaacagaauauuggccuugauacagaacauuucuaucaccacaggaucucucggguugcccuuauagucacacuuacuccccuccuuccuuccauuccccuuccccauccuuagucccugccaaccauuggucuguucuccuuuucuauaauuuugccauuucaagaaaguuauguaagugaagucauacagaauguaaccuguucggauuggcccuuuuuacucagcuaaauucccuggagauucauccaagguguuguguguauccauaggucauuccuuauuauugcugaguaguguaucugauauagauuuacugccguuuguuuacccauucacuugaagaaggacaucuugguuguuucugauuuuuaccuguaaacauuuguguacagguuuuuaugugaucauaagucuuuauuuuucuggguuaaaugcccaagggugcaauuuuucacucgugaugauuaucaugguuaauuuuaugcugccauacucuucucuaaaguaguugucuaauuuuacauuccaucagcaauguaucuaguuugcguccucgccagcauuuuaguguugucacuauuuuuuauuuuagccauuaugauaaauggcaaaugauguugcacaucuuuucaaguucuuauuugccaucuacauccucuucagugaaaugucuauucauggcuuuugcccauuuucuaauuggauaguuuguuuuuacuauugaguuuugagagaucuuucuauguucuagauauuagucuugucggaucgauguuuugaaaaguuucuccaagucuguaguuuguccuuuuauccucucaggucuuucacagagcaaaaauuuuaauuuugaugaaaucuaauuugguuaguguuuauaugauauaucuuuuucuauccuuuuaucuuuaacuuaucuauuauauuuaaaguggauuucuucuugauagcauggauguaggucuuuuuaaaaaaauuaagucugaaaaucuuuuuauucauguguuuaaaccugcguuuaauguaauugcuaauaugcuucaauuaggcccaccauuuuacugcuuguuuucaauuuuuucaccugcuuauuuuuuucuucucccucuucugccuucuuucugguuaugucuaauuuuuuauauuuuaucuguugucuuuuauguuuuuuaaaugguuguuguagguauuacauuauaaauaccuaaccguucacagucuacuuagaguuuguauuguaccacuuagaguaaaauguaaagagcuuacaaccauguaggucucugcuuuccagaguuuuuguaugcguuacauccaccuauaucaaaauccucaaaaaggacuauaauuuuuuguacguuuauacauauuguaaagaacuugaggaaaaaauaaucuuauauuuacauaguauuuacuauuuuucuuuccucauuuuuaaaauugcaagauugcuuugauacuauuuuccuucagcccaaggaauuuucuuuaguauuucuuuuacaacagauuugcuagugauaaauuuucuuagauuuccuucacuugagaauauuauuuuccuuuaguucugaaggauauuuuugcugauacaguauucuguguugacaggguuuuuuguuuuuucauuuaguauuguaaagauuguucuacugucuucuggcaucugugguuucugaugagaaauuuucaguccuuuuguuuguucuauauguaaugcauuuguuucuuuggcugcuuucaagauuuuaucuuugucuguaguuucaaaugauuugauuauacugugcuuugacauaguucugcucauuuauuuuuucaaucuuuuuucucucauuuauucaaauuagaucauuuuuguugaucuguuaaguuuacugaaucuuuugucauguacagucuucucauccgugaauguuuuaucucagauauuacaguuuucaguucuaaaauuuucaugugguuuauuguauuuuaugagagcauuuuauuuuucuguuuauuuauagaguguuuaccucauagagcaugguuauaauugcuucuuuaaagucugauaauuucagcaucuaggucauaugacaucuauugauaguuuuuacccuugagaauuaguuuuucugguucuuugcauguuugguuauuuuagauuguguuggacauuuuuaguauuauguugcuuagucucuggggcccuguuacaguccucuguagaauguagauuucuuuuuuccuuuuagccaauaaccaacccacugagguucaaacugcaaacuuucuccuuguuuggaagaugauuccgaugucaguucaauuuucaaagccuuuacuaugcugucuuguguauacaccacucaguggcuagucugagacauaggagugguuuaaauuguaguucaguucuuuaaccuuuguuauacugcuuugagucuucccacucauacacagcucauauuagcuuauguugauucauacacagaauuagggaaucuuuuucucuacuuuucuccucucuggagggaucucugggauuccuccuguucucuuuagaccacaagagcccauuuuuggucuggccagaaacaugguguuucagaguuuuagcuuucugcacugccacacaguucuugcaauuggggucauccuucugguaaaaugggaagagaaaaagaggaggaaguauacuggggauuucucccacucucuucgggacugagggcccauuucccaguucucuagccagaaagacagauuucuaaugaaguuuuagcuacuggcacugucuacugccccagcucugcuaucacuuacucuaggugaacugugaaauaagaaggaaaaaagugaggguuuucagcccacacacauacucacgcucaaagggcccccuuuacccugaucuucugguuaaagacagucucccagaguucuaauugucugugugcaccaggaagugcccacccucagcucaaggccacaagaaaaaaaaaaacgggaaaaccaggaaacucacuugcauguaggucucuuucuucuucaggcguugguucucuuccacaaacugcuuuuuucucuuuacuuuucagaguucuuugguaauuguuuuuuguguuuuguccugaguuuuuauuuguaaucagcaggagauaggcacuuuaaugggcuuaugcuauccuggccacaauagaaguucucaagugguuuuuaaauaaaacauuuaaaauggcugugaguugcaucuccaucaucaguugguccauuguggaccagugguccacaauccagugguccaaugauugugauaaucaaagcauuagaaaucuguucugauauaaugucaacacucaguuucuaugaaagcagauuauuuuauugguugagauacuccuaauagcuuugaauaucuucuggguaucauuacucuccuuacuuuuuacauuacauuuacacauuucucucuguucaucuucaguaugcauucugaaaccaacaggacaucagagcuggacugugguuuucuuuaauuauucaagcuaaauuaccagaaaugcccuuuuaagaugaaauauuuagucgcuucaaaacaagucagguuggaggaagagggcagguuuacuuagcucauguuuuucauccuuacaagcaguauugauguuucaugcuagcaaacugugguagaagccuucgaguccuaaccaaaaacaauucuuucuucaaaacucccguaacacuuuaucaaaacucccauaacacuuuauuaaaagauuaaaaauguaaauccuaaggauaggguaacaagcacucuuaagcacuauugguuuuaguauaaauuucuagauguucacugaaacuuugugugugucuguguuuacauggcaauuugaugaacuaagcuaggaauaugauuuuucuggcucaaaagguaugcaaaagauuauagguauaaacacgugagagauauauauauauacauauauauauauaaugcauacccuuugaggcagaaaucacacuucuagguguaguucaucagauuggcugcuuauuuuagccaaaaaaugggggugggggccuucauaugcauuaauggaguacagauaauuaaauuacgguacaguuauaguuucuauaaaauggaaugcuaccuagccauuaauacgauacauauuauuaaaguggaaagcucuauaauauuaaauggaaauugaggcuacuaaauauaauacaucuucauauacgcuaauggaggacagauaauuaaauuauggcacaguuauagauucuauaaaauggaguacuaccuagccauuaauaugauacauauuauuuauuaaaauggaaagcucuguaauaguggaaauugaagcuaccaaauauaauugguauaaucucuuuuuauaaaagcuauagguauacuuauauugauauauggaggaaaauaauuuggaaggauagauaucaaaauaguuauagugaucauucucacagagccaagauuaagaauuaaaaaaauguuuuuuuguuuccuauuaaguauugccagguauuuuuuuaaaaucaugacuuauuuaauuugagcaagaguaggagggaccuauaucauguuggagaaaagauuucuacauucuaaaggguaaaagaacuagaaucuaugagaagaaggggcaggguguuacagaucacaguuccuuauauacaaguaaacuuuuaaacugugacuuuuuaacacuaacauuuaacagaccugacaguacaaaauggguugccuguagguaugaguuccacgucacuaaaaauguucagacguaagcuccaaagccauuugguaaguuuaucauggaaguaauugaagcaucaguuuuuuugacguuuugccuugggacucucuugguagaugauuuuaacugugugaaaagaugaaugaggggacuuagaaaagccuuucugauucucauuuccaaauucaaagagaauuauauuucaaccugcuuaucacuaagaagauaccagcauguuaaaauucacaugaaguaugaccuucuuuaaauacgcuacgaugcagcacccucaaaaguaaaguacagaaacugacaguagugguaucugucuacaguuuaucauuggugaauaaaugaagggaagaaggaauugagucuggacuugccgcauauggaaccaugaacuauacacauagaauguuguuuggggucacaaaguaguagauuaggccagugauuccuaaacccugcugaacuucagaauccaucuucagagcuuauagauauagacauauuacauauuuuaauagacucuuggguccugaucccacagauuuagauuaacuagcucuggaauagggcccagaaaucacuaucuuuaaaagaauucucaaguuguguugaugaucagccaaguucagacacgaccagaauaaaauauauauacguauacauaccuacauaucaggacaguuacaagaaaggagaaagcaaaauaaaguauuuugauaaacacaucaaguucuuuugaguuacugauauuuuaaaaagcugucucggugagaagcccauuaacauucuacagcuaagugaugcuacagccaguauuucugauguuucauucaguccauuaagcagagcugcuuaaaagaacuaguuuuauuuauuuauacauuuauaaucagguucaugaauacagucaacacuauggaaauucuugucaauaaaaaaguguuuguccacagacuacacacagaaauaaaauuauuagaccugcaucagucaccgucugagcuggucaugcccuuaaaggaaauuucaaggaagaugggcugaaguuggugagauaucugcugauguuuaagauguaagcaaggugguaucuuacucaugaucagguuaacaauaacacauacauugaacaguuugagaauuuugcaucuuuagcuuuauguccaaaugaugaaaaggggguaaggaagaaaugaugaaaagggggaaaugaugaaaagggggaaaaugaaggcaaccugcaaaacugauaaugaaaauagaacaugaaaguaacugucaucacccacuaacaaagcaccucaucuuccuaaauaacagagucagcccucuaagucagucugucauaagugccagauuuguuuucugaggccacuuuuggcacccgaauuccugaggucuagcuucaaaugagcauuuccuccacugccagaguccugcaggaggcuguagagauggaucccacagcuggucccugcacugacaggcaugcugucgccggcucaggcauugucuagggcauguccugcuuagaaugcucuuccccuagaaccugcacgguagggagcagauucccagaaacccuucccaucuuuguucacagccacuuucccaacaaggccugggaucaucuuauuuaaaacuguggcaccugugcuccccacccaccaccugauccacaucuuuuuuuccauugcacuuaacacuuuuauuguaaacccagaauugacuuguuauguuuauuguugaugucugcgcccucugcuaauuacagagcuuuauuugcuuuguccauugauguaagugucuagaauaguggcuagcacuuaguauauaaauauguguugaguggauggauaaguacaugauguauugauuguucgauuguucauuacuagcuauuuaugccacaucaggcaguuuucaguauagccuucaguauucacguaguuaaaaccaucccaaauauuuguguuugaacaacguugucugugaaauggaacugccuaggucaugagugcauuuuggaguucugcuguugagucagagcaugcuggcaguaguggcuccgcuuguagaagugaaaccuccugcuuauguuuuggccccaugagaucucauaagauuucccccaacauuuuuggcuuuacuccugaugcacacuuucauaucucuuaaagaucagccuguuggacguuauucuuagaacagugcuaagcacucagcaauuaaccuagucaaugauauguguugacugugggugugacccaccaugucuguugugauuuuuaacuucagaguaucuuaggaauuauccaguccagcucauuuuauacuucaagaaacucaggaaaccaagauuagguuaaucuucuaaauucacaguacuagcuagaggcagccccuucugggacaggaguccuagucuguuugguuucuuuuuuuuuuaaacccaccauauugcuaaaacagauagcaacaccagcuuccucaugcagugcagucaucuacugucaacacaggucuuggcuucuuucccuucagcgucucacccaucuuucuuaaggaggauccagauuucuccaaauguuaccuucauaugggacccuauucugucaccccaauccagagccuucuuagaaugccuuucccacaggggccaguauauucucucgagugcccgcuguuugggaaugcuugcuuuucugcuuuccuaggcccccaucaccauggauguucagcacagggacucuggagaagcaccugguuagugucugguggcugcuuuguuguuuuugacucccaucuuuuuugccugucucuuccuccagcuucacccucaacucgguuugcccucaggaguucuuuaccuccuuugaucaguuucuccggcuccuucuucacccuuuguggcuucucaaggccacaucacuagaguuaggaggggaaagaagcaagcacccuccuuuuaucuaguacuucauuuuuuucagcauuaucucauuugcccuuuacagcaacccuguguuaagugggaacagauacucuuacucccuuuuuacuaucaaagaaaugaaauacagauauguaaaggaaaugaucucauuggcagaacuggaagcagagccuccaaaucuggguguagaaucuuuucuacugucccaaauuuuaacagagagacaaaauuuaucaccgucugguauucugaaauguacauaauuuuucucaacaucguacucaguuuaaaaaucuucugaggauauuaauguggauuucucuagugucuuuagaaacuugauuuuagaaaaggccacugacaaguuagugauauaauaaacagguccucugauacugacugcauuuucaucuacauuuaccaguuauuaaaugcuguuauauguggaacuguguuugcaauauuuuauuuacuguuuugagaauuagguugaugguaagauuuauucaaauucuugauuuuaauaauguaucaauacaacuuaauaauuugauuuauuugcaaguuuugaaaauccacauauucuaguagauccugaacuuaacuaaaaguguaagaaauauuucacauauaaaacaugauacaggcugggugcgguggcucacgccuguaaucccagcacuuugggaggcugaggcgggcggaucacgaggucaggagaucgagaccauccuagcuaacacgaugaaacccugucucuacuaaauauacaaaaaauuagucgggcgugguggugggcgccuguagucccagguacucaggagacugaggcaagagaauggcgugaacccgggaggcggagcuugcagugagcaaagaucaugccacugcacuccagccugggagacagagcgagacuccgucucaaaaaaaaaauauauauauauauauauuuauauauuuauauuuauauauuuauauagauauuuauauauuuauauauauuuauauauauauuuauauauauauuuauauauuauauauauuguauuuaaacauucuuuaaaauauuuaucauuuaucucaacuaauagaaagugaucuuaucacuuuuuauuauucauagacagacugaaauuuguuuuaacuuaaauucaaccaauguuuuacuuaauuuuauuaauguuuuuaaguuacuccacugucaagcaaagcauuuuaaaguacacugugauguauauacuuucauaagaaaaacgaaauguaauuacauuuugcaaguaacacaaauuggaagcugacauuguccugacauggcuggcagugucugcucccugccaagcuucucuguauagccaaucaagagaguuuauaugcaaaguagcaaauacaugguguuuuguaaugcagcuuuauucucacugccacuugcccuccuagaggccaugggaugcacaaauuguuuguauguaagaguccuagaagauguuaaaaacccuugugucuuauguucagagcugucagcaugaucuaaggcccgaaaucguaagguacaguaguguacaguaaauuuauauaaaguccuuugauauaaauugaaguuguccaaauucauuuccuauaaaaugauaauauccaaauucuagguuugccuuugauguuguuccuuccacucauuuuuaaguuguuuucauguuucacauugccaaauggcacacuaccuggaguaugcccucuuguugagaccauucuuaguuugauauagugucaaagaaaaaaagugagaauguugggaauuugguuugcuuuacaaguuaggaugaguggagagaacccucuugacaggaugaagaaaucuguggaaguaucauagcgaacaauaaccaccugccuauuauccaguuuccugaaugauaaaaauugucuaugcauccugccucaaaggcuugaccauggggugguuuucucuucugacagauuuagcuguuuccagucacauuuguuaucacuuuugugcgaucuugcuguuuagcuccuuuaaaucagaaauacauucugcuuaugggaagacacacacacacaaacacacacacacacagauuuauacuaaaaucacaaaaaccuuuuaaaaugucuugugaaaauauauuagcuaucuuucuuagaacaaacauaaagaagaauaguaaauaaaugugcaguccagcaccaguguugacaucuguugugaaaugugcuacauggaguaaccauuguagagacaaucaucuuaggcaccaaaaugacuuaggagcuucuuucuuuguucuuucuuaucacuuacuauuuuuauuaguuuagcuuuuuccaaacguguuuacucagagauaccuauuuuaguuaggaagaaaaagagaaauaacaccaauuaaagcuaauugaggcugaauucuugucagucuuaaaagaauccuaauuguuucucuuugaacugacuaauccauaaaaguuuucugaagggauggggugugguuguauuugauagcuuccauuuggaugauuucuacuaccuuuuuucuuguuugagaacuauuagaacgaacaugaucauuuuuucaagcuggagugcgguggcacgaucucagcucacugcaaccucugccucccagguucaagcgauucuccugucucagccucccgaguagcuggaacuacaggcaccugccaccacacccagcugauuuuuguaugaacaugaucaauuuuauacacauagaacauaguaaaaugcugauaauuauaaguuguuuguuuacucauuguagcuauuuacugugugaucaacugugaaauuuugugcaacccucucucagaauggaaaaaaaagaggauuuagucugaguuucugagaauaauuuuccaaguauaucuggaaagguaaauugauuuuaaaggauauauaauugauuaauuaaaacaucauuucauaaaacucauuuuaucauccacugugagagcagcuucaaaugcccucagaucuaaguaucaagccaagugguacaaaucauuuucaugcaacugaagauaccauuuauguuggaauagcccccaaaaacgaaaauacacgugaccuguuuaacuuugugcuaacuguuacaauguauguguguuuuguuuauucucucauagguaugagaaagugccagucaucuugguugggaacaaaguggaccuggaaagugagagagaaguaucguccagcgaaggcagagcccuugcugaagaguggggcugccccuuuauggaaacuuccgcuaagaguaaaacaaugguggacgaacucuuugcagaaauugugaggcagaugaacuaugcugcucagccugacaaagaugacccaugcuguucugcauguaacauacaauagcauccaaauauggcuguccuggaugggauuugcccaaugucguaggugauagaaaacucgccuacuccacugcagaacuugcagaaugcgugguguuaaucuacagagaacugcagcccuuauucagaauugagcagugauugucaguugauaucucugaguaacauuuggguucaguaacuacaguuuucaccauuuguccucagucuccuuuaugcaucugcaacuuuaaggcauaguccaucgaucuacagggugaucucauuugaaagcuaugauggcauugucgcugaguugacagaagcaacuauuguacaaauuaaaaauaaccauaagggagaaaccagaagaauuccucugaccacuuacaauuaaaauauuuugucuucuuuaaaaaaauaaguaaaggagaaauauuuuccuacaagaguacugaauuucaggaaaugggauagagcuucuaaccaauguauuccgucaaguaagauaauaacagcugaccugccaacagcauuacagggagauucuuugcucagcuaacacauuucuguuuuucaaaauugaugcuuaauuguagcuguuauucuaauuugugacauggaacuaacucaugcuucaauccuugauagagcaaaacucagaacagguuauguaaaaauauagucuggcuuuagaauuuguuaauucaccugcuuugccacagaaaauggaggcuuucacaaggguuugaucagaauuaaaaccccaaacccgcccucuguuagggguggucuuuauaacuuuacugaacaagagggaagcaacugugaugggaagagauuaccuagccuuacuaacaagaagcauucuaauagauaaacuaguaccaucauguaaggaagaugaagccauguugcauccacauguucccguuugcagaaaccucacaggacaguacgaauaucuggcauuuuuaaguucauuaaagcagcaaauuccuucucgccuuuaagggcuaugguuguagugugacccguggcuaaccugcuuucaaaaucaaguauuugcuguagcagagcuuuauugcaggcauuuuaaaaauugaauaaccaugugaaauaauuugggcuuaaaagugaacauaaauuauagaguggaagguaagggacaaaagccuuuuaccuuuaauuuuccuggagaauuauauaaagguuuucuuagaacaauuuugcccugauuacugaagcgucaaauaaagcuggagugaaaauuuuguuuugaaaaggugcucaagcucugacauuuuugguuuucauagucgugaaguauuuaucauuugcaugacuaauggcacaggaaaaaccuauucauaaguuuuacaaucaaguauagaggggucuucagcuaacuuaguuauacauaaaugcugaaaagauuaucuugagcugggccuugggagaagaauuuggccuucagaacugcaauaucacugagccugcgaucuauacaccaccccacauuuuguugguuucacagucuugugcaaguaaccucuggucuuacguguguaacugagagaagaguguguguuugugugugcauguguguuuauuguuccuaagaauuuggcacaagucagagauaauugccuauacuaagaaucuauacugcagaauauaguguaucaaaaacuuuuuucuuuuaaauuauuaaagugucuuuuauacuuuuaugaaaucauugguagccccccaaguguuuaauaacuggcauuaagcuuagagggugaaaaaaaaaaaaaagauugauaguauuuuucauaaugaaaaaacugaagagauacgugaaugaaaccaggccauagcugucauaaaucuuugacuuuugaauauuuacauucuucaguauaauuuuuuauaauccucaauuaugaaccaccuuguuuauaggacaaaaaaauuuaaccaauuuuauugaaacgaauuucacuguguaaaaguugguuugauucaaacauguagagaaguuguagauucaagauauaugauuucucuauggaaauaaaaauauuuguuagugaauugguugaguuuugauuccucuaacuucucagaaugauucuuuagaauucuauaauucauagcaauuuuugacaaguaagauugcaaaauagaaauaucuauaaagauuccacaguuugacauuauggcuugcuaugcagaugugaaaauagguuaaauaauaugaaagauauggcagaauguaaaguggaaaagaugaccuaaaauuuugaguuguauuaauaguuaaaaacauuugugucagaugacagggugggcuuuuacugucaagacaugaauaagaacugaucuggcugccugaugaguguuuccacgcagcccugcauauuuagugaccaaggcaucaaggacaucccgaaacuggaaauucauauccaucugguaugaauauauaacucagcuggcaaaugaauguguuuguugagauauuacaguaauaaaacacuuaagaacaggaagauuacauuuguuggcauacgaaaccuuaguggcuacagaagaaaguugaccuugugucacuauuuauuuuaugcccugaucagacuagcaacuuagauaagugaaaguuuuucuaacaugccuuaaaaauauuaugguuugauccaaagacccacuuuuucuuuagcucuugugauaagauuuucuuuuuuuuacuuuuauacaaaggcagcaucuuugaauuuuuuuuucuuuugauguugcaacuuuuggguucuuuuaaacugugauagugaugguaacugaugccuuucauuuuguucaacuuauacaaaacaagccagcaucugaucaaaaguauuacauaaaauauuuucuuaaacuauugaaaggugcuuugaugauuuucuccuuugguuuguagaauuaggacugaacuuuugacucaaauugcuacaguugccaucaccuuucugugguaauacuacugauauuugcuuuucuauauaaagaaauguugccuaaggcugucugguauuucuuuucaaggguuuuccaguaugaauguuaauguugucaguguauguaugaauaugaaagugcuuuguuuuguuuguugcuguuuuuuguuuauguguguguuuuuaauuuuuuuguucuuaucagcagucuuguguuagcacuggguaagcuuuaauugucccuuagccaaucaaacauuaaggacuauggaggucuuuuuuuuuuuauuuaacaugucauuguucaucuauuaaaucuugaucaggguuucaagaaugacugcaguggguuuuggaaacagacuuaucauuauugauuugagguuucccagagauauaguucacaguuaauuguugcgcucuaauacaacugaccauuuaaaauugaacaaguuuauuguuuuguaacaaugucaguuguuaaaccuugacauuucaauuaaaacaugaauuguaguuauaacucaaugcaaauucaacaguuguauuuggaguuaaauuauuuuaacaaauaaauuuauuuaaugaaacucugg

SEQ ID NO: 17710 - RNA, 707 nt, Homo sapiens
caugaguaugcucaggcuucagaagaggcucgccucuaguguccuucgcuguggcaagaagaaggugugguuggaccccaauaagaccaaugaaaucgccaaugccaauucccaucagcagaucuggaagcugaucaaagaugggcugaucauccgcaagccugugacgguccauucccgggcucgaugccagaaaaacaccuuggcccacuggaagggcaggcacauaggcauagauaagugaaaggguacagccaaugcccgaaugccagagaaggucacguggaugaagagaaugaggauucugcaccugcugcucagaagauacugugaaucuaagaagauugaucgccacauguaucacagccuguaccugaaggugcaggggaauguguucacaaacaagccgauucucauggaacacagccacaagcugaaggcagacaaggcucacaagaagcuccuggcugaccaggcugaggcccgcaggccuaagaccaaggaagcacggaagcgcagugaagagcgccuccaggccaagaaggaggagaucaucaagacuuuguucaaggaggaagacaccaagaaauaaaagcucgccuuuugucuguacauacuggccuccgugaauacauagaucagccauuaaaauaaaacaagccuuuaucugcuugccaaaaaaaaaaaaaaaagauaaaaaaggaaaa

SEQ ID NO: 17711 - RNA, 465 nt, Homo sapiens
gaccuucagcuggccauucgggaugauggacuuuccaucccagaaccauggcuccauuuguccguaaccuuguggagaagaccccagcacuggugaaugcugcugugacuuacuugaagccucgauuggccgcauuuugguacuacaccacgguugagcugguuccucccaccccugcugagaucccuagagcuauucagagccugaaaaaaauagucaguagugcucagacugguagcuucaaacagcucacaguuaaggaagcuuugcugaacgguuugguggccacugaggugucgacgugguuuuaugucagagagaucacaggcaagcguggcaucauuggcuagaauguuugaagaccagucuuaacaucugauuauauuugauuuauuauuugaguguuguuggaccaggugugaucagacugcuaucugaauaaaauaagauuugucagaaauucca

SEQ ID NO: 17712 - RNA, 1643 nt, Homo sapiens
ugccgcugccgccgccagccccaggcgcaucuggccguugagcgggugcggguggccgccuggggcccccggcgugucgugcagcgcggggaagagcgccgggccgccgcugccguccgggcccgcguaggugccgcuggcggagaugaacaugccggccgaguggggaggcggggccgggugcuggggggagccggugccggaccgcugcuccccuccgagcggggccccgugcauggccgccgcgggggccguggcggaaaggucccuccggaggacgaagucccugcuguggccuuugccgcugcugccgccgccgccacuguugguggugguguagcccgagagggcaggaggaggaggaggcgggggagggggagggggugaaggggugggaggaagaggaggggcugggggcgggggcgcggagggcugcgcgccacugcugcccccgccgcagggguagcugcccgcgccggggugcgcgaccaaggcugcagcacgggcggcggcugccggagccuccgggugugccgggaacgccugggagggagggcugaggcccagcgugcucgccugggccaugugcucggguccgagcggagugguggccacgccggggucagcgcccaggucccgcaggcggaggugcgcgacggcggcccggaguugggagugggcgggcgggccggccagcgccgggaagccugucauauucugaagcggcuggaccugagccguugccaaauccgcuaaucucagcgcuggcggguuccucuugcucaaagggggcuccaucagaacuacacaaucaggcccauagacccucacuggggggacuuuauucccucugcccgccuucaaaaacauguauguauugggcgcucuuuaacuucuuuuguccuggccucuuaacucugcuuauuccuguucccacucuauccuccagcgauuggcagagugaacaccacauuugagcugcacagugggaccgagauuuuggaaauggcacgggugggauuggagggagccgcgugauuggcaguagccucggcugcucgauuggcucccguucaggcccucgacccagcggggauucgcccccgugcuugcggccgccugcgcuuucgcuucgcgcccccuccuccgcuggagccacacguccccgccuccccggggaugcccaaguugcacuugcagaaaguuugagccuggccugcgcgcgcagcgccccgcucuuccuugacgcaccucgcggagcgcgcgccggcacgcgggcagagggcgcgggguggugaggggcugaggacccccgaggggcagucccaguuucaaaaaccuuggccucacuucucugugugccuucuggcacccaaguacuuucugccucuaccuccaccucucuugugggguggaagagcccugggcugcuguuugggagagaagggugaauagcccguccuaccuguaguggugaugcuagaaacuucuuguuuggacacccaaccugccuagcgcucaccuagggcgcauagacaguagacggagugaagaagauaaagucuauugguugcaagacaacuugagugauuuggcuccgcgaaacaccaggugaagucaaaauaagucuuucccccaaagga

SEQ ID NO: 17713 - RNA, 4897 nt, Homo sapiens
agugacacguugauggauuuacuuguguaagcaauaugguugacauauggcacuguuauuuaugaaugacagcauaaauuguauuacaaagucuauugcaauaauacugcaguuuauuggaaagcugcucgccugucaucuguauucaaucucucuggauauaguucgccugggagcccaaaggauaggucuucagaauaauuaaacacauucacguaagcuaaugccuccuauuuuuuguuguuugguuuuguuuguuuuucagcaguagaaucacucccaucaggaaggagaagacaaguaaggacaauuaauucucuuccuuuuggaaaaccacaaccacugacuaucaccauugcagggguaaaggccagggugguugaugucuucuauuuuuucugagucccuuuugacaaauacacaaauauuuacaucccuaucacuaaacugcuggugagcacauauuuuauauggagacuuuuuauaagcccaguuacagaacaguaaauuuuaacuguaggaagaaaagacauucuuuuagcaaacuagagagggccuuauccuaucacaaccucauucagcacccccacuucuuaaaaaugguauuuaaaaguuacaacauuggcugagauuuucacaauuuccccuucuuuuacauuacacuucucuaaagcacuaacaaagaacuuuuguucuagguggauuuuauagagggggcucccgcaccacacaugugguccuucaugggucaggggucacccagcccaggaguggcugagaaggcggaaucaaaggugccuugcaacuuaauauccuguugaugaucuuguugaauuuaugagucugugauacagaugauggugcuggaauccuaugaaauccaccccccugcuuuuuuuuuuuuuuuuuuggucacuuguuucucuaauuucuucucucaacucuuucccacuacccccguuuccaccuucuuccuuaagaggaaaauuacaaguuugagugguguggcaaccgagagcuucugcuuuucaauguaaaggucaauucuguuugcuuguucuuugacuucuccuguccagcaauguauaccuauuugugugugaggguauagugugugcauacacgcuauauuuaugcauagguacacaaaacacaccccauaccacaaaagaacucagucaacacuguucacagaggcccacaaaccgcaacgaggugcuuugguugaugggcgcucggguguuuggcgggauuuucugguuuuugaagacaaccccaauucuccaucgcgcugccauucccucuacuugccgagaaaugaacacuggcccccgcggcccugagcuggauccgcucaagccccggccugccgcccagucgcacgcagccuccguaagauuucggaagcauaguuuugggaaauuuacaaagaggggacuuguuugccggauggagacaguuguggguccugcggcccugacacugccacagacgggcccuuccagaaaccuguugaaaaacugaauucacucacacugugcauaacgccgcuuggccgcuuuuuuccuucagccaaggaacccgagucuacuuuuaaggcaguaacucugaaagccuuugcaugcuuuuuuuuuuccccuuggucucucuagcucucucuucacuuuccuuccuuaaaaaaaaaaagucaugaaguaaagggguuuugcgguuuguagagaaauaaagcacuucugagaagggacggcgacgugacuuugaacuuggcucagcucuucugugcccugcagagagaggagaacuagagccgggaaagaauagccaggagcgcccaacccguagggucuccggcgggaauuaaggcguccgccccaccgcccggccgcgcgcggccccuggaauccggcgcgagcgagcgcccagccgcgcgauccccaaacgcgggagcagcaaaggcgaaaucaaagcgaaagagagaaugggucaaagaggagagggagggaggacuggggaggggguaagacagugggaaaggaggaaaacuucgaagucugauggccugaaagaaggaagggaagugaggucucugcaugugcaggucugcuauucucauaaccaaucuccaagaaaacauuuuccuucggaaauauuuuuggaguaagcccuuccaaauacucuccucucgugcucgccucccauucccauaaaaauugaugaauaaagcaaacaaguguguaguacaaaaauugcacuaggcaauuuuuaauggauucaacguggcagggcagccuuucugccaaagauguucucuuuucucucugcgucuaugucucaggucccuuuaggucuagggggccaguuuggcuagugcccuccgcccccuuuuaugcacagagagagggguguggaaaugggaacguuuccuccuuucagggaaggugagaaucuccaucuuccaggcaaacugccuugcuuucagacaggaugccacagccugccuccuucuugcacccccaccccacccccaggacagggaagaaugggacggagggagggcacagggcuccuuaugcaaggggcugcggccagcgccaaccugcagagacucgcuuaagccgggagaggcugccugagccggcgcaagagagcccggguucugccagccauagugagcuagaggauucuucccgcguuuuuguuuauuucauuucagaacauaauucugaaaaauuuauuauuuucucuucguuuaauuuuauuucaacuccuagagauuuauaaauaaaagcaguucuccaggccagccaggagaacacgcccgaggcgcuggccucaggcugucccuucacaccuccgcagccucugggcccuccguucccucucuaguuaccucgggagcgcgagauuugggcggcgggacaggaaacguccgcagcggucagccaggcgcggcgccgggagcggccucgccgcugggccaccgcccgggugguacucccugcuccuggagaaggaguggauggauauauaugcuuucuagaagguuuaagcccugccgugucugacggcuucuucucccgagacccugagccugacccgcagccaaacuccggccugagucucgcuuggucucgggcguucccacacuucucagcccaaggaugcgcggcccggcuucugggcauuuacccugagggugacacugucuuuaaacgacuuccgaacaacccccuuccacgcaggggccgcugcccaguguuuacugcuguaaacggagcaggacgcaagcggcggguggggagcucagcgcgccgaggggcggacggggacgccgcggggggcggggaaggcggugucugggugggcguccggagggugggaagaaggggcaugccuggcuuucucugugcccacgguccugcaccugugguuucaaugccacagagcaaguuuacaaaggcggggugaaaguagggagcgugccaagcgggcagcagaccagccccccgccgcuccuuguggcgcgcucccggcgaggccccgggccugaaauguccccgcgcgcagagccuccugccaggcgacccagcuguuagccaccucucgagcggccuggagugcucgggccaggcguccccgggguuuucgguguccgcugggagcugcucagaucccggggaagucgguggccuacgcagaaagacuggagcgcuggguugccucccauuccugacccggcugagggcgcccugaccccgcggcccgggcccgcguccgagccacgcuggacgcccggcucccgggagcgccgcggucggccaggacuagaagccgcggcgccgaggucucgggagaagcgcggcaggauggcaggccgggcccacgggcacguucggcggcugccugagccggcagcagcucagggagcgcgaggacugaggggcgggcccggcagcggggcgggggcgcgggacugacuaggccgcggcggccaaucgcggcgccgggagggcgggcggggcgggagccgccguuaaaggggcgguuugaccgggggggcccggccucgagcuggagggagggagggaggccggggcgggagacuagggggugcggggggaggggagaggaaaaggaggagacaaaaaauaaaaaauaaaaggcugccgcugcagcguuggcggcgcccaucgaaaucaacggaggcgguggcgaacgcagcccaccgcagccgagaccugggagcccgccugggccucacacucccucgggucgcggacugcgcuggguccacgcggcgcggucacuaguuccgggcccagcgcccaggcccgaccggcgggagggaggaggcgagcgagagaucacuuuuuuauuguuguuauuguuuuucagcccagccucccccuccuccccucccccugcucgcuuucuccccucccacaucccccuccccccuacucccccgccuccuccuccggcacaacuuaaagaaagggggagcggcgcggcugcugccuucaucuggggaaauucguggccacugcaaguuuacuacgcgaggcgcagccaaugccaagcgccgaggccgaggagggcuaaacacugcggccgcggcuccgaacaauaaccgccgcgcgcggggcggcgcgaguagggccgcgggggagggagcugucgccgcagagcgccgcggagaggacgccuggacuccgccugccgccccggcgcccccgccgcggucagguggagccgcuggugcgcuggccccgggugccgagcgcggagcucgccucgguccucuccucgcccgucugccuggcgugcgcacggccgccgcgguugugacugcauucuaccggcgcugcucggugcggccgggcuccggguccgcugg

SEQ ID NO: 17714 - RNA, 4897 nt, Homo sapiens
ccagcggacccggagcccggccgcaccgagcagcgccgguagaaugcagucacaaccgcggcggccgugcgcacgccaggcagacgggcgaggagaggaccgaggcgagcuccgcgcucggcacccggggccagcgcaccagcggcuccaccugaccgcggcgggggcgccggggcggcaggcggaguccaggcguccucuccgcggcgcucugcggcgacagcucccucccccgcggcccuacucgcgccgccccgcgcgcggcgguuauuguucggagccgcggccgcaguguuuagcccuccucggccucggcgcuuggcauuggcugcgccucgcguaguaaacuugcaguggccacgaauuuccccagaugaaggcagcagccgcgccgcucccccuuucuuuaaguugugccggaggaggaggcgggggaguaggggggagggggaugugggaggggagaaagcgagcagggggaggggaggagggggaggcugggcugaaaaacaauaacaacaauaaaaaagugaucucucgcucgccuccucccucccgccggucgggccugggcgcugggcccggaacuagugaccgcgccgcguggacccagcgcaguccgcgacccgagggagugugaggcccaggcgggcucccaggucucggcugcggugggcugcguucgccaccgccuccguugauuucgaugggcgccgccaacgcugcagcggcagccuuuuauuuuuuauuuuuugucuccuccuuuuccucuccccuccccccgcacccccuagucucccgccccggccucccucccucccuccagcucgaggccgggcccccccggucaaaccgccccuuuaacggcggcucccgccccgcccgcccucccggcgccgcgauuggccgccgcggccuagucagucccgcgcccccgccccgcugccgggcccgccccucaguccucgcgcucccugagcugcugccggcucaggcagccgccgaacgugcccgugggcccggccugccauccugccgcgcuucucccgagaccucggcgccgcggcuucuaguccuggccgaccgcggcgcucccgggagccgggcguccagcguggcucggacgcgggcccgggccgcggggucagggcgcccucagccgggucaggaaugggaggcaacccagcgcuccagucuuucugcguaggccaccgacuuccccgggaucugagcagcucccagcggacaccgaaaaccccggggacgccuggcccgagcacuccaggccgcucgagagguggcuaacagcugggucgccuggcaggaggcucugcgcgcggggacauuucaggcccggggccucgccgggagcgcgccacaaggagcggcggggggcuggucugcugcccgcuuggcacgcucccuacuuucaccccgccuuuguaaacuugcucuguggcauugaaaccacaggugcaggaccgugggcacagagaaagccaggcaugccccuucuucccacccuccggacgcccacccagacaccgccuuccccgccccccgcggcguccccguccgccccucggcgcgcugagcuccccacccgccgcuugcguccugcuccguuuacagcaguaaacacugggcagcggccccugcguggaaggggguuguucggaagucguuuaaagacagugucacccucaggguaaaugcccagaagccgggccgcgcauccuugggcugagaagugugggaacgcccgagaccaagcgagacucaggccggaguuuggcugcgggucaggcucagggucucgggagaagaagccgucagacacggcagggcuuaaaccuucuagaaagcauauauauccauccacuccuucuccaggagcagggaguaccacccgggcgguggcccagcggcgaggccgcucccggcgccgcgccuggcugaccgcugcggacguuuccugucccgccgcccaaaucucgcgcucccgagguaacuagagagggaacggagggcccagaggcugcggaggugugaagggacagccugaggccagcgccucgggcguguucuccuggcuggccuggagaacugcuuuuauuuauaaaucucuaggaguugaaauaaaauuaaacgaagagaaaauaauaaauuuuucagaauuauguucugaaaugaaauaaacaaaaacgcgggaagaauccucuagcucacuauggcuggcagaacccgggcucucuugcgccggcucaggcagccucucccggcuuaagcgagucucugcagguuggcgcuggccgcagccccuugcauaaggagcccugugcccucccuccgucccauucuucccuguccuggggguggggugggggugcaagaaggaggcaggcuguggcauccugucugaaagcaaggcaguuugccuggaagauggagauucucaccuucccugaaaggaggaaacguucccauuuccacaccccucucucugugcauaaaagggggcggagggcacuagccaaacuggcccccuagaccuaaagggaccugagacauagacgcagagagaaaagagaacaucuuuggcagaaaggcugcccugccacguugaauccauuaaaaauugccuagugcaauuuuuguacuacacacuuguuugcuuuauucaucaauuuuuaugggaaugggaggcgagcacgagaggagaguauuuggaagggcuuacuccaaaaauauuuccgaaggaaaauguuuucuuggagauugguuaugagaauagcagaccugcacaugcagagaccucacuucccuuccuucuuucaggccaucagacuucgaaguuuuccuccuuucccacugucuuacccccuccccaguccucccucccucuccucuuugacccauucucucuuucgcuuugauuucgccuuugcugcucccgcguuuggggaucgcgcggcugggcgcucgcucgcgccggauuccaggggccgcgcgcggccgggcgguggggcggacgccuuaauucccgccggagacccuacggguugggcgcuccuggcuauucuuucccggcucuaguucuccucucucugcagggcacagaagagcugagccaaguucaaagucacgucgccgucccuucucagaagugcuuuauuucucuacaaaccgcaaaaccccuuuacuucaugacuuuuuuuuuuuaaggaaggaaagugaagagagagcuagagagaccaaggggaaaaaaaaaagcaugcaaaggcuuucagaguuacugccuuaaaaguagacucggguuccuuggcugaaggaaaaaagcggccaagcggcguuaugcacagugugagugaauucaguuuuucaacagguuucuggaagggcccgucuguggcagugucagggccgcaggacccacaacugucuccauccggcaaacaaguccccucuuuguaaauuucccaaaacuaugcuuccgaaaucuuacggaggcugcgugcgacugggcggcaggccggggcuugagcggauccagcucagggccgcgggggccaguguucauuucucggcaaguagagggaauggcagcgcgauggagaauugggguugucuucaaaaaccagaaaaucccgccaaacacccgagcgcccaucaaccaaagcaccucguugcgguuugugggccucugugaacaguguugacugaguucuuuugugguaugggguguguuuuguguaccuaugcauaaauauagcguguaugcacacacuauacccucacacacaaauagguauacauugcuggacaggagaagucaaagaacaagcaaacagaauugaccuuuacauugaaaagcagaagcucucgguugccacaccacucaaacuuguaauuuuccucuuaaggaagaagguggaaacggggguagugggaaagaguugagagaagaaauuagagaaacaagugaccaaaaaaaaaaaaaaaaaagcagggggguggauuucauaggauuccagcaccaucaucuguaucacagacucauaaauucaacaagaucaucaacaggauauuaaguugcaaggcaccuuugauuccgccuucucagccacuccugggcugggugaccccugacccaugaaggaccacauguguggugcgggagcccccucuauaaaauccaccuagaacaaaaguucuuuguuagugcuuuagagaaguguaauguaaaagaaggggaaauugugaaaaucucagccaauguuguaacuuuuaaauaccauuuuuaagaagugggggugcugaaugagguugugauaggauaaggcccucucuaguuugcuaaaagaaugucuuuucuuccuacaguuaaaauuuacuguucuguaacugggcuuauaaaaagucuccauauaaaauaugugcucaccagcaguuuagugauagggauguaaauauuuguguauuugucaaaagggacucagaaaaaauagaagacaucaaccacccuggccuuuaccccugcaauggugauagucagugguugugguuuuccaaaaggaagagaauuaauuguccuuacuugucuucuccuuccugaugggagugauucuacugcugaaaaacaaacaaaaccaaacaacaaaaaauaggaggcauuagcuuacgugaauguguuuaauuauucugaagaccuauccuuugggcucccaggcgaacuauauccagagagauugaauacagaugacaggcgagcagcuuuccaauaaacugcaguauuauugcaauagacuuuguaauacaauuuaugcugucauucauaaauaacagugccauaugucaaccauauugcuuacacaaguaaauccaucaacgugucacu

SEQ ID NO: 17715 - RNA, 1551 nt, Homo sapiens
uggugcuggaauccuaugaaauccaccccccugcuuuuuuuuuuuuuuuuuuggucacuuguuucucuaauuucuucucucaacucuuucccacuacccccguuuccaccuucuuccuuaagaggaaaauuacaaguuugagugguguggcaaccgagagcuucugcuuuucaauguaaaggucaauucuguuugcuuguucuuugacuucuccuguccagcaauguauaccuauuugugugugaggguauagugugugcauacacgcuauauuuaugcauagguacacaaaacacaccccauaccacaaaagaacucagucaacacuguucacagaggcccacaaaccgcaacgaggugcuuugguugaugggcgcucggguguuuggcgggauuuucugguuuuugaagacaaccccaauucuccaucgcgcugccauucccucuacuugccgagaaaugaacacuggcccccgcggcccugagcuggauccgcucaagccccggccugccgcccagucgcacgcagccuccguaagauuucggaagcauaguuuugggaaauuuacaaagaggggacuuguuugccggauggagacaguuguggguccugcggcccugacacugccacagacgggcccuuccagaaaccuguugaaaaacugaauucacucacacugugcauaacgccgcuuggccgcuuuuuuccuucagccaaggaacccgagucuacuuuuaaggcaguaacucugaaagccuuugcaugcuuuuuuuuuuccccuuggucucucuagcucucucuucacuuuccuuccuuaaaaaaaaaaagucaugaaguaaagggguuuugcgguuuguagagaaauaaagcacuucugagaagggacggcgacgugacuuugaacuuggcucagcucuucugugcccugcagagagaggagaacuagagccgggaaagaauagccaggagcgcccaacccguagggucuccggcgggaauuaaggcguccgccccaccgcccggccgcgcgcggccccuggaauccggcgcgagcgagcgcccagccgcgcgauccccaaacgcgggagcagcaaaggcgaaaucaaagcgaaagagagaaugggucaaagaggagagggagggaggacuggggaggggguaagacagugggaaaggaggaaaacuucgaagucugauggccugaaagaaggaagggaagugaggucucugcaugugcaggucugcuauucucauaaccaaucuccaagaaaacauuuuccuucggaaauauuuuuggaguaagcccuuccaaauacucuccucucgugcucgccucccauucccauaaaaauugaugaauaaagcaaacaaguguguaguacaaaaauugcacuaggcaauuuuuaauggauucaacguggcagggcagccuuucugccaaagauguucucuuuucucucugcgucuaugucucaggucccuuuaggucuagggggccaguuuggcuagugcccuccgcccccuuuuaugcacagagagaggggugugga

SEQ ID NO: 17716 - RNA, 1551 nt, Homo sapiens
uccacaccccucucucugugcauaaaagggggcggagggcacuagccaaacuggcccccuagaccuaaagggaccugagacauagacgcagagagaaaagagaacaucuuuggcagaaaggcugcccugccacguugaauccauuaaaaauugccuagugcaauuuuuguacuacacacuuguuugcuuuauucaucaauuuuuaugggaaugggaggcgagcacgagaggagaguauuuggaagggcuuacuccaaaaauauuuccgaaggaaaauguuuucuuggagauugguuaugagaauagcagaccugcacaugcagagaccucacuucccuuccuucuuucaggccaucagacuucgaaguuuuccuccuuucccacugucuuacccccuccccaguccucccucccucuccucuuugacccauucucucuuucgcuuugauuucgccuuugcugcucccgcguuuggggaucgcgcggcugggcgcucgcucgcgccggauuccaggggccgcgcgcggccgggcgguggggcggacgccuuaauucccgccggagacccuacggguugggcgcuccuggcuauucuuucccggcucuaguucuccucucucugcagggcacagaagagcugagccaaguucaaagucacgucgccgucccuucucagaagugcuuuauuucucuacaaaccgcaaaaccccuuuacuucaugacuuuuuuuuuuuaaggaaggaaagugaagagagagcuagagagaccaaggggaaaaaaaaaagcaugcaaaggcuuucagaguuacugccuuaaaaguagacucggguuccuuggcugaaggaaaaaagcggccaagcggcguuaugcacagugugagugaauucaguuuuucaacagguuucuggaagggcccgucuguggcagugucagggccgcaggacccacaacugucuccauccggcaaacaaguccccucuuuguaaauuucccaaaacuaugcuuccgaaaucuuacggaggcugcgugcgacugggcggcaggccggggcuugagcggauccagcucagggccgcgggggccaguguucauuucucggcaaguagagggaauggcagcgcgauggagaauugggguugucuucaaaaaccagaaaaucccgccaaacacccgagcgcccaucaaccaaagcaccucguugcgguuugugggccucugugaacaguguugacugaguucuuuugugguaugggguguguuuuguguaccuaugcauaaauauagcguguaugcacacacuauacccucacacacaaauagguauacauugcuggacaggagaagucaaagaacaagcaaacagaauugaccuuuacauugaaaagcagaagcucucgguugccacaccacucaaacuuguaauuuuccucuuaaggaagaagguggaaacggggguagugggaaagaguugagagaagaaauuagagaaacaagugaccaaaaaaaaaaaaaaaaaagcagggggguggauuucauaggauuccagcacca

SEQ ID NO: 17717 - RNA, 2098 nt, Homo sapiens
auguauggccaaaccuccuuauuauuauuuuagcuuucuagggacgagaaugaauacaaaugguuuuguggcccagaucucaaauuaaagcccagaccucaacccucuuacugucuuuuuuugccagaagcagcacuaacccucauucuaacaaggagggagggaugucauagcaaugucacagcagcagacacuuugaaggagaaagaccagaaaggaaaaauggagaaaggauaggaggcugaaaggaaaagacagaaaaacaacuccagggcugggcacgguggcucacgccaguaaucccagcauuuugggaggcugaggcagguggaucaccugaggugaggaguucuagaccagccuggccaacauggugaaaccgucucucuucuaaaaauacaaaaguuagccagguguggugucgggugccuguaguuccaacaacucgggaggcugaggcaggagaaucauuuaaaccagggaggcagagguugcggugagccgagauugagccacuauauacacuccagucugggcgacagagugagaccuccgucucaaaaaauaaaaauaaaaaauaagaaaaggaacuccaaaauacugaguugaguauagacgcucuaguauagaaacugcagaccacuggaccgucucucacgaacuggucaaacuccuccugggcuuuccuagacagggguggggacagacucacagggcugagcugaggacagagccccaccaggcgcugucagggcgguuucccgaccacacgucccuguccaaaaacaaccgcacagcaaauguggcuaugccaaguccuucagguaucaguuaaaucuccuccucuucuguaugaauuuguauuauuuauaagacacuugacacacguuuaaacacuuacauuacuccugcgacucaggaaauagagcuuguucagcugagggaaaaaaagcauguaaugagggaguuaacaaggacugauauuuuuuuacaacauucuuuaaaaacugaaaaaccucuuuaaacaccaggaacagcuuaaauaauucacuguaggccuaaggggccccuguggacguuucccccgcgggucccuuucuggccucggccuccccgacugucauccgccaaggugggcccggagggcgacgggcuccaggccucggucucagcgguccuccggcuuccgggacccacaggggcccugggcugggugggggccagccggaccuggggaggccggaccccggaaguggguagaggcgggccgugccuuuugaccccugggugcgcggaaagucgguagcaggcggaagugcggcccucgaggcggucgcggccugucggggcuuggagcgaauggcuccaaggccgcaggcugggccugggccgcagccgugggaagccgacgaugccugaggcgcucuguccucggcccacccuaggaacuuguaugaccgcaggaaaggaucaggagaggccgcugcccgucucccaccggcucuaggcucccucggccgaccgauguggggaaggggaaggggcccgcgccgaggcucuaggggaggcuccuaggccggguucucugacuuaaggcccucuuggcugugguuuugcgggagugaguugagggagcugcauucacucaagucccucacaugcccgagggcccgggaaucgugaagccgggccugcggacccggugggaggaaggagugcgaagcgcggccgccgugcucggccggcgccgggcuaggucgggcgguggggaccgcgccggcauaggacaacgcgguggagggaagcaccugcccccgcccaccuugacucagggccgccgcgccccuccugggccauccgcgcgggggucucaggauggcgaaacccgggaccucgcggcccucuagugcuccccugccagggugcgaccuagguacccuuuaucgagccccacuccccaaggcagagagaguucgacguucccaaggagggagucuccauggaggaauucguccugcuucacuuccagaguugaaagcccgucgguucugcaaagaggagcagucgggcgcgggcuagcaagcagcugaugaaaaua

SEQ ID NO: 17718 - RNA, 43014 nt, Homo sapiens
agagauugcaaugucaguguagguagugcuggucccuggucugcaugucaaggcacagugccuugcauaugguagacaaucaauauuaguuauugaauucagccaaagggaaguugaauucacugagacuacuguggaugagauaccaaguauacuuauaaucauuuuuaguuuuuaaggcuuaaaaguaugucacaccaucaacucugugauacaauucuauaauaaauucuuuuaacaaugaaacagaucauaugccacaaugagguauuuucuuaaggaguaagugacccaggaugcuauaggauuuuuauguuuucaaaacauuuuaaguuuaacauuagauguugccagaauauuuauaacaaauuaguuuagcccugguauuaaaggugccuuucauaacugauacucucacuuucuugcauuuacauguuacuggguuguaauguuuguuuuaucuucgacuucugugcuaguucauugccucagcaugugcaucacaaaugcuagggggaaaguugaagaauaaacaagcuuuucaaucauuuauauuucagggaaacaaaagucagucauucucuaaacacuauuuuaagugaccugguugugagauuuuuguucuguuuuguuuuguuuugcaaucuaggcagcuauuuuuuauucaaagaauucccuccaccuaacccauaggauaaagcuggccucuagggaaaccuguuuaccaauucuuaaugauggccugccuucuaaggcuguaucagauuuuuaacuaguuccuguuccagagucccacguccuucuccuuugaucuucuggucucuggcauucugagugucuaacagaacacugucuauacugcagagggcgguugaacucuuugucugggcuuuuuauugagaaaacagaauuugccuggaacaaaggaaaacagcaggagcuuggggcggaagaggcgggcgucguguugaugucugaguagaagcuguauuuguauucugaggacuacaaggacaucacugacagauuggauucuccggcccuagguuguuuugugcauacgagaggaggugaagucacauguccaagcuggguugggggaagcucaaauucuaaucauuuagagcacuuuucucaacacacacuucagcgauagcauuaacugagccuccuccaagcuacaauuugaggacaaaaauaccuaugaauggacaauaauuugaugcagaaagcuuaaauucuacuguguggugcaugguaguacacacauuuuuaucaccugcaauuucucugcuugugaguccuuucaucagaguggguaaacauaaaucuauaugcuuuuaaauuggcaguuaagaaaaccuguuaauaugcacugcugcauauucuuccagaaaucuaaguauguuugacgaagugcuguaacuguagguuaagauggauaaggcaggaugugguuguguuuucaggggucauuuggaagcaguguucagacauaauguuauuugaauguguuuaaaccacuucuguauuucaagauuuuauuaguuuucucaggcugcuauaaacacacacacacacauacacacacacacacacacacacacacacacacacacacauacacacagauuggguggcuuagaccacaguuaauuuucucacuguuguaaaugcuggaauugucacaucagggugucagcaggguugguuucuugugaggccucucuccuuagcuugcagacggcaccuucccccuguguccucacguggugugucuucugugcacacauaucucuggugucuguguccauauuuccucuuucuguaaggacgccauucauacuggacuggggucauauggaugggggcccaaccauaugaccucauuugaccuuacuuaccucuuuaaagacccuaucuccaaauacauuuucauucuggggugcugaggguuuaauguaaacuuugggggacaauaacauauaaaaagaaaugugauuuuacuuaggaaaaaggccagugguaugaaugaguggaucuagaaagugccucgagcagucacccucaucuucccccagcacuguaaucaauguguauuaucuagugggaagaaacacaggcuucagagccugguucuaauccaacuucacagcccuagaugagacgcugaauggccccgaagcaguuuaucaacucagaagagagggucacagcagccacggccucgagccaccgugaggaaagaccgcgaucacacagcacgcaacaccgcucccagcuggugggugccacucaaggugugccagcuacacaccaucuuaccauucaccgugacuguuguuagcagcacccacacuucaugcuucugauugagugaguuucuguagcaucgucuccucugggcuugcuacucacuuuguauuguaaagucccgaaaggagcuuuugaucaucaacaaauacuuuucuuuuucuuucacuuuuucuuuuucuuuuugugagacagagucuugcucugucgcccuggcugaagugcaguggcaugcucuugccucacugcagccuccaacuccuggguucaagcgauucuccugucucacccucccaaguagcugagauuacaggcgugcacuaccacacccagcuaauuuuuguauuuuuaguagagaugggguuucaccauguuggacacgcuggucucgaacuccugaccucaggugaucuacccauuuuggccuccugcaguacuaggauuacaggcaugaggcacugcgcccggccaacaaauucuuuuuauuguagucuucgugagcuuguguagucuggcugccuuaggcuuaguucaaguccccacuuuuuucuuugucauuuauucuaagcccauguuuaguugagaaacuaccagacguuggcuucccugaugcccucguuccaaggugaccugagaauuccuaguagauuggcagcugggagccccauucuauccagccuacuucacccccucuucagucauugaaaauccuuuccucauucucucuuuuuuuuaaauggagguaaaauuccuauaacauaaaacuauccauguuaguaccucaaaaaauuaaaaacagaauucugugauccaacaauucaauuuccaggcaaauauccaaaaggaccgaaagcagagacucagagagauuuguacacccauguucacagcagcguuauucacaauagcuaaaaaguagaagcuacccagguguccauccagggacaaauggacaaacagaaugugguguacucaugcaagggaauauuauucagccacaaaaggaaggaaauucugacacaugugacacaaauggacaaauccuguacaauuccacuuacaugaggcacgugggagucaaaugcauagagacggaaaaugaauggagguugccagggucugguggaggugagaauggguacagaguuucagauuugcaaaaugaaagaacucuggagauggauggugaccauggacuuccacgucagccuauccuguaccccuaaacaaggcuggucacccaucacaucucuugaaagucaucacacccauucuguccugaauguugggaaccuaccacuuguucuugacacucuucccucucuccuaucaguuggucaccaauuuguaugcuuuuugcuuccucacuguucuucaaaccccuccacagauucaccaccacccuaguucagucugcugaccucucuccuaggacugcagccacagccucccuggagccccugacaccugcuucucccccacucacaucucuuucccaccacgggauuuguuucauaugaacauaaacaugguggugaccucugccacccucccaccccuggcuuccugcuguggguuuaauugugccucccaaaagcuacgcucaaaucguaaccccugggaccuagaaguauaauguauaaccuuuuuuuggaaauaggguuguugcagauguaauuaagaugucaguuaagaugaggucauacaagaggauggugggcccuuaauccagugugacugguguccuuuuaagacaggagaagagacagggagacagacaagaggugagauggucaugaagacagaggcagaggugggagcgaggcaucugcaagccggaaauuaugggcaagcaccgugagacaggagagaggcagggagcagucucuucccucagccggugaugggaccagcccugcccacaccgugaucucagccuccaggacugugagagaaguguguuguguuaagccccucaguuuguggugcuuuauugcugcaacccuggggcacucacacacuuacagaccccgccccgcgccggccucguggcucugaggacaacgacugauccuagccugcccuugcucaggguucccugcgagcgcagcugcuccucccgggcucuccaaccugcaucccugcucucugugcuccagccacaccgaggcccuugcucagacccugugagaauaauaccagagacagggugccagacacucauuucucacagugccagaggcuggaaagcccaccaucaaggugcaggcagguugggugugugguaagggccugccuccugguucacagacggucgucuucucacuguguccucacguggcggaaagggggcaugggagcucuccagggccuuuuugaugaaggcacugauccauucaugggccuccacccucaugacccaaucacuucccagaggcccuacuucccaauaccaucacauuaggagucaggauuucaacaucugaauuuugagaguccauaaacauucugcuuauuacagauacagaguaaaaugcuugugaugcuagcuauagaagaaaggugccauccaagaaagggccauauuugcuuaaauggguggacagaaucaugcuuucuucuacucauguccacaugugacuagacuuuguuaucucaacucuaguggaguguguaggugaggggaauuugagguuuugaugauaaaaacaagccagguguggugguguaugccuguagucccagcuacuugagaggcugaggcaagagaaucacugaaucccagggguucaaggcugcagcacgcuaugauggcaccugugaauagcuacugcacuccagccugggcaacauagcaagaccccaucucuaaaaaucaaaaguaaaauuuuaaaaagcccagcuuuguaguuuucugguugucucuggugaggucuuuaguuauuucccuucuguugugcuuuagagauguaucaugccuauacccccuuucuucugauccucuuacaggguuggagauuaaagcacaagcaacuccuaaccccuguaggguuuuagcuaaaguucuggugggugauuuuuuuuccucgucgcuuuaccuuuugucuucaguuagaagaugugaugggguccaggcucugaacaagaagucugucugcugauggcccaauuauucucugucugcagguucacuacaacauuggcaaaaaccuggcugauaaaggcaaccagacagcugccaucagauacuaccgggaagcuguaagguauggcgaguaugucuuacagaagaauuauguacacagaucguuuucacuuucuaauaugaaacaccuguuccuuuaaagaccccaacuuuacaauaucuuuaccgauuccugagaguuuaguaaaaacuuacuauugagcauuuaauggucagcuugguuuuuucucaacuuucagauuaaaucccaaguauguucaugccaugaauaaucuuggaaauaucuuaaaagaaaggaaugagcuacaggaagcugaggagcugcugucuuuggcuguucaaauacaguaagcauuguuuuuauaauuaugcuagugacaaagaaaggagcuccugcauuccggcaucuaagccuuucaucuucuuguuuaucuuuguuaaaacugcuccucuaggccagacuuugccgcugcguggaugaaucuaggcauagugcagaauagccugaaacgguuugaagcagcagagcaaaguuaccggacagcaauuaaacacagaaggaaauacccagacuguuacuacaaccucgggcgucugguaagcgcggggugcccugugccuguggaaggaaagauggguuauuuuucuuauuuauaauaaaaugacauagugacacccaccuagcccauacauuuuauaaaguucuuucacauguuucuaucucauuugaagguagcuauuugauuuccuuuugaguaauuuuuuaaagcucucauuagagagcaguacagugugaauuagucaaguuuaagaggucacccacgcaaaagguuaaacccaggaauaaauuaacauguuaaagucccguccgcccuguaaaacagcacuccaauggguaacuuccugauaaacaucaguuucucuguuuuuaaaacaagaauugaguaagaacagagauuaaaguaacaaauccguaguaugauuucugagcucccuuguucuccuucuucaagggagcagagcucuucaucugcagggagcauuucccccaaaaaaggcagcuuuggagggcacgggauuuauuugaaagggcuuugacauuauuugguggaaauagaaaauaacguguucuguaguagcuuuauauuuuugguuauugacaggauguuuacgaagaucugauugcucuugauuuucuugacaaaaauaaaaugagacacacacauagcaaaauucuuuaaacacgaaugguugucuucucccuauaaucaaccauuuaauuugguuucaagaaaacaaauacauauguuccuaauauauuuagauguauucaauaaacauuguuaauuaaaaaauuuguguucauucuaaccaaacuggaauacauccauagugauaugacuuucacagaaguuuauauguagauuuccagauuuuauccagcuuagccuuacagguaggaaggcauccucguguucuaaagagaugucugcugcccucguuuuaaaggccugaagcuucuugguuuuguuuuuuguuuguuuguuuguuuguuuguuuuguuuuguuuuuggagacagaguuucgcuuuaaagaguucuuauguugucagaacugguaguucccuuagcugcuugucgauggcuuucaagguuacuucauggagcuggagcgcuuggcugcgcaggcccugagggcuggcggucccaauggcauggccacggugcgugccauggcuucuggagguggugucucuuucuuuuuuuauuuuuuuuuuauuuuuuuuuuuugagacagagucucacucugucacccaagcuggagugcaguggcgggaucucggcucaacgggaucucggcucacugcaagcuccgccccccggguucacgccguucuucugccucagccuccggaguagcugggacuauaggcgcccgccaccaugccuggcuaauguuuuguauuuuuaguagagacgggauuucaccauguuagccaggauggucuagaucuccugaccucgugauccgcccgccucagccuccgaaagugcugggauuacaggcaugagccaccaugcccagccuggaggugguguuucuauugauaacaaguaggugacuggccuagagauggaggucaugaugacugcaaggaagagacuggacccauacaauguacuacccccaaagacagcuuuaggcaccaaggaagacccuaauuuaguccccuccaucaccaacaagagaauagugggugcaucugugaagaggaaaacagugcugucaucugguuuuggccgcacaaaggcaagacccagcaaugccccagcuguggagcccauuacaagcugguacccaucagcuggugcauugagcgccugcaccaaguuacucaaaaugugcuauaaaguuucaucuuuccaauaaagaccagccauugcauuggcuccuucuccuucugcaaaaaaaaaaaaaaaaaaaaacaaaacccaacuaguaguuuccaaaacugacaugcauccagaccgucccaccccaucugacauuuagggaaucaagggcucuauagagaaucuguuuuaaaauaacaauaauaaacugggcacaguggcuuauaccuguaaucccggcacuuugggaggccaaggcgggcggaucacuugaggucaggaguucaagaccagccuggccaacauggcgaaaccacaucucuacuaaaaauacaaaaaauagccagacauggugguacgugccuguaaucccagcugcuggggaggcugaggcaggaaaaucacuugaaccugggaagcagagguugcagugagccaagauugcggcacugcacuccagccugggcaacagagugagauucugccucaaaaaaauuaaguaaguaaaauaacaauaaugaaucacccaggugauuccaguaaccugcccuuggcccugcagcagggaagcagcucugucugaacuuggauaacaggguaaucaugucagagcagaagccaugguuuguggggaacaauccuagaaaacacugacugcuuuacauuuauuggaaaaccaggcuuugguuuuuaccauaaugugaaugucuuuggucuuacugucuuuguuucuggaguggguagccaugauuuugugaguuguggagauagaaucuuaugaauggagaaaacaagauagcaggaacgucuggcuaacuaaugguaaaaugugaccuucccccucugcagaagucccuuuacguggacgaguaaugcuuguguuagaaauauauacauauguaacuaaccugcacauugugcacauguacgcuaaaacuuaaaguauaauaauaauaaauuuaaaaaaaaagaaauacuaaagugaagugguugcauguaugaguccauuuucauaaugcugauaaagauauaccugacacuggguaauuuauagagaaaaagagguuuaauggacucacaguuccauguggcuggggaggccucacaaucaagguggaaggugaaaggcacaucuuacauggcagcagacaaaagaaaauaagagccaagcaaaagagguuuccccuuauaaaaccaucagaucucaugagacuuagucacuaccacgagaacaguaugggggaaaccacccccaugauucaguuauuuuucaccaggucccucccacaacacaugggaaugaugggagcuacaauucaagaugagauuuggguggggacacagccaaaccauaucaccgcauuuuuauuacucaaaaaaugcaaaacauguuucaguuaugauaugccacaggaagauaccaccucuaugugcugacuccacuguggaaaggaggaauuauuucuucgugggcacagaggcaaggguggcaggaauguggcugaacucauggaauggcaugaugcuugaacaaggaagauuaauggcaagauauuccuuugucucacauuaacuuucuccagaaccacugaccuugcgugcauuuuuguucuuuuacauuuuaaaauucugugcuuuaugaccuaguuaccugcuuugauguugaaaccaguuucucugugagaccugaagauuccaggagagcugaaauuauuauaaugaucggcuguuuguucccagggggaaggggaggcugugaaaccucaacauaauguuacgaguggugacuucaaaauucaaucacauacaaagcaggggcgauccucacaaaguuagugaagugagaauaggggugggguggaggaugggagcacaugaggucuuaccugaauucaugcauuugggugguuaugaauauauggguguagggauuaccguuucuguucacuguaucuguuaaacuaguacucagugacuaaauaugagacuugguauucauaagaauucuucuuuugguugggcgcgguggcucacgccuguaaucccagcacuuuggaaggccgaggcgaguggaucacaaggucaggagaucgagaccauccuggcuaacauggugaaaccccaucucuacuaaaaaugcaaaaaauuagccaggcgugguggcaggcgccuauagucccagcuacucaggaggcugaggcaggagaauggcgugaacccgggaggcggagcuugcagugaaccgagauggcgccacugcacuccagccugggcgacggagcaagacuccaucucaaaaaauaaaaauaaaaaaaaagaauucuucuuucaucccuuuuuuuccuuuucuggggauugcucuucuguuacuuuauugcucacaaagugagugggucugcccacagccucccagguuauccucuaggcuccacagcuuagucuucuccccucuccuaguagcugcccgucacugcaguuccuugggauuuggaaaauagaggauuuauaauaaaugcuccuucuguaagaaugauguccaaagggaggaacggagaauauaaaguaccagcuuuuaucaugugcuguaguccuugggauucauuacacuuucacuuggaagaucaucuguagcauugaacacauugagaccuuguacugcuuuugguuuauauuguuuacuaauuacacugccgugaaauggucuuccuguauuccauuccgccaacuguuccugcuuauuuaaggcuuuugcuuucccuugugguuuaauuauccagcuuuuuccucuuugacagcuuaaaagcauuaagagcuuaaucuuuaacaacucaaccaacccauuuauauacuggcaaauaagaacuuaauagcuuaagaggguuuuuuguuuguuuguuuguuuguuuguuuuaagaaaucacucucuaguaacaggagacagcgauuuguuuugauuucuagaccccaauauggagagaauauaaggcaguucucuuguggaauaggaagucaggaagagcgcaauuacugggacauauuacuaaucuuagaaaguuauauucuaagcaauaauggcuagagggauugcggaagacaaugcaugauggaaggacuggauguguccaggaaaacagaaaccauucuaaguguuuuagauagagaagacuuaauauaaggaauugguuagacucauuggaaggcuggaugagcaaaaaugggaugguaacaugaacucagagauuaaagggaauccuauauguuuugggggaacagacaggaggcacuaccaagauuuaaaaacucacaagagguuacaaucucuggagcuaccacagccucaagagcugugaucauggagacagaccacugcuuccacccugggacgguggaggaggggacauagucacuucagagacacugccaggggaaggaaggagagagugagaguaagaggaaaggacugcuccccucuccccaccauccagugccuguugacagaacagaacaaaagggugaagaagccugggaaauguaguugcagacucccagccccugcuucucagagcagaguacagaaggguaagcguaggacugcugggugauugauguuacccaucuacuuccuggaugagcaguucugguuaaaucaccacuuuuucugcuucccugaaaguuuguucccuucguguagaugcuguaagaugaguagaauuugagacaaaaugaaacuaaauuuuaucugauucagucuauucuucaauaaauaguaauaauaauuguaguaguaacaguaaaguagugaagaauuuugucauguuggauaaaggaaguuacguugguuguucuagguguguucaaauguugccauggauuuuguccaagugacucaaaugcauaucacuugguggagugaauugaucugaggaaucacuggaacaucaaauagagauaauuaaguguuagaauaauuaagcaucgcauuauuuucauuuucugaacuuuuccuaucauuuccucauuaaaggguaaaaauauuguaacuugaguuucugagucucaugagaaauucccacaacaucuuuagcaaauggauguucauaaauguuuccauaauucauuaaagcuuucuuuuucuugcauaauaugcuaucuauuugcuguguagcguaggacaagucagaacguuuuuguugucugaagaaaagacagacuugccaguaaguaaggaaacagccuuaaacucugauaaauuguaaucauuuguacuuuuugcagaguuaaagggaucaaguacacucaaauaaaaugugcauuugaacugagauaagagggcaacagggucaccugcuaaaaaauccaucacugugugugugugugugugugugugugugugugugugugugugugugucugcuuuuauuaacuaugcaaauugagagcuagccauuuuauauucuguuaccaauguuaacauucccucucaaaagaagcaacaaccgccccuacugggaagugaggagccccucugcccggccggccgccccauccaggagggaggugggggggucagccccccgcccggccagucgccccguccgggagggaggugggugggucagccccccguccggccagccgccccguccgggaggugaggggcgccucugcccggccgccccuacugggaagugaggagccccucugcccggccggccgccccaucugggagguguacccaacagcucauugagaacgggcugggaugacaauggcgguuuuguggaauagaaaggggggaaagguggggaaaagauugagaaaucggaugguugccgugucuguguagaaagaaguagacaugggagacuuuucauuuuguuccguacuaagaaaaauucuucugccuugggauccugcuaaucggugaccuuacccccaacccugugcucucugaaacaugugcuguguccacucagaguugaauggauuaagggcggugcaagaugugcuuuguuaaacagauguuugaaggcagcaugcucguuaagaaucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaauaaaauaaaauaaaagagagagagagagauuaaaaaaaaaaaaaaaacaagaagcaacaaaaaucuggaagcauuccccuugagaaauggaaccaggcaaggaugcccacucccaccacucuuauucaacaugguacuggaaguccuagccagagcagucgggcaagaaaaauaaauaaaaggcauguaaauaggaaaagaagaagucaagcuaucucucuucauggacggugugauucgacaccuagaaaacccugcagacuuuaccagaaggcuccuggaacucauaaacaacuucaguaaaguuucaggauacaaagucaguguacaaaaguaagaaacauaucuauaugccaaucacauucaagcugagagccaaaccaagaaugcaaucccauuuacaagagccauaaaaaggauaaaauaccugggaauucagcuaaucaaggaggugaaggaucucuacaaggagaacuacaaaacacugcugaaagaaaucagaggugacacaaacgaguggaaaaacauuuccugaccauggauuggaagaaucauuauuguuaaaauggccauacugcccaaagcaaucuacagauucaacacuguuccuaucaaacugccaaugucauuuuucacagaauuagaaaaagcuauucuuaaauucauauugaaccaaaaaagaaccugaauagccaaagcaguccuaagcauaaagaacaaagccagaggcaucacauuaccugacuucaaacuauacuguaaggccacaguaaccaaaacaguaugguacuggugcaaaaacagacacacagaugaguggaacagaauagagaacccagaaauaaagccacacaucuacagccauguggucuucaaacaauuuaaccaauuuuuuuuuaaagcaauggggaaaggguucccuaggcaauaaaucgugcugggauagcuggcuagccauacgcaaaagagugaaacuggaccccuaccuuucacaaaacacaaacauuaacucaagauagauuaaaaauuuaaaugcaagaccucaaacuacaagaauccuagaagaggcugagcucaguggcucacaccuguauucccagcacuuugggagccaaggcaggcaaauggcuugagcccaggaguuugaagccagccugggcaacauggcaaaacuuaaucucuacaaaaaauccaaaaaaauuagcugggcaucgugguaugugccuguagucccagcuaccugggagaccaaggugggaggaucgcuugaucccaggaggucaaggcuguagugagccacuggucacaccacaucacaccacugcgcucccgccugggcgacagaauaagacccugucuuuaaaaaaaaaaaaauccuagaagaaaaccuaggaaacacuauucuagacaucagcccugggaaagaauugaugaugaaguccucaaaagcaauugcaacaaaaacgaaaauuggcaagugggaccuaauuaaacuaaaggguuucugcacagcaguagaaacuaucaagagaguaaacagacgaccuacagaaugggagaaaauauucauaaacuaugcauccaacaaaggucuaauauugagaucuauaaguaacaaaucaacaagcaaaaaaacagccccauuaaaaagugggcaaaaggcgugaccagacacuucucaaaagaagacauacaagcagcuaacaaacauaugagaaaaugcucaucaucacuaaucauuagagaaaugcaaaucaaaaccacaauugagauaccaucucacaccagucagaguggcuguuaucaaaaagugaaaaaacaagagucacuggcaaggcugugggagaaaaaggaaugcuuagacacuguauauaaauuaguucauccacugugaaaagcaguuuagagauuucucaaagaacuuagaacugccauuuggcccagcaaucucaugacugguuauauacccaaaagaaaucauuccaccaaaaagacacaugcggccgggcacaguggcucacaccuguaaacccagcacuuuggaaguccgaggcagguggauuacgaggucaggaguucaagaccagccuggccaagauggugaaagcccaucucuacuaaaaauacaaaaauuagcugggcaugguggugggcgccuguaaucccagcuacuugggaggcugaggcagaaaauugcuugaaccugggagguggagguugcagugagccgagauugugcuacugcacuccagccugggugacagagcaagacugcaucucaaaaaaaaaccaaaacaugcauucauauguucaucaaucacuauucacaauagcaaagacauggaaucaaccuaggugcccauccgcuguagauuggaaaaagaaaaugugguacauauacaccauggaauaccacacaaccauacgaaaaaaaaaaaaucauguccuuugcagcaacauggaugccacuggaggccacuauccuaaggaaauaaauccaggaacagaaaaccaaaugccacauguucucauaagugagcgcuaauacauaaagauggcaaucauagacacuugagacuacuagaguggggaggcagggaggcaaacaaggguugaaacacuaacuauuggguacugugcucacuaccuggaugacaggaucauuucuaucacaaaccucagcaucacacaauuuacccauguaacaaaccugcacauguacauucugaaucuaaaauaaaaaguugaaggccgagugcgguggcccacgccuguaaucccagcacugugggaugccaaggugggcggaucaguugaggccaggaauuugagaccagccugggcaacaucgugaaaccccaucucuacugaaaguacaaaaaucagccaggcauggugacacacgucugugaucccagcugcucaggaggcugaggcacgagaauuguucgaacuugggaggcagacguugcagugagcagagguugcagugagccaagaucaugccacugcacuccagccugggcaacagagcgagacucuguuucuaaauacguacauacgccuggcgcgguggcucacgccuguaaucccagcacuucgggaggcugaggcaggcagaucgaucacaaggucaggaguucaagaccagucuggccaauauggugaaaccccgucucuacucaaaauagaaaaaauuugccgggcaugguggugggcgccuguaaucccagcuacucagaaggcugaagcgggagaaucacaugaacccgggagguggagguugcagugagccgagaucgcgccauugcacuccagcccgggcaacagugugagacucuaucucaaaaauaaaaauaauaauaauaauaaaaguuuaaauuauaaaaaauaagaaagcaacagguauuuuucuccuuccuaaaugaagcaaacaaacucaaaauugccaagagguuuuaccuuaccauaggagacuuuuccaaggaguuacaaaguaugucugauaugcuccuguuuuuauauuuacuuuagacacaggcaggaagaggcccugagaccacccuucacaaggugaauuggacacauagcuuuugaucaugagaaauacuuuguucacuauucuaaguaauacuuuaucaacaaugaacuuaugaagucuuuagugaaaaagacuaaugaugaggcuuucuucaguauuucagcagucugaaauaugauuugauuccuaaaaucacuaaauaacaggaaauaggacauuacagguucggaccuuguucuuauuccugcuuuaccauuucuagucuauaacuuugggcaaguucauuuccucgugccuuaguugcuuccucuguaaaauggggauaacaauaguauuuacuucauugguauuguuuugaggauuaaaugaguugauaugaaaaacuagaagcuccauaauuaaaguuagguuuugguuuuuuauuguuguuuguugggcuuuuucuuucuuuuuuuuuuuuuuuaauaaugucuuggaaagaggaagcaggaaacuuggaauacugauuuuuugguguguuuuauuuucaguaugcagaucucaaucgccacguggaugccuugaaugcguggagaaaugccaccgugcugaaaccagagcacagccuggccuggaacaacaugauuauacuccucgacaauacagguacagaaagcuggauggaacaaaucacaggaaauggcuccacaguaaaaugccaccgaagacuuaggaaauagagauuauugugcuuuuuuccuacugaguuuaaaaaaaaauuaaugugaaguuaauuauuuucuauuacaaaaaugucuauuccucuagaaaauggaauuucuaggccgggcacgguugcucacaccuguaaucccagcgcuuugggaggccgaggugggcagaucaccugaggucaggaguucgagaccagccugaccaacauggagaaacccuguccguacuaaaaauacaaaauuagccgggugugguggcgcaugccuauaaucccagcuacuugggaggcugaggcaggagaaucgcuugaacccaggagguggagguugcagugagccaagaucacgccauugcacuccagccugggcaacaagagcgaaacgccaucucaaaaaaaaaggggggggcggguaggggggagagggggagggagggaggaaggcaggaagaaaggcaggaaggaagggagggagggagggaagggagggaaggaaggaauuucuuuagacauacuggaaugugaaugucugggaaaaugacacuccaccuagaacugguguugaguaaugggggagaggugugacaguaucuuguuucuucugaagccuguuauccaccauuggccauccucuaggguguugggagcacucagaagugagcaagaauggccuuggggcuaaugacauggauaguacuagguccaugccccaaguucagggacuucacucaaaggagcccccucagucuacacuuggagccauggauucuuucuuuuuauauaaugcuaaucgacuugaagaucugguuuccuaucccugagcagaccagauucaaucaauuaggaguuacucugccuccuucacuuuaaaaauccaaacgucuuuuaagaaaugaugguguuaggcacagaaaggcaaauaucacaugcucucacucaugggggaucuggaaaaauggaccucguggaacuagagagcagaacaguaguuccuaggggcugggaagggggcggggauaaagauaggcugguuaauggguacaaacacagauaggagucaguucuaguguuccacugcacaguagggugacuguaguuaacacuuuaugauauauuucacaagaacuagaagaugugaaauguuccuaacguaaagaaaugaucaauauuugaggcgaugguugucuuaaguaccuuaauuugaucacuacacauuguaugcauguaucaaaguaucacaugcaccccaucaauauguacaguuaugugucaguaaaaauauguuaaugaugguguuaauuugaucaugguguagagcagagauauaugguuguuucuagggaaaauauagaauguauacuucaaugugauaaauucucaguuaugaaaguguuacugucauccucuuauuuugcagauuuguuuggguauaacugguaucugggaaaaaauuaaaacuagguuuuagaugguuuuacagaaguuaaucaaaagcuguuuauguguugugucagaaaugugcugaauugcaguggcuuugccacugauaacgucguguguguguguguguguguguguguguguguguguguguauuacaugaucuacacagauuuucuuaaguaguuuauucauaauugucaugugcugugcacauaaacccuguuaguuauagagagaagcuaaaaugcgaguacaacauuaacaugucuuuuauuuuuccauuuuucacucccagguaauuuagcccaagcugaagcaguuggaagagaggcacuggaauuaauaccuaaugaucacucucucauguucucguuggcaaacgugcuggggaaaucccagaaauacaaggugcguaaaccgcaggcugugaguucuugcaguuagugccagcaucugacagaagacguaaguguuacuucugcccaguuaaauuaggaaucaggccaaaacaguggcaguggugcaccaauguggcuuggccaguuuguuuccuggaaaaguugcuucaaagacagcgguguggggccaaacccaguguccuuucucaucagaauuaaccacugugguucacacguggagagaggaagagaagcccaaggaaggggugggagcaggcagggaguuguggaauguuuggccucagaggccgggcaggcuggugcaggaggaggacucagggcagccacagugcauccccggaggugccccugccccagccccacccuagcacaacaggguuugacucugucacuugcacaugggcuggagcucuagguuuuaucugcagguuccaucuucugcacaaaagaauaaccagcccauggaggaugcaugacugguucuugcugcuuccagguuuuucuuuaucugaguuauauaggccaccagcaaggcccagaguuuucugaccaacaaaaaccacaagauacuaaaucuuugcuccaguuggcagccaggguggagcaggaauaggcuaugcauaacucccuguguguugaaggggacugguuguaaacuuuaauuuugucuaucagaaucacugaggaagcuuguuaaaguagagaugcccagauucuccccagaagggauuggcuucguggguuaggucaggucagggaauaugcauuuuuuuguuguuuuuuuauuuuuuuuguuuuuuuugagacggagucucgcucuuucgcccaggcuggagugcaguggcgccaucucggcucucugcaagcuccgccucccggguucacgccauucuccugccucagccucccgaguggcugggacuauaggcgcccgccaccacgcccggcuaauguuuuguauuuuuagaagagacaggguuucaccguguuagccaggauggucuugaucuccugaccuugugauccacccuccucggcuucccaaagugcugagauuacaggcaugagccaccacgcccagcuggaauaugcauuuuuagcuggcauccuggguguuaaacacagauaucacagaagcagugccuuagucguuucuuaagagaaauaccuuuauuucagaaucaggggcuauaucuuauuucaaucacucagccuauguauaagaccuaaaggcagcaacuagcuaauaucuguccaguguuauucacuucucuuuuucuguuuauuacaugucauuaucaguauaauuuucaauaacaaugguaagauaauuucaugcauaucucuaguuuuauaauguuggggaguugaauagcuucacuaugcauuuuuuaaauuucuagauuuuacuccagaaauagcuuuuugaagagggcuuaguuuuaguuuuuaugaaucuacuuguguagcaggggaaggaggugagguuuacagguuucccuucuaaugaccuuuccagccaucugucagccugggacaggucccaagucucaguucuccuccagugacccagcuacagcgagucuucuugaagacuuggcuuauauaaucguuguauugauuuuucugucaucccacagucuguaaacugcuggaauuucuauuaaggggauaaaacccagaguucguuuggcuuccaguucauguuguucuuccucccccacccccaaguaaaguagaaaauacucuguaaagcagaauggagaaaucagcuuccucuuucucuacacauuuugcauuuuaauuaucaaggccaaagcacugggccuaacuuaaggaaacagaaggugaaaucugaaacacagaacucacgaugagaucuucaggagcuaccaaguugggggacaugaugugacuuccugagccauggcaucagccaccaagcaagcauuccauguauuuuuuuaguuaaggguuugaauuuuaagcaacuguuuagguuuuccucuucuaaugcaaaaaugauaccgguugcuaauggucagcugcaucccuggcacugcuuguuucaggauguagugaggggacguguuuccucgcagagcacugggcaggaugucccagagaagaggggauguggugagucgcagggcugggugaacagacccuccagcccagcuaucuugauggcagggcaggugucugcucccugacaacucacuuuuuacccaagcacuugcuguuuuauuuaucaugcacuugguaaaucuccucagagagccuggaggcuucuugagguuggagccgagucuuuggucccaguuuuguaucuccauugcugucgggcaguuacgaagcacccaguuaaguaguuguaaaaugaucaaaugcaucucucauuuggcccugaaacguucaggcuuccagaaccuauuuugagauguugauaugcagagugaguguucucguuauaucugcguggcucuaagcaccuuuuuauucuaucugagcagcccuucuuaaaaccuaacagcagucacuuagccucucugggucucaguuuguucaucuauaaaauggagauaguuaucugcccacccucuugacaaggugauacaaaaaaaugcacaacaacuuaauuugcaacuaucaaaugguuaauauguauauguauauauguauggguguguguguguguguguguguauauauauacauuuagugagcauucaaucauucagugaaucucuagggaucauuaaaauguauuaaaauuuauauuacuucuugccauuuaauuuccaguuucaagcuaaugugguaaagcaaaaauacaaaaguaauguuuuucagugcuuaaaucauggcuuccugugcugauuucuuuuucuguagugcuaauuccaauggcccuguagcuuaagugcagguuauguugauagagucaguuuccuaagcuccagacauuuaugucacaccuuuaugauauuuuuuugccacaucuagguauuaccuuauuuacuugacauuuuuauuuaaauagauuuuuaacaugaauguauuuaaaggagaaacaacgcaucauuacuguaaauacaggguaacugaaagugaaauaaucauacuaaaucccagcuagauacuauugcuggccaaggcucugagcucucuuagcuucaaggagagauuggccgguauguuagaggguggggcccacacaccaccaccaagugcagacuucagccccaaugcaaucagaaggaaggagggagaauagagaauaacucucuuccugugugagucacgguuucaacuucucaucagaucucccauguuacccuuccuauucuagcggaggcacaguggccccugugccccagagcacucuuggguggcugcuguggcugaaaugaccuccgcccacccaggcuuccucgccuagacauacagacuagcgcuuguuccuaccuagagacauaauuugcaaggcuuucucaguccuacaccuuuguuaaauacauuuugucuaauaugcuucagaacauaauaccuuauuuuuccccuuucuguucagaaaaaaaauauccccaacucuaaaugugaguuuauugguucauuggcauuaaauuggcucauugccugggucuuuagucauccagagaccuccacagaagaucaauuuauaaacaguucacugcuuuccugaaugaggccauuagaaggcugauuuaauagaugaacauuucaugggcuuugaauacucacagaugcugcguucuaaagaggccccuccaaccccacucccaggcccagguacaggcccaggggcugcccccgugacuuggauagagccaggccgacccacccacaccuccucucaaaccaucucuuccuccugacaccccuucuuuuguccacaugcugucguguuuuuguugcccuggcuuggaaaucuugacucauuuuuccuccuuugucccccuggcccagugcucucugccuguuauuccucaucccuguuccuucacacuggccuccuccucacccugcagaguuuggguccagcccuugcugacagcaguggcccucuaacaaggugucagaucugagcccuucccugucuucagcaccacugugucccccaaauugcugacuccucaauguccugaaugauguucguccucacaggcaucugagaacuuagcugaaugaauaaaugaauuuagcaacacuagaaaacuccuaacuuuuuaucccuaagccauuucucucaaguuaacacuacuucauuuacagguugggaaggauuuuuaaguagaugugguucccuggccuuccuaugucucaaguuuuagguuuuaaauggaaauguuugaaaaucaucagaaacagcccagagacucagaaaccacugcgaaacuacacaacccauuugacuuuuuuucugcagccuuccugauauggccggagucuugacccucuuggaaggaguuucagccccugaaacucggaauguagacacuacacugacuuugaacugacaucccguauguuguccugaugucuuucuuaagucccucuuggaugacauuucuaaaauauaaauguuucucugccagcucugucugaaaggucaugguuuuggagauggucccccacauucucagccaauuucucagggguaccacaggccauacagggcaaaggaacugguggucuugcacauuauaaaaugcacagucacagauaugggaagcccaccuggaaaaaauucauguaugacccagguagaaggcacaaaaacuauccccacaccaacaaauuuguuugguuaagcucaaugugugauaccgauuuuuuuuuuuuuuuugagacagagucuugcucucuugcccaggcuggagugcaguggcgcagucucggcucaccgcaaccuccuccucuuggauuggagcaauucuccugccucagccucccaaguagcugggauuacaggcacguacuaccacacccggcuaauuuuuguauuuuuaguagagacggguuuucaccauguuggccaggcuggucucgaacuccugacuucaagugaucugcccaccuuggcuucccaaaguguugggauuacaggcaugagccaccaugcccagcaugugauacugaugaaagcaugcuccccuuaaggaaugcgaagguggauggagugaacagcguccccagggcacaugucaauaaaaacagguuaggcgucuuuauuucucagcauuaugguagaagggaccagccagccaucaguuuuuagcagugaucaggguaggaagacacuuugcccugccuuuuaggggccagguuggaagugaguaugacuuggaagaaaugcaaggcugugcaagaaucaauucacacccaucaggggcauuuggugauggucaugugcaguacugugacaauguaguugacagguggccauuccuuccucuuuucugcacauucuuuccagauggauggggcugcuucugggcggcccagaguguuguagguucuugggggagaggaaaugggccucaacugcuaccccaagagcucuggaaauggcauuggcauggguaugcuccacggcucagccuucuccuguucccugggccuccugucgucaucacgcacccugaccugggcgacuugcauaacauuacagaaguccaaccacugcagggaggcaggugguggcacucacgaacauguucauccccucucugcggccaccacucccucccacugcuccuugucagccucucuuuggcagagcguggccccgcugggccuuccgaguguuucuggaggaaugcauugauacaaaaggaggagguuaaaaguuugaaaaccguaggugauaaaacugggaacugcuuuugcuucauguacaauaaauaucuuccuuuuuauguuucucauuuuuuaggaaucugaagcuuuauuccucaaggcaauuaaagcaaauccaaaugcugcaaguuaccaugguaauuuggguaagaaaaauguucaacuugaaucguguugaaauuuuguuacuuuaaugaagugggugcaugucuauaaaauuaauguugggagaguaguuuuuucaaagcuagccuggcuuuaaaaugugguucuguuauugcauuaaaaagauagcaaagugauagccacacuuacaaaucucaauugcaugaccagaacagccccaaaguuugcccacucuauuaccuucucaugaugaaacucagauuguccuucuuuguguuaagcugagaagggugagauuggaucaagagaaugaggcuaugguugcgaagaguucuccuaguaaauuaaucguagguacuuuggaagcuugccauugaacuuaccuccuuuuccuuccuucuuacagaguagaccuuccccuuccagccuggucuucugcuuuauauccucuuaugccuuggcuaaaaugcauuuauaaucauuuauucccuagaauucauuucuugcauuuguaugucuccauaguuaagauguuuagagcauagcauuguugauguuuagaaugcucacagaaauguuuuuucaccaaagcuguucucuaccaacucugaagcuucucuucacaaaagccaaaaagcguccacagaugcucuucugcccauauagaaaguuaauuuuacuaacaaaaucacugucaugaucagaggcuaaucauccuaaugauuagguuuacuguaacuaucauuuuagggucagcucuugauaucagaggccuuuuuucuaaauggacccaaacaagcuauuacuuccccaaaugguguaaggaaauauuuaaaauaaacagcugaacuucugcauagucagggcucugggcagugccuagcauccaucacccccaccucccauacccagccuugcuuccuggaaauuucauggcagcacuaagacauugcauguacucuucuuuuugcuucuuuauguaauaauguuacuauaggcagauguaucuuaucuagugcuaugaagagcccuaggaguaacuggcaguaaauggauaaucaucagggagugugauuacaauaaauagaguuuucaguacaaacaauauuguuucauacaauugacuuuugaaaacuguuugcauaggaucuguaauauuucuuuguccaagaggguaggaauacggcacguuacucagaagcauucccagugaaauuuaucuccugcuauuucagcugugcuuuaucaucguuggggacaucuagacuuggccaagaaacacuaugaaaucuccuugcagcuugaccccacggcaucaggaacuaaggagaauuacggucugcugagaagaaagcuagaacuaaugcaaaagaaagcugucugauccuguuuccuucauguuuugaguuugagugugugugugcaugaggcauaucauuaauaguaugugguuacauuuaaccauuuaaaagucuuagacauguuauuuuacugauuuuuuucuaugaaaacaaagacaugcaaaaagauuauagcaccagcaauauacucuugaaugcgugauaugauuuuucauugaaauuguauuuuuucagacaacucaaauguaauucuaaaauuccaaaaaugucuuuuuuaauuaaacagaaaaagagaaaaaauuaucuugagcaacuuuuaguagaauugagcuuacauuugggaucugagccuugucguguauggacuagcacuauuaaacuucaauuaugaccaagaaaggauacacuggccccuacaauuuguauaaauauugaacaugucuauauauuagcauuuuuauuuaaugacaaagcaaauuaaguuuuuuuaucucuuuuuuuuaaaacaacauacugugaacuuuguaaggaaauauuuauuuguauuuuuauguuuugaauagggcaaauaaucgaaugaggaauggaaguuuuaacauaguauaucuauaugcuuuuccccauaggaagaaauugacucuugcaguuuuuggaugcucugacuugugcaauuucaauacacaggagauuauguaauguaauauuuuacauaagcgguuacuaucaauugaaaguucaagccaugcuuuaggcaagagcaggcagccucacaucuuuauuuuuguuacauccaaggugaagagggcaacacaucuguguaagcugcuuuuuaguguguuuaucugaaggccguuuuccauuuugcuuaauguaacuacagacauuauccagaaaaugcaaaauuuucuaucaaauggagccacauucggggaauucgugguauuuuuaagaauugaguuguuccugcuguuuuuuauuugauccaaacaauguuuuguuuuguucuucucuguaugcuguugaccuaaugauuuaugcaaucucuguaauuucuuaugcaguaaaauuacuacacaaacuagcaugaaaaugucauauugccuucuuaaucaauuauuuucaaguagugaacuuuguauccuccuuuaccuuaaaaugaaaucaaacugaccaaaucaucauuuauguggcuucugugugacuuggggaccauuucauagaauggcacuacaguguuuuccaaguucagagaacagagcgaguagauccacacugagaggaaugugauucucuggacucacguguugggggcaggucuguguaguguuucagucagugauuguaacuucugguguuugaaauguaucaagaaauaaagugcuguguuuaaaauauuucuuuuuuuuuuuuugagauggagucuugcucugucucccaggcuggagugcaguggcaccaucucagcucacugcaaccuccgccucccagguucaagcgauccuccugccucagccucccgaguagcugggauuacaggcgugcaccaacaugcccggcuaauuuuuguauuuuuaguagagacgggguuucaccacguuggucaggcuggucucgaacuccugaccucaagugauucacccacuucgucuucccaaagugcugggauuacagguauaagccaccauaaccagccuucaaauauuucuuaaauggucccaaaacaacaguaguaauuuauagcucucuuuaguggcuaagaccaucuuccucuuauuuauguuccuauagugcuucacuugucauacaauagaugcauuauaugcuuuguugauuuuuuuuuuaaagcaaacuucuuuuuuugaaacaguacuugucuauugagaguaaucacaaaaugauguuucuuacaaaagccccuucaggauccuucuuuuuuccuaccgauucuaaaacuagugccaaaucaaguugugcaaaucuggaccccugccuaccgacaaauucccucagccuucacugcuucagcuuccagcauuuccaucguagcuguuuucuuuccagggaacacagugauuaauuugauugauauuucaggaagucuuugaucugugcagauuuuggaagcauaacacacuggcucccuuuucuucuuuuuccaucuuaaggcagccacccucuuuguuucuucgguuuccuuucaaacaagacugaaguggaaggccgccucgcaguucuucucuuauuuggagucuuuuacuauuuuaauguuuuuauugcuaaugacaguugggaggcaggugucaaaacaaacauggggaagucacaaguuggagaaaucucaucaucucuuccuugauagcgaacaucaacaaaucuggaaagaggcuuggagcuggguguugguuuguugggugguuuaacauauguagcacaugugaaaaugcagcacuucuucccuguucuuguuuggauuuuuacaaauuuaaaugcaggcuuaacauuuguuucucuccgaguucauccugucagauguagccuacaggccuugacaggaccccuugagguucucauucugucacauugcuuacagauguucuuucuccuuuuuuuuuucuuuuucuuuuucuuuuuuuuuuuuuuuuuugagacagggucucacucugucauccaggcuggagagcaguggugugaucuuggcucacugcaaccucugccucccggguucaagugauucucccaccucggccugcugaguagcugggacuacaggcacgcaccaccaugccuggauaauuuuuauauuuuuuguagagacaggguuuugccacauugcccaggcuggucuugaacuccugggcucaacugacccaccugcccuggucucacagugcugggauuacaggcgugagccacugugccaggccauucuucacauuuuauuucaaauuauugacaaaauaucggaacagaagacugagcccuccaccaaagcacuggacaucuauguccauauucacacccaaccagccuggacuuuggggugagaaaacccagacuuggaccuggggcucucccacugcaguaugauacguaaggcauugagcauugcucaggcgccaguuucccaucuguacgguggugauaagaagaucccucauagccauaacguagggagcccaguagacccuccauaggugauagcuuggacuuuugaaagaggggcucuguugggaguacacagauccggccuuagauaccuuuauuccccauucacucaacacauacuaagugcuauguaccagauacuuucuuaggcugucugaauacuaagguggguggaagaggacacggucucuugcccucagcaguggacaguccagugagagaaaacaaaugaucaaagagucacaugaauaguagcugaggagggaggccugcucuaaccuggagagucaagaaagugcucccugggaagguggcuuccggauggagauugacaggcagaggggaggaagaucacuccaggcuggcuguucucaaccaggggagaugucacccuugggggcggggggcauuuggcaaggccuggggauauuuuugauuguuaaaacugauuggaaagugacaggggagagagaggcugcugcuguacaugcaauauucacaggacaacccccuacaaaaaucaacuggccuaaaacaucaguagucccaagguugagaaaacguggaccacacagaagcaacagcaucugcaaaggcccugcugcgggaaagcugaagucugaggaggccggggagggugcuugagaaggcuggccuuggugauaagccagcucauacaggguucacagaccacguggugcuuacuuaaacugggggagaauccaaagcaggucagugacaugauccaaguuagugagguuuugacaaggucacuuggcugcuggugagaagagaauuggagagaggcuaaggauauaagcagagaagccaagagaccaucccaggugucagcgucgaaaugaagguggcucuaugcagccagguggcaguggggcuggagaaauguggacaguuuagaguaaugauaaggagucaaucaacuagucaugggcaggagguggguggugugggaaugagaggcacuaaauaaaauucggcgcagaagccacugagggagaagcuggccuuaaacuggagagagaagguucuugagaagaaacaagauagggccccaaaucagguagaguuuggcccuacaaaagaggaaauaaggcuccuguauguauguuaagagguccagaugggaacagauguaggcaccucugcacauucauacaguuggcuaagccccaguugcagcauucaguggucauauuacaagaaguuccaccugacucucaacuucuucauaugaaaaaaaaggccggugcgguagcucaugccuguaaucccagcacuuugugaggccaaagcggguggaucaccugaagucaggaauuccagaccagccugaccaauacgguaaaaauacaaaaauuagccaggccugguggcgugcgcuuguagcuccaguuacucgagaggcugagacaggagaacugcuugaacccaggaggcggagguugcagugagccgagaucacaccacugcacuccagccugggugacagagaaagacugucucaaaaaaaaaaaaaauuaaaaaaaaaaaaaaaagcagguaaugucuaauuugcaagguuguugugaagguucaaguuaauauaauaaaaugucuacagcuguccuguccaguaagguagccacucaccacauguggcuagugagcacuacacacauggccaguucacgucaagaugugcuauaaauguaaaauacaugcuggauuuugaagaccuggcaugaaagauuaaugugagaucucaauaaaguuuauuuugauuacauguugaaauauuuagauauauuggguuaaauaaaacguuaaaauuauuuuccccuuuuuuuaacuuuuuaauguggcuaccaaauuuaaaauuacaucuauggcuugcuuuggagcucauuugauauuuccaauggguagcacugaucuagaguacaguaggagcuggguauacaguaccuaccucacaaucuaauuuguguuuuuaaaaaguauuuauugcaucuaauuauugcaaucuaauuaauguuuucauucuuggacuccuacaaggucuauauuucucaucuuugucccuaaagcuuuccuaaguggaccaguccgaugcccuuuggaaaacuggauuccgcaggccuaucgugauuaugugauuagcaaacagccauagcugaugaggaagacucuuccuuauagacuaauuauagcuaauacaugaugaaagaaugggaauuaggaaaucauccuuuuuucuucugguccccaaggaaccaguugauucaaacagagaucagcaauaaauaaaaucauugaugggaaacugcacuggagggaccaggcugucaccagccgaacccacugaccaauuuuuuuuuuuuuuuuuuuuaagacagagucuugcucugucccacaggcuggagugcaaugacgcaaucucugcucacugcaaccucugccuccuggguucaagcaauucuccugccucagccuccuaaauagcugggauuacaggcacgcaccaccaugcccggcuaauuuuuguauuuuuaguagagacgggguuucaccauguuggccaagcugaucuugaacuccugaccucaagugaucugaccaccucgguucccaaagcgcugggauuacaggcgugagccacugugcccagccccacugaccaauuucacaaucauuaagagugggacacccagaugugugucucccacugugaugcugcauacaguacauugagccucccaggauguauccuugccaaaaacaaaaacaaaaaaggcaguugcaccugaaucuaaccaaaaucugccuuuuuugaugccuaauguuaagaaaaaaaaaugcaaaaugacauuuuugagaccguaaguaguaaauuugucaugauaaugcuauuaugauuacauagaauauguguauauuuaagauagaaauacauacuaaguuuguagagguaaaaugauaggaggucugggauuugcaauaauuaaaagaaaaaggaagggaaaggagggaggagaggagagggagggaaagaaagaaggaagaauggauggaucucugcuuaucuuuucugacaccauucuugcaaauggucccuuucauauuguccuggggcaagucauauuuuugucuuuucgguaaaucuuuuaaauaucuuuguuuaauggugaacuuccugauuuuauuacugguuuuaggugccugcccaucuuuucccucccuggaaucacaauccaaauugcauuuuugagagcugacagcuucccuguccuccugagauauuuacuuagcuucuggaaaugugccuuccugaagcuuuugguucaaguuaauugcaccugcacagccguuucugcuucagcuuucacaaauugacuguauagccacuuugucccgcaguugcuauuauuuucacuuuaccaaugcacuuccaauuguugauuagaaauaguuugugcaguggcucacaccuguaaucccagcacuuugggaggccaaggcagguggauaaccugaggucaggaguuugagaccagccuggccuacauggcaaaaccccaucucuacuaaaaauacaaaaauuagccaguccugguggcucaagccuguaaucccagcuacucaggaggcugaggcaggagaaucgcuugaacccgggaggcagagguugcagugaguggagauugugccacuccauuccagccuggaccacagagugagacuccaucucaaaaaaaaaaaaaaaaaaaaaaaaguuuguuccaguuauuacccucaaaacuuaguggcuuaaaauaacaguuuaauuugcuuauugugaugguuuuguuuuuugagacagagucucacuuuuuggcccaggcuggaaugcaguggcgugaucuuggcucacugcaaccucugccucccggguucaagcgauucuccugccuuagccucccuaguagcugggauuacaggagcaugccaccaugccuggcuaauuuuuguauuuuuaguaugggugggguuuugccacauuggccaggcuggucucaaacuccugaccucaggugauccacccaccucggccucccaaagugcugggaguacaggcaugagccacuucaccuggccugugaugguucauuuuauaugucaacuugaguagguaggucauggggugcccagauauuuggucaaccaucguuauccugauuaauacacucaugcaucugcaaguugggcuggauucauccccaauagguccucucuugcuccaugccacaugagcugggguggcacaaagacugggaccuggaaugaaucaucuguggucuuggucacccacgucuggcaguuugugcuauuggcugugagcucaucuggagcugagaccuggaaugccaacacguggccucuccauguggcugcuuaggcuuccucacagcaugguggcugaguuccaagagagucaagcagaagcuaugucaccuuuucugaccuagcuuuggcagucacaaagugucuccugccaucaucauagguccauucagauucaagaggagggaacgcagaccucacuucuccaugggaggcaugucaacaucacguuguaaaaagagcacguggaaugggaaauuuugugauggcaucuuagaaacccaauuucccccauagaccuacauagcgucuaccuuccucuucuagauuauucuugggaaauuaaaacgucagcaugucgagucagagucuuaacaaaggcucugccaaagacgacauccagcagguauucacaucacuggagcaucccuccaggcacucuauguugcaguggugccaaucuggggauuuguauuuugaggcauaucacucauuuuccccacucaaccacgcagacaguacugaccuccugcaauaacaucacagaucuccauuucucucuucauccucuuccaguuggcuuccaccuuuaggggcaugcacuuccacacaggugccuaucuuuuggauuaaugagccucccucccucagcaggcucuuuaaaacaggguauagcuuuucaaagccaaaauccauccugacucacauucuaccacaugcugaguugaugacaccagaggcagggauuagagugaugcuucuacaagccaaggaacaccaggggccaccaaaugcuggaagagacaaggaagaauucucccuuagaggcuuccaggguagcguggccccugccaauaccucgaucucagauguccagccugcagaacugcaagagaaugcauuucuguuguuugaagccacccagucuguggggccuuguuaugacagcccuagggaacuaauagagcaagucacuuaaucuuucagcaccuuggcuuccuugucuguaaaauggggaauguaacuuuuucacaauuauugagauguuuacgugagaaaagacauauagaguccuggaccagagcuugguauaucaaaauauuugauaaauaacugaaggggggaaaacccuucacuuuuccuauaauuaaaugacccagaaauaauuucagauuuauauauauauauuuuuuugagggggguagacaggaucucgcucugucacucaggcuggagugcaguggugcgaucucagcccacugcagccucaaccuccugggcucaagcaaucuucuugccucagccuccugaguagcugggaccacagguaugugccaccaugcuggguuaauuuuuuuuuuuuuuuaguagagacaaguucucccuauguugcccaggcuggucuugaacuccuacuucagccuccccucaaagugcugggauuauaggcgugaaucaccacaccugggcaaucacuuauuuucugacuaguucaaguaguuuuaaucaguuacuuuguuuaucaaaacugccugaguguccuacauuucuaaucauuuauuuuuaaauauguggcauuucccaaagaccaauaaagcuuucuucuucccacuugugauguguuugagaaaauguuuucucucuugauuuaaauucuacuuuuauccaucuuguaaaaacaauuuugucucagcaguuaaauuuugauagcauuaauuaugauggcuagacuugagauuugucuugaauaucaaaacugcucauuucuagaacuuucugauaaaacauacagaugauagcuuucacaguacuggccuaggaaacugcagaccucggcaaacaaggugacaggguagaaaaagcaugggaacaggugugugagagcugugcuaggauuaacuucacuggcaugugucuuuuauuuuuaaguuccagcaauccaauuagauacaaacaacuccaauccuuccuuuaguuacuuggaaccugggaugaaucuguuaauuacuccaugccucaguugcuucugauaaaaauaaugguagugacacaggauuuucuucucagucauuuugcaagaugcaacaccccacccaggccucacucaaccacacuaccugcugcaggacacagccugcccacucagccugcccaggcccggucaagcuuaugcacugauuccccaguucuugucuuacacccaagaagaaugaggaugcacugacaaucaaagcgugagcaaggcgggguuacugaaugaugaaauagcuuucauggagaggggacgccgggguggugccccuacccaaaggugggaaaguuccccuaauauggcugagucugaggcuuuuuaugggcucagaauggagaaggggcaggcuguagguaauauuggaaaaggcaacauuugauuaguuaaaaggcauaauucagaaagaaucaauugggaaaggaugggcaaaaaggaacagaaguucucacucuggguugcagacuucauccgggaccggcaauccgaucuuucagcuuucaggcuguuuuuggccugaagguggcguuucacuggggaccugcccuaccugccuaggcauuuggcugccuccugucacuaucaguaguuguccuugcuuugguuaauuucuccucuaugaaauaagauuggacuaacccaggagucuucaaaaauaccuagaugcuuuauccuuuuuuaaaaaaacaugaacucuuauagagaaguccacuggaagaaguuauaaaggugagcugcuuugcaugcuuaugcaaauccucaucaaaaucuguugugaaauaucauaauguuugaaaugccaacacccgcauggaaauaaaguauuuugaagguuucuaguccugauauggccugaucaguuaaaaagguaucucagacugaaaaaguaaacuucugcccccugccauccaucaggcugagauagcacagauaacgacagcagcagagggagcgggaaauacguccuccaaggacacacggaugucauaucaggucaaaucacccccguccuugggugcuugcugcuuucuuacucacugagaggcuuccuucuggaaaagcauugacuaucagaagguuugcuguuugaaaucaucaggacggaaccaucucaacuuacccgggggauccgagucuccuugaaacaaacaagcagccucuauuuccaaccugggugcagaacuucccuuaaaggguuucugggugugccagucugcaucuauauuaacucuagucuccaaggauguagacccccagacuccagaccugauguugaucuguacucacagcucugucugccuugaaccugucaaaacacucuuuccuuuaaauuucaccuacacgccaccccuccccuaagucuucaaacuuuaccuuugcugaggcaucccaggauuccucuggccucagucuucucuccuugcaaugagccaauaaaucugacuuuauccaacuacaguuuugcaccugguggucuuugauugggcccagacaggccacgugccaaucaaagcagaagaaauucucccuggucuuuacuauuucaugcaagaauaaggaucaaauggaucgugugugugaaagugcuucacugagagaacuacauguauaggauuacuuacuggaacuaauaauuuuaacaaagagguucaaauauaaaugauaaguccugauaauauacaguucaggguauauuacccagcuuccccguuuaaaccucaugguaagagaacagguuuucggcucagcugggugugaguucaagccauugcacgcuuauuuacaguguaccuuugagugaguuauuuuaccucucagagccauuucacagguagaauggggauaauaauaucugguucauacuauuguucaaaggaugacacgagaagagucaugucgugccuggcauaugaggcccacucaauaugccuuaauuccccacauugaccacucaaagagaacccagcuacauuucauuuuguaaugucuacauuucuagacaccagauuagcauuauuuccuuuuaaaaguuacugcuugaauagcagggcagugacuugauuggcagcaaggugauaggguuagagaggcuguggccugccuacagcucuuucaaugucauuagcuuugagcaugguggauaguauauuuggcuggucagauuacuucugagaauucuuauucuccuauucaugauuggggauuuauucaacaaagcuaaggaaauaaccucauauagugcuuucuuccggucuuugcuuguuguuccugaaauuacagaagauggcaagaauagcauaaaccaucucaacugcaauugcuuggaaaauuucauacacuuuuuaaaaaagauacugcauaucuuuuguggagaaaaggucaaugccuuauucacaaaaaccugccggcaacccacaucaucuuuaaaacauuaauucuagaaauacugggauugaauuuaaagugagcgaacuuagcuucgugagguugguuuucucugcucguuaauuugucauggaaauuguuuagcagugagaccuguuguaacaaguaaaauaaucacacagaaagaaauaauaauccugcuguuuucaaauuuaacaacuuuuuagagccggguuuagaaguggaaguaaggaauccaaugguuugcagaauauacacuauuugcuaucuuuugcacacgcauuuucuaaauuagccuacuaauccuaugcugaaauuugaaagucuucuuguuaaguucauacugguuuacacagggaaaugaucagaaaguaaaccucacggcacgaggugcuugaaacauacacacaaagcaugaaggucugugcucgugaaacuggguucaguagggagacaguuacagaaaggagaggaagguguugaaacagaggcaagagcaagaaacacaguuugcagcgugggcaaacuuucuguaaaagaagauguuaaguauuuuaggcuuuacaggccauauggucucaguggcagcuacucaaugcugccgcuguccugugaaagcagucacagacagugucaacaaacaaaauucuauauacagacacugaaacuuaaaucucaugaacuauuaugaauuuuuuuccaaauauuuaaaaauguaaaacucuuuauuaguuugaaggccauagacaaccagguuggauuuagucugcaggcucuuuaggcccaaagaugauuauuaaaugguuuacugaaauaauuugguaauauuucaguagauuuuaugguguuauucaguuggacuucaagcuccuuauauagcccuccuuuugguuguuuaccucacauuauagcuagaguuucaagagacuuaggggauaucuuccccucuauuggacguuacuugcaaugcuggaggcacgcaggagagaaacacccagaggaggcuggccucguuugcauaauauuaaguaguaauguauuuaguuaaauaggaauauaaauuagacaucuauuacacccaggucuggaaaacagagcucagcaauuaccugcucugauuuaggcaaauacaaaugccaaacugguuaauucugguuaaagacaauuugcugguuuaaauccuuguaguugauaaggaaaauguuugcugagcuuugaacaggugcugauaugauuugggucuguguccccaccugaaucucacgcugaauuguaaucccgggugucagggaagggccuggugggaagugauugaaucaugggggcagauuucccccuggcuguucucgugauagugagugagaucucacaagaucuggcuguuuaaaacucuguggcaccuccuccuuugcucucucuuucuccuucucuggcuguuuaagaauuuaagaugugacucuuuccucuucaccuucugccauaaucguaaguuuccugaggcuuccccagccaugcuuccuguacagccuguggaacugugagucaaaccucuuuucuuuauaaauuaccaagucucagguagcucuuuauagcaaugcaagaacagacuaauacaggugcauagugauuugcugacugcaugacccuaagccuagaggaugugagaguuuguaaaaaggcagagcaaaggggccagaaugagcagcugaacccuuugcagugaaugacucaauuguaccauuuggacacaaccaaacagacuuggugagucgacccaguuccuaaaagcuaccagagcaguuggcuugccaagggauccugaauaacugaccaacccuaaacugacaagcccgggaccugcuuagauugaccagucuauuuccuugaggcacuuugugaguuuuaucucuaugagacccaagcuuugcuguggagcugucuucacagugacagcacccuggagugugucuauacacaagaaaaucuucacuuagcacccucuguccaccugcagaaucuuagacccuacuccuggcuagcugaaccagaaucuacauuuuaaaacaagacccuggguugacugacgugcacguuaaaguuugagaagcaccgagguacauccucaaaaggcgaugguuuucaaacuugaacuggcaucacucauuagaauguccaucucugggccccacccccagacuugcugacacugaguugacccccagagucaggacaccuccaguguggcuggagauugugcauuucuaaauacccaggugcugccagugcugcuggacugggaccacauuucaaaaacugcucuucaaacugugaguuguuuuccaagaaguuaaacugaaggcuucaucccacagagccuauucuauguuagauugggcuuccccagccuuaucugggaugcaacuuaacacuugucuuggcuaggcacuguggcucauaccuguaaucccaucgcuuugggaggccaaggcggguggaucgccugagcucaggaguucaagaccacccugggcaacauggugaaauccugucucuaccaaaaaauacaagaaacuagccgggcgugauggugggugccugaggucccagcuacucagaaggcugaggugggaggaucacucgagccugggaaacagggguugcaaugagccaauaacaugcuacuguacuccaaccuaggugacagagugagaacccaucucaaaacaaacaaaaaauucgucuagucugcgucaucuuuaauuuuccuuuaucagaagaauuauuuaucuauuugucucacuuuccuuugcugacaugauuuuccccccucaaaaaagagaugaaaguggaaucauucuuucgcuucaaaaaguuaagaauuacugcugucuuuaaaaauauuaauaugaggccgggcgcgguggcucacgccuguaaucccagcacuuugggaggccgaggcaggcggaucacgaggucaggagaucgagaccauccuggcuaaaauggugaaaccccgucucuacuaaacauacaaaaaauuagccgggcguaguggcgggcgccuguagucccagcuacuugggaggcugaggcaggagaauggcgugaacccgggaggcggagcuugcagugaaccagaucccgccacugcacuccagccuaggcgacagagcgagacuccgucucaaaaaaaaaaaaaaaaaaaaaaaaaauauuaauaugagcuagacaagguuuuuuaauacauuucaauuuaauuaugaaguguccaagacaagaaaaaacugugaaaaccaacgacuuauguaccugaugguuuagauuucuuuuggaauuguacaucuguucaaaauacaauuacaucugcauuguuggaaacguuuggauaaaaaccaguuuauauaaagguuucaaucaguccacauccaugagaaaguagaaagggcaggaaaugauuaagggggauuauugcuaaucugauaaacacagauuugugucuuucggagagacagaagugucacucucuccauagcuguaccauuccuaccaccuggcccccaaguggcauugcuuuaacccauugucucuagggaaaauguucucuuucgauuuugguucucaguccuauaauuucuggggcuuaaauuaguccuggagcuagggaagaggugaugucauccuuccauugucuccuucggccacaguuucauuuuaagaguauugguaaguaagugggcagugugacuagauggcggucuggacucgguaucagggcugugugcaugcccagcuggggggccuugguggugugugaugugauagauacacacaugguuggcauccccaagugugucugcgcuuggguucauuugugugugcauguguguccauuugauguggcguguccccaagcuuguggagucgucugugagucuguuuugugggguguggcccaggugugucaggguccaccaugcagucggggcuugagccugagugcccagguguguuaggguggaugugacuucuguggggcguccccaggugugugaagcugguugcgcugugucugcggcggggcgucuccggcgggcaucggcgugggugggucuggcuguuaggcggccaguugugcgagcggccacgugugugcgagggcgccgcaggggcuggcgggccucgcguuccgccugcagggggcgccgccgggggcggccugggagcagaggcgcgggcccggcccugcauuuccgcccuggcccugcccuccccgacagccccggcugccggcaggugaggcgcugagcccgggcgggggucggggcugcgccugcuccgccccccaggcgggguguccuggcgcccgcgggaaccuggggcgucgcucccugcgcggcg

SEQ ID NO: 17719 - RNA, 580 nt, Homo sapiens
agauuuuaucagauccauaaacaaaaauucuuaaaaaguagucauaauauaaaauagcagcucccaguaacuucuucaaguuuuaucuucagaaguugacucaauucaguuugccucauucuuggaagccucaucaaaauucuccacaagaucaggaacuucaucaucaucauccuccccaguagcaaguggugcuuuuccauccauggauuguuugggcaaagcuucagccagucugcuuaaacuguucagacugucuacaccaagcugguuuaagauguuggguagcauuucugucagcugcuuugucucggcauggccuguaauggugaaaguguuugcugccagagaugccugaacuuuaggguuguuaaaguggaucacuguuccuugguuuguaaacauaugcaccucuucaauaccaaagauauuguuuaccccuaacuucuuuaaggagaacugaaguuuuuuaucaucugcuguggcuguucuaugaaccaccuucuuccuucuacgagcaguuccuuucccaccaaugcacacuugugccugcaguuuggcaaguuuuuccugauucaug

SEQ ID NO: 17720 - RNA, 1307 nt, Homo sapiens
uuucucucucuuuuuuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagagccg

SEQ ID NO: 17721 - RNA, 593 nt, Homo sapiens
uuucuuuuuuuuuaacuguauaauuauuuuauuuuuaauguccagaauguguaauauaagggccagaucuuccuccuggacucaauuuuauaaauccuugauugguuggugaggucauuagggauacuuuuucuugucuaauuugguuucugggaaaguuuuuuucaaguccucaauggucaucugaucaaauggaauuaaguucuucaucuucuccuucuguuucucauauucuacaaucccggccuuugagagagacacccacucagcacaagauuucacaucuucuuugucuucagcauccagcugggcaguauauuuauccucuggcacagaaacuucagggcauuaagcuucuucucaaagucauccaccaagccugccuuggcuacaugggccuuguaguaagccuagucaauagcugguggauucucagguaaaguagccaaccuggaggugagggucucauuccaggauuucagggaauuagcaauggccuuuuaguucugggguaugaucuccacaaaagcuacacagucagugguuuuuagagcaaguuuucgcccaaccaucuugggauccuucaccaaccc

SEQ ID NO: 17722 - RNA, 10648 nt, Homo sapiens
caauuuuauugcaagccuuguuucuuuuuuuuccccccuguggaaauuuugguccuuuuggucuucuaauggcuagacugcacauuuaucugagaaggaagaaagaaaucagauauggaucuaggaauaguaaauaugaaagcauuaguauaaugaagaagaaggaaagauuauauguggaacuugaagcuugauuacuuuccacuuacuacacguuuuagacuagcuaaaaaagagaccaugaauggcacggcaugauuuuaucaccaaagggaaaggacaaaucauucucuaaaauuuauauuuuaagauaucuagguaagaaauguuuuuguuuguauuuuaccuauuuucuuccaauuaaaauauaauacaugacaauugaaaaaacuuagaaaaacaccaacaauagagaagagaauaaaaaauuaucuuuaaucccaugacccagaagauaaccauuguucuuuucuuguuuuuuuuuucgucucuggauuuuauuuaguuuuagcaaagugacauaguucaggucaaacauauucuuaaauauacgaaguuagggaauuagaauaggaaaucauucagggcauggccuuuccagucacacagaacugggucauaauccugguucugucacuuacugucuuugugaccuugagcauguuccuugauuuuuuuuuuaaccucaauuccuucauuuaaaacaaagagauauuaucuucauauaauuguuucgaugaugaggggagauaguguauaugaaguguuuagcauaaaacuuagcauauaguaaguacucaguaguugucuacuauuuuucuuguuguuacauuaucuucacuuaacauuauaucaaaagaguauuauaaugaagcuaccuaauauguucucuuucuaagcuggaaauaagcuguucuuuucauuguuugucgcugucauuugucccauaacuuuuuuccccccauugcugugucaauacauucucccucuuaaaacuggagggaaauuggagcauuucccucaacauacacaaugaagugcgagcuagaagaggaaaauuucagugcaaaaagugacaauaauacaguaugaauauaaauauaaauuaagucauauucuaaauucccuaaacuguuacuuucagucucagcucuauucaaaguccuucuccugauccugccauuuuucucucagggaacaugaaugguuuaaacaggaccuuccaaaauaucucuuuccugaggauccaucauauaguucaaccaugauugaugaugaagccuuaaaagaaguaugugaaaaguuugagugcucagaagaggaaguucucagcugucuuuacaacagaaaucaccaggauccuuuggcaguugccuaccaucucauaauagauaacaggagaauaaugaaugaagccaaagauuucuauuuggcgacaagcccaccugauucuuuucuugaugaucaucaccugacucggccccauccugaaagaguaccauucuugguugcugaaacaccaagggcacgccauacccuugaugaauuaaauccacagaaauccaaacaccaagguguaaggaaagcaaaauggcauuuaggaauuagaagucaaagucgaccaaaugauauuauggcagaaguauguagagcaaucaaacaauuggauuaugaauggaagguaagaaagaaauaacauuuugauuauuagcauauuuggcaaacccauagucuauaaaauguuuuauagaagaauuacuuuugacuugguuuuuguuauaccaugugcuagguuguaaacccauauuauuugcguguacgaaggaagaauccugugacaagcacuuacuccaaaaugagucuacaguuauaccaaguggauaguagaacuuaucuacuggauuuccguaguauugaugguauguacaucacacaaaacaacauagauuagaccuuguuacuaacuugguauuuuacgccuugauucuuuugaggcuucuugacuuguuccuaguaauucaacugcaaaggaauaaaaaaugugauuucuugugccuuugcaauauuaacauuuaugaaucuuauuuuucuuguaaucuuauagcauauuguccuuuuaagauuaucaucuuguaaaauccuuaaagccagguguagucugauccuaaggugauaguuuucugcugcauuuguuuuuuugguguaguucauuuugauaagagacaauguuuuauuuagaaauaaauauugacucuucuguaagcuuuuauuuauuauuaaauaaguuuucaguuaagaaugaaguuauggcaauucuucauuggccaauucaauugcauuaagcuacgcuguugagugcaggugugguggcuuaugccuguaaacagcccagcacuuugggaggcugaggugggaggauggcuugagcccaggaauuugagaccagccuuagcaacauacugagacucugucuuuacaaaauauuaaaauauauauauauaguaucaccuuugcuuauggaagguugcauagaauuauuagaugagguucacguuugaauuuuuuucuucuuuauaaacucaaagauaguacacacauaguagcagaaagacacagguuugagccaugauauguuggccaaaccaguuugucugguuaucuuuagguccauauaguacguaucugcuaacauauacuaaugcagucugaaauacggaaugaguuuuauuuuucuuguauuuggaucaaauuugcaaccuuagauuuacuaguacugggguauaccaauugaaugcccauuuuguuuuuguacuguguucccaaccuuaguuuuucuucgauuuuuauucauuggaauuguugcucuuuuaugaaauacuaaaugaaauaugaagggaaaguggaaaguaaaaagcacugagcugagacuuaggagaguuggguucuagacuuaccuuucuguucauuuguuaccuugggcaagucauuucucuggguuuguuuucuuaucaauaaagugaggggcuggaugagaugguuuccaguauacccuccaaauuuuaagugcaucgauucuaugauuuuaauauagagggauuacuuuuuauugcuauagaauaauauuuauuaaucccuagauuguugguuuacugggcucuuaaccuuggauugcaacugaugaguagcuauacuguacccaacuuugguuagcuaucuugagaauacauacuauauguaaaaaagaugaauaguuuaauacaggcucauugacuguuuuagaagguauuuagaauaagcgugcucuugauagcuggccagcagccccacuuaaagaagcaaauucaauacuguuacaaaaauuuuugggagaaggucauagacuauaauaaauugaaauucuuuuuacccagaugaaauuacagaagccaaaucagggacugcuacuccacagagaucgggaucaguuagcaacuaucgaucuugccaaaggagugauucagaugcugaggcucaaggaaaauccucagaaguuucucuuaccucaucugugaccucacuugacucuucuccuguugaccuaacuccaagaccuggaagucacacaauagaauuuuuugagaugugugcaaaucuaauuaaaauucuugcacaauaaacagaaaacuuugcuuauuucuuuugcagcaauaagcaugcauaauaagucacagccaaaugcuuccauuuguaaucaaguuauacauaauuauaaccgagggcuggcguuuuggaaugcaauuugcacagggauuggaacaugauuuauaguuaaaagccuaauaugcagaaaugaauuaagaucauuuuguuguucauugugcaguauguauauagcauaauauacacagugaauuauaggucucaggcuuacuugauuuuuggcuauuuuauauuuaguguacacagggcuuugaaauauuaauuuacauaaaggccuucauauauuauuacguguuauauauuacguguuauaaauuuauucaauaaauauuugccuagaauucccaagaccuuuauaggugauuuuguuuucugggcuccuuaacuucauaaauagcuaguaucuuccagcaguaguaacagucuggauaacuucuuccauaucccucccucuuuguuuuuuugagacagugucacuuugucacccaggcuggagugcaaugguguggucucggcucacugcaaccuccaccucccggguucaagugauucucccgccucagcuuccugaguagcuggaacuacaggcgugugccaccacacccggcuaauuuuucguauuuuuaguguagacgggguuucacuauguugcccaggcuggucucgaacuccugaccgcgugauccaccaccucagcuucccaaaguggugggauuacaggcgugagccaccgcacccggccuccauaucccccuuuuaaaauucuguaguguaugguaagucauaucagauaucagaccuaauuuaaauuucauuuuagcuuuacaaguccaaaaacacagaauuuauauauucagauacucuagcacuaauuuuagucuuaaaauauucccacgauauucuguacacaaaauguucuuuuuguuacaagagcugaguugcauauacuguagauaaaucauauuauuuuugccaauuucacaaauuccucuggcccaucaugucagucauuauugaguauaugcacacauugcuacuuauuugauuauguaucuuuuaaauugauucagugcauagaaaacuaucucuuacaaacuuuaagugcucugauaugacuucccccccaaauuuuauuaugaacauuuuuaaaaacagaaaaauugaaaaacuguuugguaagcacauguauaucuaccauuuagauucagcaguuguuaauguuuugucauuuguuuucucuauaccuauauauguauagauacagcuaguuaugcauauauaugcauauauguguuuguuuguguauguauauaugcuuuuuucccccugaaccauuuggauguuacagacauacuuaucaccgugaaaauacuucaaguaucuccuacagauaaugacauucuccuaaaaauccguaauaccauuguaaaaguaauaauuccccaauaucaucuaaucaagccauauuuaaauuucugaaguuaacuccaaauuucuuuauagcugauuauuucaaacuaggauccaauuaaaguuuacauaugacacuugguuauaacucuuuaguuggauauaacauuauuauuauuuugauaaaauauggaacaaaucaauucuauuaauaaguggucacauuuguuuugggcuuaaauuacuuuuuaaagauacuggauuuuccuaagauuucugauuuacacugauauuuuuuuuugucauucuuaauugcaucacacaauagauguaaaugaagauguagucaccucagauaaaauugguaucguguaugauaauauuguaucauuuauauuugccuuauguuaacuuuaagaaauugauuuuuuuguauuaaucauuuucccauugcaacagagcuauauuuuuucuauuuuaagaaucauauuuuaggauuauuuuuggcaaauacagugagcacuuauguaaccagaugauaaugaacucaaaugucaugauagcuugcauaaauggugacucuaguagauuugacucaagcacuucuagaaucaugcacugaauucaaaagaaaaaucuugcugcuuuuuguccagggcuuguucuauucaacuucuaauuugaaagcuguacaaaguaauagaaguuccauuuaaauaugaguucaaaacuguauuuacuuuuuauguggcccucucuuuaggggauucuaauuuuacuuagggucucuaagugcagcauaauguuccugauguuaacagaagacuguauuuuuaaaguuacaaauuuguauauggaauuaaguaauggcgcuauauacgcuguuguggggaggggggaagaaaaggaggaaccaauuaaauaggaccuuuuaaaaauuguuaauuuuguaaacuuugcuucucuuauaaguuauugugauucauuuuaguuacuguguuuuauuuugaaaauauuuaaauauugcacuucuauaaauaguaugauaaaugcacagacaauugcaguaaauucuuuuuuaagcuaggauauuugaaaugacaaccuuugguuaagugugucaagguugcaacagaauuuucacaauuuuuuuguuguuugcaaauuguuacuaauauugaagagguaagggaggcaaugcaaaugauuuuuaaucuuuuuuuauuaucuuuucagcaguuuauauuuuuugugacuuuaugcaaccauauuuuuacuuugucuugacaacugaaagauguauaagguuuuuugccagaaauguacuguauacauaguuuuaaguauaacagauuuuacugauauguaaaaauuuugccauuaaaauaaaugauuucucacugagaggaacuuuucuaccagguuggggcauaugggagcuuaauauaucauaucuaauuuaaaauaauuucacugaaauaaacuccauugcuuuuaccuaauuuuuuucuugagaugcuuuuguaguuuuucagaguuuuagaugauuuuauacaaaauccucugccuagcacugcucuuuuugauguuguagugacaccauuuacauugaauuaaugcuugguagccuggggcuagauguggaacuccauggaucuguguucugacuggcaccuuuggaaugaaagaaaagugugugcuguccaaauuuuuuccccuuaauucuuucccucaucuucucacccauaauagaaauuuuauuuccauugugaguucugacaagaaugaaauuccacauacaacauaacuguaaauuguugguagguagaaguuaauauuugugguucauguauauuuugaccagaguauauuuaaguauauaauuucagcuuccuugauuuagaaauaugauauaauaaagaaaaacuccauuuaucaucuguuacaauguacuuauguuuuuuaaccucugggaaaacucaguggaaaaaaaaaaaacuaaguaucugugcaccuuucuuucuaacaauguaccggcuaggugcgguggcucacaccuguaauccuagcccugugggaggcugagguggguggaucaccugaggucaggaguucaagaccagccugccaacauggugaaaccccgucucuacuaaaaacacaaaaauuagcugggcgugguggcgggcaccuguagucccaccuacucgggaugcugaggcacgagaaucgcuugagccugggagguggagguugcaaugagccgagaacaugccacugaacuaccagucugggcaaaagagugagacucugucucaaaaaaaaccccaccaaaacaacaacaaaaaaaguaccuagaaauauaaaauauagugccuggccacauuuaaauugucaaacauugugauuuuuaucucgacuacaugagucuugauuucaucuaaaaaccaaccacuugaauaaaacaugauagauacaauaaaagccaaagcaacugccauuuaucaguugcuaacacuugauuugguuagaauccuacuacuguuagaauucaauuaauauuaaauauuguauccauaugacaugauuaggcaggggcuugugcuagauuguugacacucuguuaucuuuaaaacaacaaaagaaaacugcuaaagagugcuaugaguaguauauaagguuuuuuuagggaauguauaaauugcuguagguauuuaccuuggcuguacaagaauuguccaagaaauucuuguuugaaaaaucagaauuuuugaacucuuuuauuuauuguaaauaaacuauuuacuguaaaugccaauaaauuaugauaaauuuaaaggauuuuggaaaaugaucauguugucuuaaaaagacagcauaagacauauauuaaauauauuaggugaaucaagaucauagaccagucagaguuaguagagaaguagugggugaaguauaaaaacuuagugggagcuacccuuaaacacaguagaggagaucaggguuagguuacuugagagauuuagcaaagaccccuagguagggggcacagcuucaaguaccauuuacucacucugcaaccucuauuccuucuuauuggcuacuaugaacuaaugacacuaugaaugugaccauaagauaaaucuucccucugcaugucuuguuagggagguacauguuuucuuauuuaagacuuucauagacauauauacagaaaagugcacaaaugaguauuuggcuuaaugaguuuucaguauuucagguacacaggaaacaugaccauguaaaccucuaggcagauuaagaaacauugccaccaucuuagugucuuucauaauuaauaucggaagugauaaacggucacuucugcccucuucuguagguaacacagaccaaccgugguacaauauaggaaggcagugcauaaggaugugaaugccaggagugaaugccaucuuggaggcuggcuaccgcagucaugcauugaucguuuucaaauacuacugguucacuuaugcagccugcacaaauauugauguauuuaagcaaacaauguaaauaaaagucacaacugauaaucacuuauaucagaaaauucuggagauacugggaagcugccaagaucauuauggugaauaccauuuuuccaaaaucauauuuuuuuuuugccuaaaaucuugaauuuuaucauuggcaacaaacucaauuuuuuuuucuuuccucccucccucccuauuucucuuuuuuccuuuccuuuccccuuccccuuucccuuuccuuguuuuucuugaaguuacagauucccuuuguucauuuucaagaaagguuugucaaauacccaaguccgaauaaccgguuugucacucaucuuaguaaaauuuguguuccaggaaaaaaaaguauuuacuucaguuuauaaugccaucucacaguagcucuucuuugauacgucauacuucaauaugcagcagaaguacuuugugaggacuuccaaguuuuuacaaagaauauuaagugucggagugguuauaauaaaguaacuuuuacaacuucaucagggauauucucuggugacagcguucauuuuuccauuuuuuuuuuuuuuuuugagaccgugccuugcucugucauccaggcuggaaugcaguggcaugaccucggcucacugcagccucgaccucccaggcucaagggauccucccaccccagccucccgaguaguugggauucaggugcgugccgccaggccuggcuaauuuuuguauuuuugguagagaugggguuucgccauguuggccaggcuggucucgaacuccugaccucccaaagugcuaagauuacaggcgugaaccaccgcgcccggcccauuuuucuuacugugagcgugugguggugaagagcuccaguacgguuuggugucauuacuguaauuccuguggaggggccagcaccuugaccuaccauugcuuuuccaccaucagugcaaaugucagcauugugcaaagggcaaaucacgucuucauauuaguaugaaaauaauuuuggcuuugaaagggugucauugacccucaggacaaucguuggucgacaucagugguucucaacggggcagggugggagggauaguuuuucuuccaggggaaauuucacuggggaaaccauuggcugucacaaucgacugguggugacaucccguggacagagaccagagaugcugcuaagcacccuacaaugcacagaacaccccgucccccaacaaagcauuauccaguuugaaauguuaauggugcugaggcugagaaaguaugacuuccaaaaaugagucuuuugggcaggagaguuggagaaauuaacaaucuugauuaccuuuauuacaugugcucguuuauuuucaagacaugaugcacagcuacguucuggcuguaauucugccuucuggguccaacucacuuguaacuuuaacgugaagccugcaguucagccucgagccucccugacuagccuccccgcccggccgccucgagcccuuuauaaccgaauuuugccucucuguucucugcgucuggccgaccucaucagcuaggcuauaaaccccuucggggaaggagcauauccuaauccuuugaaucccguaaaauaaguuuuccccucaccuuguuccccacugacgggacgcgaggcugcgcgguaccgcgggggcggcuccucucggugcgcucuucagcccgcgcagccucauuuucccgcgcucgugcgcugcggucacucagggcugcugcuagagggcgcgcccagccgcguggcccugacuacuacaaaucccagaaggucaugcagugggggcggccgcggugacuucugggauuuguggucccggagaagagauuggcggaggggaaagacugagucgucuuuccuuugcccgcuucuguggacuguucgaacgcccaggggugggccaaacccguuucuuaggaaaccaggaauccagggaaggcagguaggaauuugggcgugauaauuucugcuuccaguggga

SEQ ID NO: 17723 - RNA, 2029 nt, Homo sapiens
gcagaaagacaggaagcccaagaggucaaccuggagguuuaauuuggaccuuacucauccaguagaagauggaauuuuugauucuggaaauuuuguaaguaucauucuacucggcuuauuuuuguaaucagaguuauugauaaugguuuaaauauauaguauuugauaauaaccuaagcucuauuccuaggguaccuucccuagugaauaucuaggguucucuucccuaguuuugcauuuuuucuguuuuaaaauaggagcaauuucuacgggagaagguuaaagucaauggcaaaacuggaaaucucgggaauguuguucacauugaacgcuucaagaauaaaaucacaguuguuucugagaaacaguucucuaaaagguugguacuuuugcaaauuuuaauaaaacuauaguaguuuuggaauauuucauagaauauguaguuauuacauguauucuguuuauaugcaagaauaaauaugaacuuuagacuaaaggccuacauaaaugggaaauucaguaaaugagugccaauugcugagucuaguuguaagugucauuuauugcuagaauaugagccaguuguguccacagucccaguccaguaaauuauaggcccuguaaauccaaauuguauauaaccuuuaaugcugaguacuuuaguauuugaguauguugcaagaaacaugucugauguguacauaggagaauugucucaaguuauuuauucaguagagguagccaguuaaagucaaagucuuaacaucuugcugccaguuuuuauuuguugaauuuauucaccaaauauuaaauacuacaugggcagcacaggacuggguaacccaacagugaaccaagcaggcaguuuacccaccaccaagaaacuucuaguggagaagagagagugaaauggaauuaaucaagcagugauaagugcuguaagggcauaaaacuaguugcagaguuuuuggguacguugguaaguuggucaggaaaugaaaugcagaagugagccuugcaguuguuacaggcaggaugaaccagaagccuggcagauuaaaguaauaguaacaaagccagugugucugggguauaguguucugggaggaaugcaugagauuggagggugucuggggagcagaucuugaaagccaugggauguguaaugggaagcaauuguuuauuguggcugaaaaagacuagggugauacaucugguggaaacugaagauguaagagcuaauuucagugagagacaaugauggcuuggacuaaagugguugcaguacauguuaacugagauuauaaucacuaaggauucagagauaaaaauguaguagcuguaguagcuguaaaucaaguaucuuacagauaaucagauaauuauuguaaaauacaacucuaguuacauuagauguagagagagcccaagaauuuucagagaaguugagacuuaaugagcauaguauggguuuaacccuauuauuaauagguugccuguugagccggggugggauugggagcuagggggcuugauaguggugaaggagguguuaacguuuucacauauauauacacagauaauauauuugaagagugaaaucauauugcuuaaauaauuuggcuguagcaguuugacaagagaaugcuacccuaacaaucuugaacaauauauaguguggcaguaugacaagaggaugcuacccuaacagucuuacacaauacauccugugaauggaaggaugaaauauuuuggaggaagcuagguacagaaaagaugaauaugaugauguauauuuuucguauaguaaaccuuuacauaguaggaauuguauuucuuaaugaaauuuauguuuuuauuuuaaaagguauuugaaauaccuuaccaagaaauaccuuaagaagaacaaucuucgugauuggcuucgagugguugcaucugacaaggagaccuacgaacuucguuacuuccagauuagucaagaugaagaugaaucagagucggaggacuaggcaaaggcuccccuuac

SEQ ID NO: 17724 - RNA, 136482 nt, Homo sapiens
uguugugacugaaacccgucaauauggcggcgaucggccgcggccgcucucugaagaaccuccgaguacgagguaagcccgcugcaacccucacuccccaccgcccggcgcccgccaccccuggcacuugccuuccccuggcccuggguuggggagcgagccggggcgcuggccggagccagggcagccgcagcuggccugcgagccaauccuaauuggggcugugugucuguuucgcgcagggcggaaugacagcggcgaggagaacgucccgcuggaucugacccgagguaacgcggggcgccgcgggcgccgcgagggcgcgcugcuggggaggagccggguccggggcugggggccagaggcaggggcgggccccgcacgggaccggcggggugcgggggccagagccggagccccgccugccggcccgcgggaaccgagcccggggccgccucgccggacccaucccccuacccagcgcccgcuucccucgcccgagcccuucuccgggccucgggcugcugcgggugcgggggagccccgaguggaacucggcagacccggcgacccucugggcucgagcuccggcagagugguuugcaccuaucccggaguccggcagcccaagcuaggggcagcuggagggagguagaggcuguuauuuagguugcaggaggauguuugagggaagagcgaccacauccugcccuccccguccccggagcagaagccggaccugcucggugcuugccgacugcgugacugcuuuccccuuugcccaccguccuguggggacccgcagcauugauaacuugguagugaaaccuagaacuggucauuacugcuaaaugucugguuuaugcuguuucccuucugcuucccuuucccgggccgcugggacuguaguuggcuaaagaccgcccccucacccugcugcagguucauuguuuaccuucugcaguggagauggguuuguuuacaccuuccgaacuggggaaacucgggugauauuuuuaaugaccuaaucccguuacuagccaguguuuccucuaucacuuacaguacuagaguuuauucgacauuaucucguugaagauuuaguaguuacguacaagauucuuuucucuuccacgguaaacaggauugagccuacugauuccgacgaagucauauuucacacgggcuguagcuuggaguguaacccgguucagcuguacagaaucaguuucugaggucuauaaaacaccuuaggaaguaaacaaaaaaacuuguuguagacauucuguaugagaucaguuuuuuacccuaugucguaccugacguaaugacuguuaucuacaguaauuuguuaaagcugggcuccuuguugacaacggcuagagugaaagcauagugcauuuucuaauuuguuuuauuuugcuuaucacgauguaagauuacuguuuuauaaacugaauggucagcuuucacuuagcuacaagaguacauuuuuauaacuuaauauuuuauucugaaaguucagggacuuaguuuugggugaacuagguccuuuuacaagacaguuucuaaaauauaauacaauauaguagagcuuaaauccugaaaauggcuacuaauuagauuaucaaugcacuaauuuccaccauuuuuuucagcagaucgguuuugagaauuaguauagaaagauguaaagcuuuugacuucugugcaacuguuuggaaacuugacuauaacacacaugugaaaaaucuauauaaaauagauucacuagaaaacuuccuaacaaggauaacuucuacaauuucaggucuguaaaagauguaauuagugagugauuuaauuuauauacaggcauauguguuuuagaugaaggugaagggagcccuuaauaaacuugaguuuaacuugugcauuaaaaaccugcucagauguggugcuggaaauauauaguuguauuuuaaauugaguucgucgagcuccuauauauagugguuucucugcuuggugucaaaaauguugaguuguggaagagcuuagguacacaucugauuugauaauuuuggcuuacuccaguuuuacugaggcacacagguaacuguuuacuauuuaaaaugccauauuaacugagaauuuaguaagcaccuauguccauagguauuuccagguuaauauagauagugcagaaaaugcuguuuucggcuugcccugacaaaauguacuucaguuuggaauaaaguauacacagccauuuaaaacugauugcaaaaauaaagagugagggauuguuugagaucuguauuucuaaaucauaaggaaguuuggaauuaaucugaaucagucauuuuauagugauacuauuguuuuaaaaaguugcuguugugacagacauuucauuguucaaagaaggcuugaagaaaauucaugaggaauuaaaguuuaguaauaauuugagaacugugaggcaguuuggguugcagcugaagggcagcuguuuguggauuagauuacaguauguaaaaagauaaaguuugggcaaccaaaaauuuuuuuguuuaaugccaaggcaguguuugcuuuuauucuuauuuuuuaaauuuaaucuuugagagauucauuguguaguuaccuaauaaagcucauuauaaaauagaggacauggucauuguaaucccuaaaggauccaucaauguguagugaaaagagaguugacuauaaagucaaaucauucuggauuguaaccucagcugugagauuuaauaguugggugauuuggggcaaguuauuugaccuugcuuuaccccugauuucuucauuucuaaaauaagagauaacuucaaaggguuaagaaugugaaaaguaaaugagcuaguucuuaauuaaaguacuuggcauaagaccggauacuuuguaagugauauuuaacauuaguugccuuccuacauugugaaaucacaguuuuaaaacucacauuaaaaauacuuuaaacgguuguuuugaauauuauaaacuuguuaauaaggaauuaugguauucgagcuucuuuuuuuuuugaaacauacuguuauacuaauuggguauagucuaucugaguuagaguucuugaauauaacaauuguaaagcaaucugugacauuaccaauaaauuaagucuaagcgaagugcaguauguuauauucacuuaggauaaaaugugauacuguauuucauagaaccuuagaauuuuugucucugacaccaggacauuucauacuauuuaauaaugacuuggcuagccuugcaagcuucuugaggcucagaagaauucuaaguuucguugguuuugguacuuguguuagugcugugguucauacauagagugccucaguuaaaaauuguugauggauuaauuuuuaucuaguuuaggaacuucauuauaguagacuuuacagucagcguauugguaaugguugcucugaguuuuguucagacaacuacuuaauuugugaaaguccccaauauuugcuaaugauauuauuaaauacugucuguaaugcaugccaaaauguauuuugaagcccaaaugcuuccucucgccauuuguacugcaaggauagacugucuuaucaguccaguagugcaucucuuuacugguacugaaucacuugaaaagauacaguguucuuccuggguaaaccccuccugguauacuuuaauuauuguguucaaagugaauucccagaauauggacacacuaguucaaauauaauuauuagaauauaauuuauuuaaaaguauaguugaauuuuauaauuuuugauuaacuccuuuacguuuccacuaagaacuaaaaaacugacucucuugguugcugucuaauaccuagaaaagcagaaagguuccaaaaugauguagauuugaacucuaacuuuuuuuuuuuuuauuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuuuuuaguagagacgggguuucaccuuguuagccaggauggucucgaucuccugaccucaugauccacccgccucggccucccaaagugcugggauuacaggcgugagccaccgcacccggcccugaacucuaacuuuuuauuuuccaguuucuucugguuaggaguuuucucauuuguuuaaucauucaguuagacaaaauggacauugacugaacauuuauauaccagaugcugaauuaacugcuggaagaauaaaaaugaggaaacucuuucccccuuuuaaggguuucauuggaauagacauaaggaaaugauugcagguggaaaaauaaauuaaguaaucaaacuauauaggaaacagagguaacccaauaguagccagaggagagaaugauuaacugucugguggguaaaaggaucagagaagucucauagagggguugacuucuuaaaagaauaaugguggacauaguggaaggaaauaugugcucucuugggaauauaccauacccugggaaggggaaaguuaggaagcagaggagcugccuagggugcugcugauauaaucugacggaugauagaagacuggaccauggcguuggcuacagaaaugaagucaaauacauauuaaaauggaagaauuaucuaauuugcuuucuucagauuucagacugauuuuguaguccccccacucuaugcagugaauuuuauuucuuuauuaaaauguagaggcugcccauccagugugaauuccucaauugucugcccagacuuacugucuuuacccugauucaaagaauaaagcguugcuauucuuuuccaaggguaacuuggaaaaacguuuaugcuucuaauacuguuuccucaagauucuuuguagaacuaagaucuucucuucauuucucccuuacaguuggcucaguuuucucauguucagcaagcaauuuuuauguucuucacauggaccagguacuauguuaggcaugggcugaaagugggagauauggaaugauaacgacaauauuacaaaaacuuuuuuuugaaggcucuacagacagaauaguuugucuucacuccacaacuuuauugcuuaacaaagucuuguaagcaaaacucucccucuguacugaaaauaauuucuuaaaagaugcuaguaaccucuugcaaaauuuaugggcauuuuuaaguuccacauucuacuauuauacauacuauuacuauaauacuaguuuugugccaggcacugauuucauuauuuuacuuaauauucagcuguuuuagcuacacuuauugucucuguuuuacaguugagaauauaggcuuugaaauuuuaaagggcuaaaacucaaacagguaacuuaaccagugucacagggcuuagugagugacugguaugugucugauaaucaucucagaguugugauguguaaaacuuugcaccccaaaguguacccacuuuucacauucuagguauuuccgccauccucuguuauucaagcuagagaucugcugcuuauccucuuuguuguauugcuaaacuccucugauuagcuucugaaauagcuguugaauucagucucuccuucuguucccauugucaguucauauccucauuaugucaucguguggcaguaauaucuucucaccuuuuuucacucggucuacuguaugccugccaggauuauuucccagaaaucuagaucugaucuuguuguucucuuaaauaaaaaaacaaaacaaaacacauacacacauuuucuaggcuaauuuuugcucacagaauacaguccacauuucuuuaguuuggcauucaaggccuuuuuugauuuacucccauaugguuuucuucuguacuauuuuaaccauacacaucucaauauaucugccucucugcauaguucacuucauuacauacaguccuucucagagaggauuggggagaguuugccagucuaaagcaccaacccccauuccaccucuuucuccguggagacuguaugccccuacuugagaaucuuucagucaaagaagaauguuugcuauuccuugaacauggcauguaguuuaauauucgcuugaccuugcguagguauuuccuuugccuugaauugcauuuccagcacaguuuaucuauagaaguccuaauucuuuaagguugaggucacaugccauuucuggagaucuuuccuuaucccagugggaauuuauugcuuccuucucugcuuuuuuacgucuuuauuuauuauuuucuaaauugcaguuaccauugucuuacuuuaguucuuuguccaguuucuucccccuucacuagaucuuuagcuucuugagggcaggaggccuguuuuacccauuuuuaacauccgcuucccccagcauccaucagauaaucacugaggcauuaauugacuggaagaagggagugagagacaugggaaaaagaauaguacaguauuaaggagauuagaaggaaaagaguacuuuaagauuacuguccuaagggacaaugaaauugauggugccauaaaauggagaagucauuuugggaaggaugauaaugaguucagcuuugcaccuugaauuucacgugauuauauaaauguguaaaagguggcagcaaauacuggaauggagguuuuaguugcccugaauuucuagucugauuguucuguguguaagauguugagaaaagggauauaaauggaaaaagagcugaagauuugaauguaugaaaauagauaagaugaugaggguguauaucauaggguaggaaucaauaagaagaaaggagucaauagaagagaagagagaaaauugugaucucuuaagcuaaaacaguuuggauauuuguccccacccaaaucucauguugaauuguaauccccaaugcuggagguggggcuuggugggagguguuugggccaugggaauggaucccugauggcuugguguuguuuuugcaauagugaguucuggcaagaucugguuguuuaaaagugugcaccuacccucuuacucuuucucacuccuacuuugccaugugagaugccuacuccugcuucaccuuccaucuugagcagaaacacccugaggccucccgagaagcagaugcuggcaccaugcuuccuguacagccuacagaaccaauagccaauuaaaccucuuuuaaauuacccaggcucagaugcuucuuuauagcagugcaagaacagccuauuacagaaaauugguaagugggcguggagcauugcucuaaagauaccugaaaauauggaagcagcuuugaaacuggguaacaggcagagguuggaagaguuuggaggacucagaagacaggaaaaugagggaaaguuuggaacuucuuagagacugguugaaugguugugaccaaaaugcugguagugauacggacaaugaaguccaugaugaugaggucucagguggaaaugaagaacuuaguaggaacuggagcaaaggucacccucauuaugcuuuagcaaagcacuugguugcauucuguucauucuguagggaccuguggaaguuugaacuugagagugaugaccucugguaucuggcggaagaaaugucuaagcagcaaaguguucaagauguguccuggaugcugcuaacagcccaugcuaagauguaggagcaaagaaaugacuuaaaguuggaauuuguuuuuaaacaggaagcacugcauaaagguuugggaaauuugcagccuagccauguggcaaagaaagaaaaagcuuuuucaggggaggaauucaagcaggcuauagagcaaccacgugcuagagauauuugcauaauuaaacacaugccaaagugcugauauccgugaaguuggagaaaaggccuucaaggcauuuuagaaaccuucacagcagccccucucaucauaggcccagaggccuaggaagaaagaaugguuuugugggccugggcuagccgggccuugcugccuugcacagccucaagacacugcucccugcaucccagccacucaggcuuccagccuuguucaaaggggcccagguacaguucgggcugcugcuucaaagggugcaagccauaagacuugauggcuuacauguauuauuaagccugcaggugcccagagugcaagaacugaggcuugggagccucugccuagauuucagaggauguaugagaaagccugggugucuaggcagaagccugcugcagggguggagcccucauugaggaucucuauuaggguggggccaaggggaaaugugggguuggagccccccagaguccccaguggggcacugccuaguggagcugugagaaggggccuaccauccuccagaccacagaaugguagauccacuggcaguuugcauccuauaccuggagaagccacaggcauucaacuaaaaccugugagagcauuccugggggcuaaacccugcaaagccacagggcagaguugcccaaagccuugggagcccacccuuugcagcagugugccuugaauguggaacauagagucaaaggagauuauuuuggagcuuuaagauuuaaugacugcccugcuggguuuugaacuugcauggggccuguagccccuuucuuuugguugauuucuccuuuuugaaauggcaauguuuauccaaugccuauauccucauuguaucuugggaguaaauaacuuauuugugacuuuacagccucauaaguggaagggacuugccuuguuucagaugagacuuuggacuucagaguuaaugcuggaaugaguuaagacuuugggagacuguugggaaggcaugaguuuauuuugcagugugagaaggacaugagauuugggaggggccgugggcagaaugauacaguuuggauauuuguccccacccgaaucucauguugaauuguaaucuccaaugcuggagauggggcauggugggagguguuugggucaugggaguggaucccucauggcuuggugcugucuucgugauaguagguuuucacaacaucugguuauuuaaaagccuguggcuccuuccccccagcucccucuugcucccgcucugccaugugagaugccugcacacgcuucgucuuugcuaugaguaaaagcuuccugaagccaucccagaagcaagugcuggugcccugcuuccuguauaggcugcagaaaugauagccaauuaaaccucuuuucuuauaaauuacccagucuuagguguuucuuuguaacaaugcaagaauggccugauacauaagccaggagaagaguuuugaauugaaggggcugcuagacuguugcauugaaguugaaguccagagaacgagguucugcuuuaaucugaggaagauauggcaugcuauuuaaccucucuggcuucaauuuccucaccucuaaaaugcauacuacuuuauacuugcagcacuuuagccuccuaccuuuguaauucucacauaucacuacagaccuggaauauugaaaagguuaaaaagaaagcauuuguagccuuguuaaaucacugugaguaguagucccacaaacaauaaugaauacauguaggaguggugguauuucauagcacuuuaaauuuaaauuacagucaacucucaauuuccuuuuaagugauccaccugcagugacuugcugccuccucccgcucccaggucucaggcuaccaagaauaagacugcgaaaagcacaguggggugagcgaaugauuugcuugccuguguaucugugccucugucaccaagcuauuaaauacaguccauucucaauuaccugccuuaaaaagaugaauaaugguagaagaaugcuaaauauauaaucuaaauacuuuauauuggugagaaaauauuuuauguucuuuucucucccacaauagauugauguauauuuucuuuuacauuuuauuugaauuauuagcacagauuuuuguuuccuaagcaaauacuguuaguggaagaacauaaacagguuaaaauauuuguuaaucuguaugaauaauugaaguugacuguuaaugcuuuuugggucaucuacagauacuguuauuuguguuuuuuuguuacaguggccagguuaaaguugaauggcuccuuaaaaauuauauccauacaacaaauguaguuauaaaauuacagacauaaaaguaaauugaaaauaauuguguaaaacuaguuaauacguauaacauucauauacccaaaguaauaggguugaaagagaaccuaaauauaaguauauucuucguauuccucuuuuagaggcuuccagccagauugcguaaacugagcaauguaccuggaaugaugacauuuauauaaaauauaaaauugaggauauucuaaugcuuuaaacauauccuguuaaagaugucaguaagaaauacagaaaacguuuuuuuaaccuuaauuaccuggauuuucaagaaucugcguccuucaauuacuuuuccuuuuuuuuuuuaaccccauuguguuaauuuggauuuguaaugguuuuauuaaugucaaccaguauauuuuugaucacauggguuaauuauauauauauuauaugaucacauggguuaguuaauacuguugugguugaggaaggcauacaucuuccuucagggaguuucuguugggauauagcucuaucaguguacaguaaaagacaguaguauuugaagcauaugccaauuaucuuuguaagggacucuaaaagcuagaggaauucagaaaaaaugggagauagguaaggaaugaccuagaaggaagaucucuuagaagugaagauauaaugacaauuguaagaccuuugcauaaaagaguagcaauucaaauagguagagcucugcaccaggguuuuaaaacuuuuaauuuuuugaaugaacguuuuccugguacauuauuuaguauuucaagauaauguugagaaaaaguuagggguaaguuuuguuuuccuggauauaaaucccuuaacuauugaagaaugauuauauuacagacaggcucuucuggccuuagaagguacugcuggacugaaagauuuggagcacacugugaaauacuaauuguuugcguguacuugugacuaugagucuauaaaugucugcauuccagacccaagccuagguaauuaguaauuuuuuucuuccauuguuuuguagugcauaugucuugcaccuucaguaauacuguuuaauggagggagugugcauguucaaaguccuuuguaaauuuaucaaacuuauuucuagauguaugcagucuggaaauagaauauaaaugggaugggugguguuuuuauuuuguucuacacuaaaaucaccagauuuucugaucucaaaauuuaaacauguaaccugacagucagaauauuugaaaugaagauuauccugaaaaccacagaauguuucauugccaaauucagacacccuacccagcccucuagugauuuagguacaggauaaauaguguuugaggaaauuauugcucuauuauagcagcaaaacaagacuucagggauuuuagucaucuugcauuuaauccagugaaauuucauguguuuccuauaaugaauagagaaugaagagacauagaagcuguaaacaaagaagguugccaaguaauuuaguuacuaagaaggaacagcuugucagauaaaaguguauuuagcuguuuuagaugugugcacauacauauuuuuaucaguaguuucauacuucaaaaaaucacaucuuaaaauaguauugcuauuuauuuccaugcuuaguguuugacccucauauaauaaaauuuuuaauuacacuuuuuuucacucauaauucuauaaugcacuuucuaauguuuaccacacuaccgucaccaccacuccccucccucaagaagaaaaaaaaaggaaaaaugaaaaacucugaggggaauggaguugcagggagagacuccagugguuggaaacacauuuugagguaggugagcugugaacucuuaacauuuagccaugugguaguuucuggauauguaaucagguagcaaguggaauauugugaaacuguuuguucaguguauguguuauaaguuuuuaaucauaucugucacaugugguauuaguauaaaauuauaauaauggauguuugaauacuaagcuauuuccuaccuuguuuauuuagagugacguauuacuguaggcuauaacuuucagcgguguuuuuaauggcauaacaguagaaagcaggucagauuaauucuuaugucauauaagauuucauauguuauauaagaauaauucuuacaugacaauuuguagugaguuaaauuuuagauuggaauaguuuuaaaaaugcuuaaaccaccuuauuuuaauaaaaaccuuaacauugucuuucuuuuuucucaugggaaaguuuguuguuucauggucauauuucaacauuguuuugaauacacaaguauauguuauuauuuuaccuagcagaaugaaaaaaguuauauauuugaaaagauucugguuguucuucauaucaaaauuaaaaggagaugauuaagauucagguaaacuguggcaguugccuuuugcuaugcauuguuucuucuaauaguuauuuuguuuuacuaaaaaaacucuacuugauuuuugauuccgggaggaauucuuugcauacaucaauaauuguuuuuauauuggaaaaguaccaccgagaaaaaauguaauuaccuuuaaaacaaauguauugcugcuaaguguucaccuggagugcuuaaauauguaugaauuucggaaagguaugugcauauaugaaucuaauguuuguuucuaagaauauuuggaagcuacuuuagaaauuaguagaccucccacuuaaagcaggaauuuucucugcaauaucagacagcugucauccaccaucacucagaccuuccacucauggguagguuauucacagugguuuguuccuuuguugagcagcuauguuuguugauaaaacucuuacauugaauuagcaaaaaaucuaaugaaaaaauaacuuucugcaguuaguccuaguucuuuuauuugguaaguguuugcaaauaaaaaguaguagauguaaucaggcuggacccugcuguaugcuauuagagauuugguuacccuucucuucuuauacacaggccacucaccaaguauuuauugaguacugguuauguguccagcauuguucuaauugguaaauguuuaaucgucuuugaacacaagaaauaguagcagcagcugccauauuuugaauaauguauguuggggaguguguuaaaaacauuacuuaaauucucauugucuuccuacauacuuaggagaauauguauuaauacaccuguguaacugaugaggaaaauggggcgaugccuaacuagcccaagaucauauagguauuaugagagagagaggugggguucagaagccuuucuuuguuucugauucuaaaacccaugcacuuaccccuuugcagucuucccaaagacagcaucauguauaagauaaaucauaugacuaagacuaaaugaguauucuauguauuguagaguauugauuuggaacccccaggaaccagguuauuaacugagauccgaaauguauauuuuagccauuucuauacaguuguuucuagagcugguuccuguucuuuucuaacuugagaaaauaccaacuauuaacuugagaaaaaguuaaaguauguuaacuuuuucuccuuggcuagggucaucauuaugaauauugauuuuuguguugggguggggugaagacaauuuauuacuacccucuguaauaccucaccgcucuuuugauuccuguaugcuucuacguuucuuucagcugucacuuuacaaugcaguuauuaucccuauauuuaggaguccuuuaauucuuuguuuuuuacuuuuauugugcuguagaauggcaacuguuaaguguggacuuacgcuaauauauguaaaauaggauaaauagguugugaugaagaauuaagagucucuacuaugcauaacaugugaauaaacuuggugaugauacauacuuugaauuuuuauugucauuuuuuggagugcuuacauuugaguacagguuuuccaaauagguaauugccucauagcauaguucagaguaggugaaguaugacuugauauggaguuggcuuauacguauguaauauggauaguaggauuauaugaagauagcuaauaaguuacaaaauauaacuaauauggacaaaauaacaucuaauaagguacugauugcaugauaugaagacagucuaguauugacuaaaagcauggugucguacccagacagaucuagauuugaaucuugauccugccuuugagaaguuaagggcucugcuggacaaguugccuuuucugagcguguuucuucaucuccuuuugagauaacacuuauuugaggauugaaggaaauguuuguaaaauauuuauuacauuuuuagcacauagauguaaagaaauagauauuacauauucuuauuuguauggucagugaaagcaaaagagaugagaauggagagauugaugugagcuggaaaaaaaaucauagaaaguggaggauuguuucaaccuuggauggguagaaugugguuaaaucuagaggaaauaaggcauaaauaaaggcaugacacauuuuacugaaaggaaccauaagaauauagaauuuuaguauuagauuuguaggauaaggguaaguuguugaggaccuucagaacugcagggaaaacaguaaauguuauauaaaaacuuuccuuuauugaaagauagcauagauccaaaaagucuuuguuauaaauguacaauucugagaauuuugacaaauugaacacauggggaaucagaacccagaucaagaaacauaauauugcaauacccuggaagcucccauucuguuuccuuccaggcacuacuuucccagccaaggaaggcacuauccugaccucuaaugccauagauuaguuuagccgccgguuuuugaacuuuauaaaauguacucaugcaguagauguacucuuuuuguaaaguucaaaaacaggccaaacuaauccauggugauaaacaagaguguaugcucuguuguaucugccuucuuaugccugauguuaugucuuaucaccauguuguauauauaaaguuauuuuaaucuaagucugcucauguguaucagguguguuaugauguggauggauucuuuaggauugucaguggguuuauaugaguggauaaaguuugaaguaauuacaguaauuccaccuuaauuuaaaaauuuuaaaucaucuucuccauuucucuucugugucuucagccugaacuuuucauugaacagguuuuggccaguuaauaauaugucuagauaggugaacuuuuuuuugaaugacuguuuaaugaaaaauaaucaaauuauuuauaaagacuucaaaacuacagauuagaaaguugaaaaaauuagaauuguaaucuaguagaaguuuuguguugaccuaauuauguuucugggaugauuaccaaaaucaguuuaguauuucuacagagaaaaagggaagaugauaaacauccucaguucaacagugugcucauguggaaauaucaauauuuguuaauauguuagauuuacaacaugcaguuguaauugugcaucaaaguugaaaaguuguuagaauacaaaauagagauccuucuccuugaaagagcauacauauauaaauaucuuuucugauucucuauuuuaagaguucaaaaugaaccauuagaacugucuuauaccacuccggguuuuacauagacggaagucauaaaguaaugucauggauuuucuaauagauauauuagaacuuuauuagacugauaguaucuaacaucugauugauacuuauaaccuaucucugugugauuguuucucuuucugccuuguuuuuguuucucucauugcuuucuguuucuauuuugcuauuucuagccuuucuucagaugacccuuuaaauagaguaugcuauauagaugaauuacauuuuucuuuuguuguacuugcuaccucuuuauguucccugauuuaaaauaaguuuuaauauuuagauuuuuuuguuguuuucagugauuauuugcccccuaagaaauagugaugugagaguuggaauagaaaaagauuccacugccuuucuuuuggugcuugucuccgagaaauuuaaaccggguauuuuguaggaaauugauuaaauaccugacagcaacuuggcaacauguguuguuuuagcauacacuuuuaaaauaaagaaaauuuuuacuuauuucaguaugcaaaagcacuagaguaaauaugaaagugaaacaaaaauacugaaguguaugaagguaaagaaguuucugaugaaguacauuuucuaaaugcugauaauuaacuaugaguauuaauuuauuuuaaauacuugaaguguauuaaauuuuuauacauacacucuuuggaaguguggaaaacagugaguugggaauuuccugaagaugggaacacuuaauauaaccuugacagauccuugcugacucugagucuagacuauuuaaaaaguucacugagcagauuuaaacugaguguagauuauuagcuaccaaaagaauacuuguuuuuaguggugaauuuuaagugauugcuugauucuauuaagagugauauaaugcaguaaauguauauuuuuaaccaggauuauauuauuuauugcucuuauauauacuggcacaucauuuuccuuuuuccaaccauuuuaaaugacuuuccuuagaauaaagcugaaguagugcaguaaaccagugaccguuccacaugaucugaacuuugucuaaagugauaauuugauuauuaaaauauuacuaaauguaguuuauggagugauggauuaauuucgcagacaucccagaaauuauauacuuacuaaguagaugucguuuucuuuuaagcauucuucuugcaagggacaggaucaauggaaccaacaucaauggaaccauugauguuacuauuguucaaaacauuuuaaaauucuacuugugaagauugcuaaagcuuguaaggccuuuaaauuuauccuauauauuauuaguccuucaaauugcuguuugguuuguccuucaaggaugaauuggaguuugggaaauggucagauauaaucggacucaaauuugggaaguuauuaauucacuaauuuauucacucauguauuugaaaauaauacauugagcaccugcucuuuucucagcacuguauuacauacuggaaggugguauuugcaagguagauaauuacuuuuaaauaaauugccacuauaugcaauacugucauuguaaucuagucccuggcuaccucuacuaccauucucauuuccuaacugucuccugauucacuguguuuagugaaaugauuucuaugcuggucauuccuaaucauauuuucuuugacccaaauuuguacuuuuaucauauucuuucuggauuguuuuuccuccaauauuucuauuacuuaaucccucacuguuuaacucuguucaaaugucaccuuaucaucacugaggccuucucugaucacugugucugaaguagcuccucuuacugucacuugucauuuuuuuuuuuuaaucguuuugccuuuucuuuuuugagacagggucucgcuuugucauccaggcuggagggcaguggcaugaucauggcucgcugcagccucgaccuccuggacucaagugauccugucacuucagcacccccacguaguugggaguacaggcacacgccaccaagccuggcuaauuuuuugguauuuuuuguagagacaggguucugccacguugcccaggcuugucuugaaucgugggcucaagcgauccaucugucuuggccccccaaaagugcugggauuguagguaugagccacugugccuggcauuauugcuuuuucuuucauagcccuugucacuacugauauuacgguauauauuucuugucucccuggaauguaaguuuugugaggagacaaguacuuuguuuuguucaccauugcauccuuggugcuuagaacagcccugggacauaguaagugcuggguaaauauuuguugacugaaugauugacucucaaauuuguguuuaagcuugagggcuccugaccaauuuugcugcuuacucagcaucguaaccaugucgucaaguacaucaaaccuaauauguuucaaacuggcuaauuaucucauuauucuaaaaaucuuucuggguuaagagaaguacuuuaauugggccaaauaagacacccaggagacaucuuaaccucguuccuuguccuuauuccacauauccaaucugagaccagaugguaaugauuuuaucucugaaauacuugcaaaucuguuuuuuccauuucuguugccaugccuuuauucaggcccuuauuaucuuuccugaugauucuauugacuucguaacuacucucccuguucuaguucuguucuuuuccaaucuguuuucuucucuguaaccaacaaaaaguuucccaaaaagucaaucuucccucgcaguguugaacaucuucuuuauuugggcuuuuauaauauauugcauuuuaccuuucuuacaauuggcauaauuuuauucacaugucugccucucugucacacuagacaaauauuuguugaccuuuacuguguacuggguacugaucuuuugcugcugauucaguggugaaaaaaauauauugagucccuaccuuugauggaccuauagucuaggggggagaacacaguaaacacaugagugcagaauuuuagguacugauaaaugcucuuaauaguguaaaaucagguaugugaaaaagaguggggggggggaauugucagagaaagcuucucuuaaguaguaguguuuaauugauaccgaggaggcaccauguaagggaggaaagucuucaaguagaaggaaaaacuagccaaaaaaaugugacuaucaacgagacaggaaagaaccaguauggcuagugcuugaugaaugagagagagaguaugggaauaugagauuaggagagacagggagacaaguaauaacuuggagagggugguacaacugcaaagggaagucauuagaggguuucaggcaggagugugauauggugagauaauuuagaaaaaucacucugccccuuggacaauagacuguagcccuuggagcaggcacuucauagcacaugccauuaaauuaauguuaacugaauuaauaagugaaugaaugaauucuuucauucauguuacaagacgggcaagauuauuccauuugaaucacuugaaacugaaguaguguauuguuuuucaagacgagauagcaaaaccaaacauuguagaaaugauaguuguauuaauagauuuccuuguaagugauguguguauaacccuaauuacuuuaauauuuuugaguuaucaaguaaugccugauuacuaauuuuaacaacagcucuuuucacuguggguggaaaugcuguauuuaaugaguauauaacauagaguauucugccaguuuuucugaagguugagguuacaagauaaaucagaccuugcucuucaagaaccuccaguuaguugcauguuacucaaaaaauguagacugaauggaugguuaagguagacugacaaaucaagaggcccagaagggacuucuuagccuuauauaaucuuugucaaaaauuauucuauucguuugaucaacuuuaugcugcugcugcagcuagaugcuuucauuuagauguugaaucuauccuugggaauaugaagaaguacugaaaauagcagaaugagugaaguuaguguuaacuuuauucucuuuaauauuaaauaaauuuuuauucuggauaugagcgcuccccuuccucucauuuaugucaaucuuuccccuuauucaacuuuaacugccacugucgucccaccuauccagcacuaagacaugugggcugugagugcuuuggaaacaaucuuuuuuucuuggugcugaaucaggauggcuuauaggcagauuugggggaaauucuugucuuucauuucacagcuuuuauucauauguucuuuguauuuuuuuuuuaagugaaugugaucccggcaaucuguucuuuagcaucuagauuuucagcccguuguuaaaauuaaaaccuuuuuuuaaccuauucuuucuuucuuuuuugagacggagucucacaccguagcccaggcuggagcgcaguggcucgaucuccacucacugcaaccuccgccucccggguucaagugauucuucugccucagccuuccgaguagcugggauuacaggcgcccaccaccaagcccggcuaacuuuuuguauuuuuaguagagacggguuuuuuuuuuuuuuuugagacggagucucgcugucgcccaggcuggagugcaguggcgcaaucucggcucacugcaggcuccgcccccugggguucacgccauucuccugccucagccucccgaguagcugggacuacaggcgcccgccaccucgcccggcuaauuuuuuguauuuuuaguagagacgggguuucaccguguuagccaggauggucucgaucuccugaccucgugauccacccaucucggccucccaaagugcugggauuacaggcgugagccaccgcgcccgacccuuauucuugcuuucuaauucugcggauuuaauaaacauuuauuuaauaaauauuuauuuuugugcuaggcacugugcuagauccuaaauauuuuuuaaagaggcuauagcaugagcacgugugccuuugguaaaguaaaaucaugguuugggguuggcagauacaugagccguugugguagaaauugcucagcaaucacuagacucuuuuccucugagugacacugaggguucauaauccucagaguaguauuccuggaagcacuagggccgacacuagaguugaaaccugauuugccaugacaaguauaauugaauaaugucuguguuuugguuuguugacugagggauauuuugcaccuuuagcaaauagaggaggauuuagcuacuuauuaaauuguauuauuuuuuacuguuagcauuuuccagagaaaguuuuauugguuaggugcaucaggggcauugaaauagccuaaaauaaauuggagaaaaacuaugaaaaaauuuagcuagugauuugucuuauuuaaaauguuaguucaugaaaguguuuggauguaaucuaaucaauuggauacucuuacaaauuucauugcuaaaaguagcauggaugugauucuuaacugauacuguuauuuauuugauauuuaucccuuggucugagcagggcauucuuaguaagccaaacuuugcacuagagaauggcuguuuggguucagcaauaguguaggugaagaucauugguguggaaucguaaaauagaagccaaguaagcagaguuuagagcuagaagaaacugauaagagaucacuuaauuucagaagacuuuuaacaaaagaaggaggcucucuagguacgagaaagguagauuccauugucaauguacuuugaggagacugacaguauuaagaggacuacuugaguuaaacuagucaguaaucuuccccaggauccccacugguuuuauuuuauguuuacauacauaaaauauaaacugcaaauuaugggaaaccuuauuuuagaucuuauugguaauuuguacaggucuggaucaacuacaguuuaccuuugugauacuguaaaaaguucuuuuuuuaugcagauaacccuaggauuaugaugggauuacauccuuucaaacucccuaaacucauuguaagugaaaaauaaguauuuguagacacgauagguugcaaaaacaauguccaaaaaaugcuaaugacuggguacacuguagaguguugguucauucuguugcccaggcuggauugcaguggcaggaucauaguucacuguaaccucaaacuccugggcucaagggauccuccugucucagccuucuaaguagcuaggacuauacacgcauaccaccacgccuggcuaauuuaaaaauuuuuuuuuguagagauggaugucuugcuguuagccaggcugaucuugaauucuuguucucaagcaguccacccacaucagcaucccaaagugcugggauuacaggugugagccaccacgccuggccuauuuacccuugcaaucauguggcugacugagauuuugacucacuacuucugcccagcauuaugaaggaguauccuaccacauacugcugcucaggaaaagaucaaaauucagaauucaaaguaugguuucuauugaaugcauguugcucuugcaauaucuuaaaguaagaaaauuuuaaguugaaccaucauaaguaggugacuauguauuaauuuuaagcuauuuuagaaaauuagcauaucacuccuuuuuugaaaauauacauuccuaauuauuacugugaaaugaaaagugaguuuguagaagggaaaaucaaaaaucacauucuuuuuuuuuugagacagagucuggcuccguugcccaggcuggagugcaauggcgugaucuuggcucacugcagccuccgccuccuggguucaagcgauucuccugccucagccuccaaguagcugggauuacaggcgcccaccacuaugcccagcuaauuuuuuuauuuuuauuuuuaguaaagaugggguuucgccauguuggccagccuggucuccaacuccugaccucagguguuccacgugccucgccucccaaagugcugggauuauaggcgugagccaccgugcccagccgaaauucacguucuugcuccauaauuugcaagcaaauaccagaugugcuguuaaguuuucugagucuaacuuuuuuuauuugugaaaagggauaaaauuuuguauaucuuacagugucauuaugaguauugagaaaauuauuuguuuauagaccccagcguagugucuggcaaaugcuuagaugaaaacucuaagaacaaguguuaauaaacaaauaacaguuauuuauccauucuuuugaucauggacauuuguguuauuuguaguuucuugguauuauauacagugauuuuauguauagucuuguauaugaauccugcugcuuauauguaaguuucucugcauuauauaauuuagcguggaauuacugguuauaugccgcguguguguguguguaggugcguguguguguguguguguguguauauauauguauggggagagagaaagauuauccaucuauaugucuuuauucucacagugauaauauauaggaauugcuauugauucauacuuuugucaacacuugggauuaucagacuuauuaaaaauauuucauuaugaaaaauuucaaacauacacauaauucgagaaaaaaguauaaugagcccucauguauucuuuaccuucaaccauuauaaacauaugggacaaucuuauuucauuuguauauucucccacuucccucaugggucauuuugaagcaaauccaagguauauguuauuucauugcagaucaucaguauguauuucuaagggauacggaauuuuaaaauauacaaccacagugacauuaacacaacugaguaaauuaacaguaaguucuuuguaggucaggcgugguggcucacuccuguaauccagcauuuugggaggccgagguggguggauugccugagcucaggaguuugagaccagccugggaaacguggugaaaccuugucccuacaaaaauacaaaaaauuagccggguguggcagugugcaccuguagucccagcaacuugggagguugaagcaggagaauugcuugaacccaggagguggagguuacagugagccgagauugugccacugcacuccagccugggagacagagagagaccccgucucaaaaaagaagaaaaaaaacaaagaaaaacaaagcaguaaguucuuuguauuaucuaauauucagucagugcucaaauuuuccugauuguuuuacagauacuuagaguacuuugaguaaugauucauaggucagcauacuuuauauauauauauauuuauuuauuuauuuguuuauauuuauauauguaaaaaagcaaguuguucaucuagaucaccuuccuuuuggguaaucuguuuuucugucuauauuaacaauuucuuucaaacaucuugaauaaaauguguuuaggugguuauuuauucugccuuuggauucauugggcauccugauucuaaguauuucaagucuuugaguaauuccagaaaagugucaguccuuggguuuuugaguauugcauuucccccauuuugucuuguuaccuccuuuaugaacucucauguauguuagaguuucucauuaucuuucuugguuguuaaacuuuuuuauguguuucaucuccuuuuuccugagaagccaaguucuguauaguaucuucagcuaggucuuucuucguucauuaauucuucugcuagcaguguuuaugcuguucaucccuuccauugaguuauuucaguuaugauauuuuuauuucaagaaguucuaccuggacugcgcucccucccucccucccuucuuuccuauucugucauggaucuuuuugauaacuuuuuuuuuuuuuugaauguucucuuuaguguucuuuuuacuucuuuuuuucccuuaagccagagguuugcaaauuauggcuugcaaaucuggcuugcuacugcauauguaaauaacauuuuauuggcacauggcuaugcuuauuuguuuuaaguuuuaucuguggcugcuuuggugccauaguuguggaguuaacuaguugaaacagagacuguauuacagaccuuuaaagccuaaaguguuuacugugugacucuaugaacaaguuuaccagcuccccuguuuuagauauauaaaacauaauuauuauuucauugaauaauucugauuuuuagucuuuuuauaucuuuuuuuuucuuguuucuguuuauaauggcuuauuuugcuguuuacuuguguguucaugguuuuugguugugcccuauauuuguuagguuacccaggcuaagggugguuaucugguugguuggaugaguuaguggggagugauugaugguugaguuugcuucugccugcugcuugggagcauuguagaccaagggcuacuuuaaauucagauucucaccuugguguuuuuuucccuuaaccaugcaagaguacauuuauguuccaaagucacaugugguggcuucagagucucagcagagucucucuuguuuguuuuguuuacaguguuacccagagcugcuuuucuuugcuguuuaccucuguuggauguuuuuuaauucaccuuuuuucuuaggauguagacuuuucuaaggucuaacuuuaugcguaacaaauuccuugucuugcauugacucaaggguuagccuacaguccucauggccugcucuuaagcuuuaggaauaggauuucauguggguucucuaaagcagagcuucugaaauuuaaugcuuuguugcaggucccagauaccauccuuagauucagugauucacuagaacucauuauggcaaaaagauaugacacaaaauuagcaaagggaaaagauacauggggcaaagucugggggaaaccagcacaagcaucuagaaucuucccagcagagucacacaggacaugcuaguucccuccaguuaugaauugugacaacccaugaaaugcugucaaccagggaaucucauuagagacucagugcccaggguuuuuauuugaggaauugccaaguagguagccucuaccuggcagauaacaaaauuccauacuuacagaacaaaagcaaguauuucauguaaaacauauuguuaguauaaacaguuuagguccagugagccaccuuaccaguuuacagaaucucccaaaauuuaaguuccuguaugccagcugagggucaaccuugcaagcaggccuuuuuaaagauaagcaguuaggccugcuagguuaacuuuuuuucugcacaaauauacaguuggaccaccuggggauuuugucauaaugaagagucugguucaguaggccuggaagggcucaagauuuugcacuuaugacaugcucacaggugguacccauguugauuguccacagcuacacuuugguagccagguaguuguucuuagggccagaagcccuucuuuucauuaauguuuuuauccuaaaugaccagucuuuuauucugaauuagugggaaaauucuucguugugguuaaauucuuuguguugacaaacuauuucuggggcaauaugguuuacuuuuuguuacuuuuuccaacuuaagaucuaaauuuauacuucacuacauauuuugugucuuggaagaguggaaaaaguaacaguuucaauaacuuaguuguagaaaagagugcaacauuuucacuuugguaguauuaauuguacagguccauagucucuucuccacaacuuugaaaaccuaaaaucucugagaaugaaagcuuuuuccauaaauaagcugaccuguuaaaacugacgugaccuaaacucauuucauacagcaaagccugacuggaauuugauuucuuaauuugucucagugugucuagucauauguuuuuccuaaaagaaauaauaguuuuugaauagguaauguuguacaaaacacuaauuuuguauaaaaacaggauaccauuauaauguagucuacguaagagguuaguaaaauacaugaacuaaagcagggguccccaaaccccuggcugugcaccgguaccaguccguggccuguuaggaacggggccacacagcaggaggugagcagcgggcaagcauacauuaccaccugcucugccuucugucagaucaguggcugcauuagauucucauaggaacaugaacccuauugugaacugcacaugcgagggaucuaggucgugcccuccuuaugagaaucuaaugccugaugaucugagguggaacaauuucaucugaaaccaucccccccacuugacccuguccauugaaaaacugucuuccacagaaccagucccugggccaaaaagguuggggacuacuguucuaaagugucucagugauacuugaugacuacuuggaugugaguagauuccagggaguccagaauuucuaauaguaauauuauuugaagauggaaauuuuuuuaaguuuuuuuuuaagaugaauuaauuugauuacaggacaugcuaaauuugagguggacacaccacaaaacauacagacugagguguguugcuuuuaaucauagauaaauuuuagaaucgaacuuuugaggcauugacuuaaaggguaaaauugaauuuguuagaguugauagagacagggaaaagagaaaccugaggaaaaggauauaguacuucagguaauuuuuguugucuuuguuguuguuuacauuuaaaacauuuuuuuucccuggcaaccuucauuuaacucaaagcuuuagguaauguuaaaggauauggaacaggaggagggaauacaaaucuuuaaaccaagucauaaggaacagugaaggauaguuaugaaaaggauugagacaguguaguugcagaaaccacgggaaauaugguggauuugguuagcaugggucaguagugugauggaaaagucaaaaaguuuugaaaagcugagagaaaaacuuugaauuaggcaaaugguaagcuugaggaggacagcuuaauuugaaugauggccuuaaacaccagguugaugaaguuuaggagaugaugagguaagaauaaauucaguugcaucucagauuuggcaaaaaaaaaaaaaaaguaauauuucaaagauagaaaacaaugggcaaagcauuuauucuucuucuuuuuuuuuuuuuuaauuuuguuuuuagagacagggucuuguucuguuacccagacuggagugcaguggcaccaucauaguucacuguagcuucaaucaccugggcucaagugaucuucccaucucagccuccugaguagcugggacgacaggcguaugccacuaugcccagcuguuuuuguuuuuuuuuuccccuaauuuuuguagagacaggagucuuacagugcucuuauugcugguguugaacuccuggccucaagaaauccucccaacuuggccucccagaguuuugggauuacgugcaugagccucugcaccuggccagcauuuauuuauuuauuuauuuauuuauuuauuuauuuuuaaagacagagcuagugaaagagacugacgauccaugaagaauagugaauaacuaaugauaaaaauacuggaauaagauaagauguggaaucaauacaaauggaaagauuagaaaauaauacgguaacaacauauuuuucagguugcuaauccauacucaaaucuaguguccuacagccaagguauauuuauaccuuugcucucccuuauuaguuucuaagaagguaagcccuuuuaacuacuaccuucauagaagccaccugucugacaaaugaucugaacuauagacauguuucauagagaaaagcagaagcaugaaaguagcuguacaugaaaauauacaacugacuucuaaauaauucuaauagacuggauaucuauauauaaaaauuaaugucucagccuuuaggcacagcuguuccauucuuucacaggguucauuuacauagugaauuguuucaaagacaaacugauuuuuuucucuuauaauaaaggauuccuaauuagagaacuguggaagccuaaugauuuuacaaguaucuuuguaaaauauaacagacuaagacauagaaauuguagcagaacaugcaguaauuguaauguuuaauaauugcuuuuaguuauuuuuacugucuuagaaaggguuguucaaguugcagacuguauuuuucagucuauaaugaaauuauuucauaucuuguugcucagaguuuuccugcuuuucugcaggaaaauaacauuaaaauguuaugaaaaacauuucuuugaaugauagucauuucuguagucuggugaagaccuuuugaauucuuuguauauacucauauauacuuuguguuuguguacaaaguaaaagugcuuugugaauuugguucaguugucuaccacaaauuaucuuuuaacagguguuaugagcccaaguacucaauucuaauuuuacuguggaaaagggaaagagaugaagucuaagaaagcacuugaugccuuuuuuccauugagcaggucuuauccauuuucuccuucaaacaucugugccagaaaaucuuuauaaauucacuaauuaucuaccauguaaaaauagacaaggaugaaaugauuaaaagauuagguaaggggaaugguuaggcuuuaguucuuuaucuagcaagugcaaccuggcaacaugauuuuuagcacugcgugaauauagugcuugagaggguggaauagaaaaggaucagaaugugguuuucugaagguagacagcaggcuuaaauuuuuguuugccuuuuucuuuuuguuuuccuaugcauugccauguuaaaaguuuuguauuugacaaauuugggugaaugcuauugcauuguuaauuauauuuaauuagguuuguucuuaccuuagaaagugagauuccuuuucaaagcaauagaaauaaguuugguuaggguuuuuggaaaauuauauuauuucauaucuuguugcucagaguuugggaaguagauacauuuugaagcagcauaguuuuuuuuuauucccucuuuuguguauguccauauuauaacuaucauuauuauaacuacucauaagauaguaagucccuuguccauucuuauauuuuagaauucacagguaugaccuagagacuucuucuguuauaaaugccagauuguuaaaagucaauuuaagaagcauagucuuguuuacuauaaaaggacaauaaacauagucuuuaauaucuggcaaaauaacaaaauuuuuuuucguucuugcuuuuuaacuauuuauugaauagagagacaugaauuuauuauacauguuuugcucaaugaaucuuugacagauugacaccugugaaaccagcacccagaucaaaacagagcuugguauauuuuaaacauuuuuaaauauuuugguuuuaauugacacauaauaauuacauauuuauaggguacagugucauuuugauauguguauacauuguguaaaagucaaaucaggguauuuaguaaauccauuaauggauuaaucaguuuucugucgcuuauaaaagaauaccugaaauuggguaauuuauaagaaaaggaauucaguucuuaccguuaugaaggcuaagaaguccaagauugaggggcugucugacgacaccuucuugcugucauugaagagucccaggguggcacagguuaucacauggcaagggggcugagcgugcuaaugugcuagcucaggucgcuucucuucuuauaaagccaccaguuccucuccugugauaacucauucaugaggacagagccuucaugauccagucaccucuucaagaccccaccucucaauacagccacacuggggaugaaauuucaacaagagcuuuggaggggacauucagaccauagcaaucaccucauauguuuaucauuucuuuguggugagaauguucaaaauccuuucuccuaguuauuuugaaauauacaauacaguacuguuaaucauagucacccuacugcacaagagaacaccagaacuuauuccuccuaacuguaacuuuguacccauugaccagucuuucucuauuucuccucuacccuccacucuucuacucuguacuucugagaucagcuucuuuagauuccacauaugagagguugugugguguuugucuuucugugccugguuuauuucacuuaagaucauguccuccugguucauccauguuguugcaaaugauaagauuuuauuuuuuuaauggcugaguaauauuccauugugcauauauaccacacuuaaaaaauucauuuaucuauugaaggacaauuagguugcuucuauaucuuggcuauuaugaauaguggugcaaaaaauaugguaucucuuugguuuacucauucucuuugauaugcugauuucguuuccuuuggcuauauuuauauaccuaguaguggaauugcuggaucauccauuuggcaauucuauuuuuaguuuuuugaggcaccucuauacuauuuucuauaauggcuguacuuacuaauauacauucucaccaacaguauaugaauuccccuuuuuccacauuuguuacuuuuugucuuuuucuuuagagacagggucuugcucugucacccaggcuagaguacagugguguguucauggcucccugcauuuuuuugucuuuuugauaauagccuaauuuaggugagaugaaaccagaacccagaucaagaaacagaauuugguauauuuuaaaguuucuguguauuuauuacugaauaguaaguucauuuauucaacaaauacuuuuugagugugguuacuguuugccaaccauuguuuuagguauuuggaugacaucacauuggugaaauaaagcagaauugugguauagggagauaaacaucaaauaauuauacaauuaaguguguaauuauaaaccgguaugaacacugaagguacauuguccuaugcaaggcaguacaacuagguagucuguauuguauuauauauugaggaauaaaagguagacuuuggagucauacagcuuaaguucagaucucauugccauaucugguauuagugugacuuuuaggcaagugaacuaugucucuaagccucauuuauuaacaugaggacaauaauaguaguaccuaccuuauacgguugguguggagauuaaaagagauuauucaugcaaaaauauuagcacaaauaguauagguucucuguguguauaguauuaguaauuauuauuuuugugucaguguuguuguuuuauauuguaacauuugaagaugauaagaauauuucauagaguagguucuagucuuagauuucagauuaaauaacccaaagagauaucagaaucuaguuguaugacauucuggcagccuuuauagcauguuucauauuucagugugcauaagaaucacugggguacuuccuauaaaugcagauuacugugggcaacuuucuaggcacacuugacccuggaauugguauuucuaugguaaucuacuuauuuuuuaagaacacaggcuugaaaacugauagccuguaaaugugguuucaaaucauuuuuaauuaaacauauuaaauuuuuuuuuuuuuuuuuuuuuuugaaacagggucuugcucugucacccaaacuggaguccaguggcaugaucauagcucacugcauccuugaacucccaggcuguagggauccgccuacuaucagccucuggaguagccaugccugacuaauauaaguguuuuugauguaggaacaaauagccaauuaacuuauaacauuguaagguuaguuguuauuuacuuuuggugcauaagcuuacuacagcugguagaaaauuucccccaaaucuguacuugcucuaggauucccuguuagugaauagaaucauacaucaauuuacccaauccggaaaucuagacuucauccuugauucugcccucuaucuuuuuuccaucucuaagccguuauuaaguuuucugcucagaaaauuuuuuuaacuucuacuuaaacuugccuuucuccucuucugcaguucacucuccagaguuguauuccuaaagcacaaaaaacugaucaugccauucacuugcacaaaugccuuccuuaauaauuauccauugcccaaagauauaagauauguuaacuuuuaucuuucuaaguuaaguuaacuuaucuuagaaagcuguuggaaucuagcuccauuuucauuuauucucaucauccuguuuucugaagauauagaauuucuugcuauuccuugaguucauugagaaaaguaccuuguuuuuucacauuuccauguuaauguacauauugcucuucacauuuuauaugccuacaagauguauugcuuauugucaagaauaaacucguguuaagcaucuccaaauaacauuugugucacuuacugucuugcucaguauuucuuuuaaccacuguuuauugacaacccaccaugugccuggcauugugccagaggccaggaugcaucuguaaacagacagacagguuuccuauucucaacuugucuuauacucuagugaaaucucuaucaaucacucuccuuuuauuuuauuugcaugauauuuacuaccuaccugucuauuauauuacuguuagacauuuaugucccucuuuuuucccauuuaauuuugaucuccaggaaugagaucauauauuuauuaauguuccucuccuagcaguuaucgcaguauauggcagaugaggagcauugaaauuuauaacugaauaaaacauagaaauugaaauacugcguagauauacagagcuauuccuaggucagaucauaacugucuuuuauaguauagauuuauuuuuaaaaauuauauaaguaauaaaauuauggaauacaaucuaggggacaaccuguuuuccagucuauugauaguguuaacaacuuuuuugaaaaagaaccuuggaaggaccauuguuuaaaauuuaauuuuaaaauauuuuaaguuguuuauauuauaaaacauauucuaaguaaaugaauuaaaauaguaauuauagcuucuaauuauuaaaauuauacaacuuuuuuaauuuuaugauuguuauacuuuaaguuuuaggguacaugugcacagcgugcagguuuguuacauauguacacaugugccaucuuggugugcugcaccauuaacucgucauuuaacauuagguauaucuccuaaugcuaucccuccccccuccccccaccccucaacaggccccggugugugauguuccccuuccuguguccauguguucucauuguucaguucccaccuaugagugagaacaugugguguuugguuuuuuguccuugcaauaguuugcugagaaugaugguuuccagcuucauccauguccccacaaaggacaugaacucaucauuuuuuauggcugcauaguauuccaugguauauaugugccacauuuucuuaauccagucuauuauuguuggacauuuggcuugguuccaagucuuugcuguugcgaauagugcugcaguaaacauacgugugcaugugucuuuauagcaccaugauuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccaguuguuuccugacuuuuuaaugauugccauucuaacugguaugagaugguaucucauugugguuuugauuugcauuucucugauggccagugaugaugagcacuuuuucauguguuuuuuggcugcauaaaugucuucuuuugagaagugucuguucauauccuuugcccacuuuuugaugggguuguuuguuuuuuccuuguaaauuuguuugacuucauuguagauucuggauauuagcccuuugucagaugaguagguugcaaaaauuuucuccuauucuguagguuaccuguucacucugaugguaguuucuuuugcugugcagaagcucuuuaguuuaauuagaucccauuugucaauuuuggcuuuuguugccauugcuuuugguguuuuagacaugaagucuuugcccaugccuauguccugaaugguauugccuagguuuucuucuaggguuuuuaugguuuuaggucuaacauuuaagucuuuaauccauguugaauuaauuuuuguauaagguguaaggaagggauccaguuucagcuuucuacauauggcuagccaguuuucccagcaccauuuauuaaauagggaauccuuuccccauuucuuguuuuugucagguuugucaaagaucagauaauuguagauauguggcauuauuucugcgggcucuguucuguuccauuggucuauaucucuguuugguaccaguaccaugcuguuuugguuacuguagccuuguaguauaguuugcagucagguagcaugaugucuccagcuuuguucuuuuggcuuaggguugaccuggcaaugcgggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuacccgugagcauggaauguucuuccauuuguuuguauccucuuuuauuucauugagcagugguuuguaguucuccuugaagagguccuucacaucccuuguaaguuggauuucuagguauuuuauucucuuugaagcaauugugaaugggaguucacucaugauuuggcugucugucuguuauugguguauaagaaugcuugugauuuuugcacauugauuuuguauccugagacuuugcugaaguuacuuaucagcuuaaggagauuuugggcugagacaaugggguuuucuaaauauacaaucauaucaucugcaaacagggacaguuugacuuccucuuuuccuaauugaauacccuuuauuucuuucuccugccugauugcccuggccagaacuuccaacacuauguugaauaggaguggugagagagggcaucccugucuugugccauuuuugaaagggaaugcuuccaguuuuuguccauucaguaugauauuggcuguggguuugucauaaauagcucuuauuauuuugagauacgucccaucaacaccuaacuuauugagaguuuuuagcaugaaggacuguugaauuuugucaaagaccuuuucugcaucuauugagauaaucaugugguuuuugucuuugguucuguuuauaugcuggauuacguuuauugauuugcauauguugaaccagccuugcaucccagggaugaagcccacuugaucaugguggauaagcuuuuugaugugcugcuggauuuguuuugccaguauuuuauugagaauuuuugcaucaauguucaucagggauauuggucuaaaauucuccuuuuugguugugucucugccaggcuuugguaucaggaugaugcuggccucauaaaaugaguuagggaggauucccucuuuuucuauugauuggaauaguuucagaaggaaugauacuagcuccuccuuguacuucugguagaacuuggcugugaauccaucugguccuggacuuuuuuugguugguaagcuacuaauuacugccucaauuucagaagccuguuauugguguauucagggauucaacuucuuccugguuuagucuugggaggguguaugugucgagaaauuuauccauuucuucuagauuuucuaguuuauuugcauagagguguuuauaguauucucugaucguaguuuguaugucugugggauugguggugauacccccuuugucauuuuuuauugcgucuauuugauucuucucucuuuucuucuuuauuagucuugcuagcguucuaucaauuuuguugaucuuuucaaaaaaccagcuccuggauucauugauuuuuugaaggguuuuuugugucucuauuuccuucaguucugcucugaucuuaguuauuucuugccuucugcuagcuuuugaauguguuugcucuugcuucucuaguucuuuuaauugugauguuagggugucaauuuuggaucuuuccugcuuucucuugugggcauuuagugcuauaaauuucccucuacacacugcuuugaaugugucccagagauucugguauguugugucuuuguucucguugguuucaaagaacgucuuuauuucugccuucauuucguuauguacccaguagucauucaggagcagguuguuuaguuuccauguaguugagugguuuugagugaguuucuuaauccugaguucuaguuugauugcacuguggucugagagacaguuuguuauaauuucuguccuuuuacauuuccugaggagugcuuuacuuccaacuauauggucaguuuuggaguaggugugguguggugcugaaaagaauguauauucuguugauuugggguggagaguucuguagaugucuauuaggacugcuuggugcagagcugaguucaauuccuggguauccuuguuaacuuucugucucguugaucugucuaauguugacaguggggugcuaaagucucccauuauuauugugugggagucuaagucucuuuguaggucuccaaggacuugcuuuaugaaucugggugcuccuguauugggugcauauauauuuaggauacuuagcucuucuuguugaauuuaugccuuuaccauuauguaauggccuucuuugucucuuuugaucuuugcugguuuaaagucuguuuuaucagagacuaggauugcaaccccugccuuuuuuuguuuuccauuugcuugguagaucuuccuccaucccuuuauuuugagccuaugugugucucugcacgugagauggguuuccugaauacagcacacugaugggucuugauacuuuauccaauuugccagucugugucuuuuaauuggagcauuuagccuauuuacauuuaagguuaauauuguuaugugugaauuugauacugucauuaugauguuagcugguuauuuugcucauuaguugaugcaguuucuuccuagcccugauggucuuuacaauuuggcauguuuuugcaguggcugguacccguuguuccuuuucauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaauauucuuuucuuuuagaauguugaauauucggccccacucucuucuggcuuguugaguuucugcggagagauccgcuguuagucugaugggcuucccuuuguggguaacccgaccuuucucucuggcuucccuuaauauuuuuuccuucauuucaacuuuggugaaucugacaguuacgugucuuggaguugcucuucucgaggaguaucuuuguggcguucuguguguuuccugaaucugaauguuggccugccuugcuagauuggggaaguucuccuggauaauauccugcagaguguuuuccaacuugguuccauucuccccgucacuuucagguacaacaaucagacguagauuuggucuuuuuacauagucccauauuucuuggaggcuuuguuuguuucuuuuuauuuuuucucuaaacuucucuucucgcuucauuucauucauuucaucuucuaucgcugauacccuuucuuccaguugaucgaaucggcuacugaggcuugugccuucgucacguucucgugccgugguuuucagcuccaucggguccuuuaaggacuucucugcuuugguuauucuaguuagccauucgucuaauuuuuuuucaagguuuuuaacuucuuugccauugguucgaacuuccucuuuuagcucggaguaguuugaucuucugaagccuucuucucucaacucgucaaagucauucuccguccagcuuuguuccauugcuggugaggagcuguguuacuuuggagggugagaggugcucugauauuuagaauuuucagcuuuucugcucuguuuuuuccccaucuuugugguuuuaucuaccuuaggucuuugaugauggugacguacagauggguuuuugguguggauguccuuucuguuuguuaguuuuccuucuaacagucaggacccucagcugcaggucuguuggaguucgcccgagguccacuccagacccuguuugccuggguaucagcagugguggcugcagaacaguggauauuggugaaccacaaaugcugcugccugauuguuccucuggaaguuuugucucagagggguaccuggccgugugaggugucagugugccccugcuggagggugccucccaguuaggcugcucaggggucaggggucagggacccacuugaggaggcagucugcccguucucagaucuccagcugcgugcugggagaaccacugcucucuucaaagcugucagauagggacauuuaagucugcagagguuacugcugccuuuuguuugucugugcccugcccccagagguggagccuacagaggcaggcaggccuccuugagcugcggugggcuccacccaguucgagcuucugggcugcuuuguuuaccuccucaagccucagcaauggcgggcgccccucccccagccucgcugcugccuugcaguuugaucucagacugcugugcuagcaaugagugaggcucugugggcguaggacccgcugagccaggugugggauauaaucuccuggugugccguuuguuaagcccauuggaacagcgcaguauuagggugugagugacccgauuuuccaggugccaucugucaccccuuucuuugacuaggaaagggaauucccugaccccuugcacuucccgggugaggagaugccucgcccugcuuuggcucaugcacggugcgcugcacccacuguccugcauccgcuguccggcacuccccagugagaugaacccguuaccucaguuggaaaugcagaaaucacccaucuucugcauugcucaugcugggagcuguagacuggagccauuccuauucggccaucuuggcuccacccccaaaauuauacaacuuuuaauagaugcucuguucaaauggauuauuaacuacaucuagcucacuuucuguuaguguucuauaccuagauugauccucaucuauauuugacaguuacaguauauaauaauaugcugacaauaaaccaauuaaagacauggcuuuuaauagaauuuuaagacaaucgcagaaguggccugguagaugucacuuguuuaacuuauccaaagguacagaaugauaaacugucagcaaggacuuuuuuuucuuccguuaauuauaaccuuuucuccuugaaaucauucaaagugagcaauuguuuggaauuaaagaaaggcagauguuuuuguguacacagaaagaggaaaguauaaaaugaaguaaguuuauaauucagaauugaagggggaggaaaauagaucugaaucccagaguccuugagagaaaaauuuauuuauuuauuguuaaaaacauauaguuauuuguuuguuuuucaaccuuuaguuucggugguacaugugcagguuuguuauaugguuaaguugcauguugcugagguucaguguacaaaugaucccauuaccgagguagugugcaugguacccaauagguugcuuuucagugcucaguccucuuuccuccuccccugacuacuaguccccggugucucuuuuucccaucuuuagggaagacaauuuuaauauguuacaaaucagcagaaauugccauaacucuuucugccaucauuauuauaaaaguaggacacuggugggccaggugcaguguuuuaugccuguaaucccagcacuuugggaggccaagacggguggaucaggaggucaggaguucgagacuagccugaccaacauggugaaacccugucuuuacuaaaaauacaaaaauuagccaggcgugguggcacacaccuguaaucccagcuacucaggaggccgaagcaggagaauugcuugaacccaggaggcagagguugcagugagcugagaucccaccauugcacuccagcgcuccagccugggcaacagagcaagagucuguucccaaaaaaaaaaaagaguaggacacugguacaagaagccaacaacacaauucuagucucugggggaaggagauaauggagcagauguaguccuaagaaaaacagacacugcaguugaaguuuacacuuaaggcgaucauauuauuuauaguuguuauuuauaauacaaccugggauacuuugggaagugaaaauagaugguauuaauaauuacagugguacaccaacuguaaauuggaacccugacaaaucagauauauguguuauaugugcuguaauguuaguaugaagaauguaucaugaguauagagaagggggcuuguagguuaggaaaaaccuuuacuaaucuagucugagcuagacuucuaaagaaugacaaaguuguuccccaaguuggguugagaaauaaacggcaugccagguuaaagggaccuagugccaucuugcuguccauguugcucugucucuguccguaucauugccucucaagaagugcuucaugguuugucguuuuucugaaacagcuaugaaacauucaguugguuaauugcacuucaguuuuccuaccuaggcacugguucucccagcaguuucugcucaugaaccucuuuucuaaugugugacucccuguauucuugugucugucuuuaugaucuuggggguaguggcuugcccuguguccucaguucucuuacaaauucaagaagaguuguugauuuuucaguuuguucagguuuuuacuuguuguuagcaugaugugaugacuuccaggcuccuguuguguggaaccagaaaugaaguccauguucaguuuuuaguaugauaaacuuaacauuuuaggaacauuauaauccaguuaaacugauugacuugccauuguaauugauugacagguuuuucuuuacuauuuuugccauuguauuuauauuuaaaauauaccaaugaucaaaagauuauuaugugcuucaguugcuugagaggaaacaugguuauuucaaguauguaaacggaagauaauacuuguucucugcauuccagaugguuacaccagaacaaauagacaaaaauuacaaaggggcagauuuuggcaucaguaaagaaaaaauguucuauuuuucuauccaaagauggaauagguucucuuggcaaauuuugacuuccucugcauaguuauuuuaucauaaacuagaggcccucagaagaugcuauccuugggauacagccuuucucuacuaaauuauauaacuuuuugaaauuaauaauuguuagaauuucaggaaauguuagauuguuugaagcaaugcuuuucucaccuuuuguaccuguggauaaaggugagaagauggacucccagugucuucgcuaguggagauaguuuugcuucuggcuuuugcaaaaguaaugcuaacuacaguaaucuucguaugcuuuuagucauaucugcucacaauaaucauagaugauauuaaagacauaauuccauaucagauuuguguaauuguuuaauuuuguucuacuguugaagucgcauauguauccaacuuuucuaguuggauauauuguaguauuuguuuauguguauucacaaauacaucauagaaugcauuguucagcucuacucccagucccaguuucucuuugaaauuuucaggaagguagauaaaaugauaaaaguuagauuuguacaguuaaucucaugguggcuuggagauuggauuagaagaaagagaggcaauauaagcacagggaauuaauucauugugcagcuuuugccauaauuuagguaugaguuagaagagcacaauugaaauguggcugugguugauagaauuuaaaaaaaggaaaagaugucagaaacuuuagagaggaguaaauagcacuuugcuggccaguugaaggugagagaucagggagaggaaaaugucaaagauaacuuuuaaggauaaauuuucccuuaagguggaaaagaauuuaaaggaccaguaauuacucagaguuugcuuaacugccuuuucuuuucagugccucuuuaaggcgguuaucaacaaaccuggucagucauuaacuguaauaaucauuguuucugaacaguuauagaugauaaauggaaauauauuuagacauuugcuucaagauucuagucagccuccagcccuucaagaaaacauuuuauaagugauuuuaauuagaaggagcucaugagugugaaaaaccuuguaugaagccuagaagaagagauaaugacaggaacuaaagcuuuguuagguucaugcugccugauagccguuauaugcauaucacccuccuuucacauacuccuuuuguaguuguuucuuuuuccuucuucucuguccucuugguguuuugcuucacagggcaauuggaagggauaauuagcaauacuuacuggaauugguacaugaccagacauauacuucaugcuuaguaaauguugguuggacccuccuccuccugaguacuguuagcaacaacaaccuggucuuaaaaaauguuuacucacauauuuauuauuuaauauagaaaaauaauucuugaaagccuacuguguggcagagacugugguaggcauuugaagauaauuguaagcaagauguccuuguccucauaaagcuuaaaacucuucauagaaucuugguucauguuauauaacuguucaccuguuuuuuuacuguccuguuuuagagugaaaauauuagaaauuacagagcuacacagauaacgcucuagaguaaaugacaucucauccaaacuacugagaguuuagguaagagugaugggaaauuaaaggcuagguaagugaugggauagugaauaagaauugagggauccuugaagugaccguaagauguuggggaauauauucugagaauauacuuaugacaacauaguggccuguugaguuaucagcauauuuggcuuuauuaaauuuguacugacuccuuuaauuuauuauaauuuacuacucuugcaugacugaaaaaaguuuuuuuaaggauuuguuugagguuucauuaauaacaguuuuagauagaauuauguaucaaaaaguacgucauauguuauauaagcaaaacaaauucuaccugcauauuaaaugauuucagguaauucacacuaagaggaagagggucauaauuucuaguauuuguguagcacuuuaugguuugaauauuucuauauggaauaucuaaugugaucauuaacauagcucuggaaggucauuauuguuucuacuuuaaaaacgaauuaaucuuggaucaugaaaguaauguacuacuaaaacccucauauaauaaaaguuaauuuaaauagacuaauguguuaaacacuugccugggccagcuguauaaauuucacaugauuacucugugaaaauugguuaugcuaaacaaauaacuuuuaauuauagucauuauuuauugaguagcuguuaugggcuaggcacugugcuaauaaggaaguuauaucucacauuuugcaaaagcauuuuuaaaguaggcaaauauuuccacuuuacguagagaaaauggaugcucauaaaguuaagugauuuagccaaggcuacaugguuuaggggugaaugagcuagacuugaauucaguucuuuuuuauuccaaagguuuuuuuuccuuuccauuacucccaaguagcaugugcaugccaucaguuuuuggucauuaauuuacuauagguacuuggauucagauuuguuuaaaaaucaguuuuguguuguguuauuuauugacagguaaagauaacaauauaguuuauugcagcaaguuauaaagcagcauauauugaagccaauuuuauauuaauguuuacacacauauauacauauguguguguacaugugcacauacagagaauugagccaagaaauaaauaaaugaauaauuagugaauaaugguuuauauguuaguuuucucuuggugguguauguauuauguaucuuuguauauguguguguuuaaauauguaaaguguuuuaugauuagugacuuaaaugcaucuuuguugagcuguaauuaacacaaaauaaaauguacauauuuuaaguaugcauuuaagugucauucaauaauuauccacuacuuccaaacaagauacaacauauuuuuauccccuucccuaaacccccuugccuguuuccaauugguuacuuuaucuuccagcaaucacuaucugauuucuaucaucauagauuacuucugcuuauauuugcauugcauacaaauagaaugauacaauauauacucuugugucuggcuucuuuuucuuaacauuuuugaaauucaucuauguuguauguauaaguaguuuguuuuuuucuuauuaauauuguuuugguuuuaagagacugggucuugcucuggcacccgagcuggagugcaguggcacauucguagcucacugcagccucaaacaccugggcucaagggauccuccugccucagccucccuagcugcugggauuacaggcacgagccacugcacacagcucuguucuuuugauuuuugauuaauauuccaauauguagauauacuacaauuuguuuauccaucuguugauggacauuuggguuguuuccacuuuggggcuguuaugaauaaggcugcuauaaauauucuuguacaaguauauuugugggcauguauuucuaacugagagugaaauuacagaaucauaauauugacagauguauguugccaacaguucuuuaaagugguuguaauauuucaugcuccuccaacaguguguaagaauuccaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcaccuguagucccagcuacuugggaggcugaggcaggagaauggcgugaacccgugaggcggagcuugcagugagccgagaucccgccacugcacuccagccugggcgacagagcgagacuccgucucaaaaaaaaaaaaaaaaaaaaaaaaagaauuccaguugcuccauggccucuccaacauuugauguugucauucuucuugauuuuagcuauucuuauaaguguguaaugguacuucugugguuuuaauuuucauuuuccuguuaauuaaugauguuaggcaccuuuucucauacuuuuuggccucuuauccucuuuugcuuucacaucuauuuaaaucuuuuaccuguuuuuacauggguuauuuuauuguugauuuguagaugauagucauauauugguuauuaaaaucuugucugauguuugugcugugaauguuuuuuacccauuuuguggauugucuuuucauuuucuuaauagucuuuugaugagcagaggauuagauacuuaugucagauaauuaacuuuauacuaauuaagacugcuuucuauuguucuguauacuuagaaaaauauuuaacacugauauguaaaaaugcuucugcgggauggaaguguuaguaauuuuuuaacauuuucuuuggcuuuuuuauuuuucaaaaugucuacaaaauaauguaacaucagaaguacucuaaaaaauaaacuuuaacauaaauauguguaacuuauggugacauuaauauauaauacucuggugaauacuauauacgugccaugcaauacaugauaaugaagcacauauaaaacacauuacacuuacauuuauuauauuuauuuuaaacugcuuuuuccauuuuuacuuauaaaagcaauguagagagauuaauuauuuuaaucuagucacagccaggaagucuucauuuuuuuucaguuccucucauuuugugcauguuuuuuauacucauuuagagaaguaaaauauaguccaagauauaaaaauaaaucaucaguaauuuuuaccaccuaaaauuaacuucucugaaaauauuuuugaaguauauacuuuccuaauugcaagaauccuugaauugccauguauuaucuccuuggggguaauuaaguguuaaccccaucccuuuucagcuauacuuaaaguuuuauacaguccucacuuccaaaaacauauaaggcaguguaaugucaagaaaauaaaucucuugacauuuugguuucucucucaaucugcauuuuguuuuucuuaauaaugcucaguaauuaguaugugagaguaauacauuauuuuuuauuuuuuugagaugggguuuugcucuuguugcccaggcuggagugcaauggugcgaucucggcucaccacaaccuccguuucccggguucaagugauucuccugccucagccuccugaguagcugggauuaacaggcaugcgugaccacgcccagcuuauuuuguauuguuaggagagacgggguuucuccauauuggucaggcuggucucaaacuccugaccucaggugauccacccaccucggccucccaaagugcuaggauuacaggugugagccaccgcaccuggccauccauuaaauuuuuaacucaucuauuaaaaacaauaccacagaguaucuacagugucacaagcagaauaggcaacuccucgauggaaggacaggagaagacagaucaaauuaaagaugguugaaaucaauuguauucagcucuacaauugaauauauuaaaucacuggauauuuggaauugcugcaguuacugcauuacuuccagagagauucaucaggaauacguguaguauuuacagucuacacaauaugaugaaaagagccacuguaauucuaguaguucuuuuguauuuugcuuccuuccauuugaguaguugccuaucauagcaggcuacccacauuuauuuuuuccuuuuguuuuguuuuguuuuguuuuugagacagggucuugcacugucuguugcccaagcuggaguacaagugacaugaucacugcccacugcagccuuaaccuccugggcucaagcaguccucccaccucagccucccgaguagaugggacuacaggugugagcaacugugucugguuauuuuuuccuuuuuucucucauacagccaugguuuucuaaacuuuaaggcuucagagaauaucaucuuauuucugaccugauacuuuucacguagugcuguuauccguagacaguuuuagagaaggaaaauuggaaacacagaguaggaagaaauagagacagguaaaccucucuuuaaguuucuuuuugcuauuucuauaucuagucacccuaucccccauauaaaaaucaugucaaucucagcuugcucacuacuuuaaguggugacacucuaaggguugacagacugcagcucgagagccaaguuuguuuuauuggaacagugcaaugaacugaauguuugugucauucaaaaauuaauaugucaaaauccuaacccguaacguauugguauuaggaggugggccucugggagguaauuaggucauaagggugaagcccucacaaguggaauuagugcccuuauaaaaagggaccccagggaguucucuagccccauuuccccaccaugugaggagacagugagaaauuggcagucugcgaccugaaagaggaaccaggaccugaccaugcugucacccugaucuuggacuugcagccugcagaacuaugagauauaaacuucuguugcuuaauaagccauucggucuccauuauuuaguuuuauaguauacugaacugacuuaauacacaugaaaaguccauuuucugcacuugcuuucugaucuaaaacauuagaguugcauagcugcauuggagacuuauggccugcaaagucaaaauaguuacagaaaauguuuuucagucccuggucuagcccuggucuagguaaagaagaaagcagagauuucucauuuuauuaccagggaaacuuuaaccuguuauuucaaguuaaaaaguuccucagcagcauuguaccacaugaauguuagaugguaguuuggugucuaaaauggcccuaauacuguuuuaauugaucuggaagucaaauacugucugggagguggagguucuugguaauuauauaaaggagaaagcuuugaggaggagaaggagggagaaaggcugauucauuuugguuuggguuaagaaggauaacaucuucauuaggcaaacauuugacucauuguugaguuaucaucaccugucaguuuuuaaauuaugugcaugcaguuuguuguuguuguaaucaguuuucuuccacuucuauguuagauacauuagagagggaguugucuuguuuauugcuauauuuccaguacuuaaaacaguaccugaucauaauagccauucaguuaauauuuguugaaugaauacacuuagauaugagauuuugcuuuguaacaagauugugguuuuaaaaaaaugucugcaaucaguuuguacccagaaaauaggcaguauuuaaaaauuugcaaaccuuuguaaggaaucuaucuuuucagacuaaucaucguaacuauuaguccuguuagaucauuagauagcaguaacuauauugucacgaguuaaucuguuuggugccugacaagcuaaugauaaacugaaguaaaauguuuagauuauacauuuccauuagaagaguuucacacuagcuucuaugaaccucaacccugacuuugcaaacuaccauagguccuaaauuaucuagaggguuguuauaaaauuuuuaugaacuucucaaauauaguuaaaucaucuuaaugccauugacuugcuuauaauuauucuccuauagucuuuucaaacagauacaauuuauaguagugaaaagauauuacuaaauacagugaccuauucauggccccuuguaauucuuuuuaauauauccagucucacucagugauggaucauucaacuuucaaaauaacuccccaaaaucucuaaguauaaagacauacgcuaaaccagaagucucuagccccugagccuggacugguacaggucugugguuugcuaggaaccgggcugcacagcaggcagugagcagcaggggagugagcguuacugccggagcuccaccuccuguuagaucagcagcagcauuagauuauuaauaggagcacaaacccuauugugaacugcacaugcgagggaucuagguugcgcacuccuuaugagaaucuaaugccugaugauuugaggugaaacaguuucaucccaaaaccauccccaccccggguccauggaaaaauuguuuuccacagaaccugucccugguguccaaaagguuggggacugccacacuaaaucacuuaagauugaauuuuauuuacauuaaaaauauuucaucugucaugaaaauccaaugauugaucucagcauguagcaacuucaaagcaauuggaaauagcuaaguaguguacuuagugcuuugacaccacauuuguugucauagacaacacccaguauaacagaauggaguaagguaggcagacgcaagcuaaauuuaaagcaggacagugcaaaccguuucauuugaugaggaaaacacuaauucaaaacaguuccuugcauugguguuaacagauaaaagucucaaaggaagucauaauggcucuuaaacuaaaauaucaaaaacuugguaauguauuuuaaaaauugugcuuuuguuuuuauuuaaaacaaauaggauggugaagauuuuaauaguuuauagccaucugaagaaauugacacucuauuccggagguggcaaacuacugccuauaaggccauaucuggcccauggcuuguuuuugugaagcauauuuuuaaagcauuuguuucauuacuuuaaagauguugcuucauugucuucuguuuuggacaagaaauccguuguuaucuuuuuuuuuugcuuugcucuauguaacuucuuuuuuuucaaucugguuacuuguaagauuuucucugucagugguuuugagcaauuugauuauaaucugccuaggucuaguuuucuuggcuuguuucuguaaagcaaguauuuuuuaaagcauuuuuucuuucauuauuuuaaagauguugcuuuacugucuucuguuuugcccuguuuuggauaagaaauccgccguuauccuuuuuuguuuguuuguuuuuguuuuucucuauguaacuucuuguuuuuaaucuggcuacuuuuaagauuaucucuaucagugguuuugagcaauuugauuauaaucugccuaggucugguuuucuucauguuucuugugauuggcgcuuguugagcauuuuauugguuuauuguuuucaucaaauuuggaaaguuuucauccaucacuuuuuucuuuuuuugcaaauaagacuuuauuagguacuuucucucucuuaugaggaggauuuggguccuuccagaugaagcuccaaauugcuagacaauacacuguuuccuucaguugcagcaaguuuaucccacagugggugcucaggaaagcaucuugagggugaauggguuucaggccauucaugguuaaguuugucugaugcuuuuguuaguuaagauguuccugugucauuucuuggaagcaguuuugugucucccuccaaauaguccaccaccuggcugcaccccaccuccaucugucccccagcuaccagguaauagugaaugguucagaaggugcugcucuagggcagccaggccuuuagcugcaacacagaacaaugaacagcagcaauuuccaacucccuucaugggucugaugcgaggucauuuugaugaccuucuaguugcacaggauagagcaguaagacagcagaaacaccgcuggcagcaccuggcaggggacaagagccguauuugcaauaggccugggaaggcuggguggccuuuagccaucauuucuucaaguaauugcucuguucccucaauucuuucuuuucuuugggguuuccaguuacacauauguuaagcagcuuaaaauuccacagcucacugaugagguuacgucccaauacaugcauuguuaaguugaaaaugucuuaagucaaaaaugcauuuaauguaccuaaucuaccaaacaucuuaguuuagccuagccuaccuuaaacauucucagaacacuuacauuagccuauaguugggcaagacuaucuaacacaaagccuauauuauaauaagauguauuauauuucauguaauauauugaguacuauauugaaaaacaaugguuuuauggguucuugaaguauaguugcuacuaaauguguauugcuuuggcaccauguaaaguugaaaaauuaggucuaaccguucuaagucacagaccaucuauauauuuuaucuaauuuuuugguuuacucaaacagggacaguauauuucgucccuuuuacuacacuguagccaugcuaucaaacagcuaucaagugaaaguugugaugcugagauuuuucuuagucuguuucaugcugcuguaacacaguaucugagacuggagauuuauaaaauacagagauuuauuucucacaguucuggaggcagggaagucugaggucgaggggccuucaucuaguaagugccuucuugccaugucaucccaugcuggaaggucaagagagcacuggagguggggugaggggagagaugcuugugagagcaugagcacaagcaagguggggguggugcaugcaagagagagccaaaagcuuuuauaacaaacucacucucaugcuaacccauuuccuccuuaacaauccauucaugggggcagagccuucauaaccuaaucaccucuuaaaggucccacuucucagcacuuuugcauuagugguuaaguuuccaacacaacuuuggggggaacacauucaaauaauagcaagauuuaagauuuugugguugaguaauuccaggcaaugauacagagcuggaccauggguacaggggaguagagaugugaaguuaauuggauucgucacagacuuugaagucauuuaaauuaacagauuugggguggaggguaagacuuuaaaccaagagccaaaguugugaaguuuuaauacugcauguuuuauguguuugaacaggaaaauacucauaaaauuguguuaaauugucuugucuuuccuucuagaaccuucugauaacuuaagagagauucuccaaaauguggccagauugcagggaguaucaaauaugagaaagcuaggccaucugaauaacuuuacuaagguaaguaacuugaauuuuuauuauugucuaaaauucuuuguuccuuaccacacuuacuaaauguuucuugaccaucauuaaauacaaauucuuguguauucacucagcauuaaugcuuuucuuuccugcuucucauggauuuuguccaguguaucuuaaaaauguauuuguguaauagaagaauuauaucuuuguuacagaaaauuugguagguucagaaaagaauaaaaucacugagaaauuuacaguucaaccuuuuauucacauaaggauguauuucuuuugccuucuacucauuuuacuugauaauauaugguacaggcauacauuggagauauuguggguuugauucuaaaccagugcaauaaagugucgcaauaaagucaauguuguaauaaagcaagucacgaguuuuuugguuucccagugaauauaaaaaguuauguuuauacuauaguguaguccauuaagugugcaauagcauuauguuuuuaaaaaaugcguguaccuuaauuuaaaaauauugauuaaaaaauacagucaucugagccuucagcaaauugugggguuuuuuuuguugguagaggaacuugccucaaugucaguggcugcugccuuaucagaguagugguugcugaagguuaaggugacuguagcgauuucuuuaaauaagacagcaaugaaguuugccgcauugacucuuccugucacgaaagauuucuccguagcaugcagugcuguuugauagcauuuuuucuuucaaaauuggaguuaguccucucaaacccugccacugcugcaucaacuaaguuucuguaauauucugaauuauuuguugucauuucaacaguguucauagcaucuucaccaggaauagauuucaugaaaccccguuuuugcucuuccauaagagggaacuccuuauccauuaaagcuuuuuucaugagauugcaacaauucaguugcaucuucaggcucccccucuaauucuaguucucuugcuauuucuuccacaucugcaaugacucccuccacugacaccuugaacgccucaaagucauccaugaguauuggaauaaacuucuuccaaauuccugguaguguugagauuuugauuucuucccaugaaucaggaauguucuuaauggcaucuggaacgauaaauccuuuccagaagguuuucaguuugcuuugcccagauccaucagaggaaucacugucuaugguggcuguaguguuguaaaauguauuucauuaaaauaaaacuugaaaaucaaaauuauuccccaauuccccgauucaugggcugcagaauggauguuguguuagcaaacaugaaaacaacauuaaucuccuuguaacugucaacucuugggugacuaggugcauugucaaugagccguaacaauuugaaagaaauccuuuuuuuuccugagcaauagcaaauacuguuuucucaacaguauguuuaaaauauguaguaaaccaugcuguaaacagaugugcugucauccaggccuuguuccauuuguaaagcacagacaaagcagcuuuagcauaauucuuaagaucucuaggauuuucagaauaguaaaugaucauuggguucaaucuaaagucacgagcugcauuagccccagacaugagucagccugucuuuugaagcuuugaagcuagacauugacuucucucuaguuaugaaaguucucgauggcgucuucuuccaguugaagauuguuucaucugcauugaaaaucuguuguuuaguguagcuaccuuggucagugaucuuagcaguaucugcuggauaacuuguugcagcuucuguaucggcaccuacugcuuuaccuugccauuuuauguuacggagauggguucuuuccuuuaaccucgugaaccauucacacuuuucuucugcagcuuccucaccucucagccuucauaacauuuaagagaguuggggucuugcuugcucuggguuaggcuuuaguuuaaaggaauguugguagccaguuuaaucuucuaucuggaccacuaaaacuuucuaucagcaguaaggcuguucugccuucauauuauuuguguguucauuggaguaguacuguuaauuuucuucaagaacuuuuccuuugcauucacaaguuggcuaccuguuugucucaagaggccucucuggacuuucuucacuaagcucaaucucuaauuugugauuuaaagugagagaugguugacucucccuuucacuugaacacuuagaggccauuguaguguuauuaauuugcccaauuuuacugaauauuuugucucaggaaauaggcccaaggagagagggagagacaagaacagcuaguugguggaggaauuggaacacacauuuauuaaguucaucguccuuuauggguccaguucauggugccccauaacaaugauaauaguuacauugaggaucacugaucacagaucacccuaacagauaauaauaaugaaaacauuuuuaguauuguaagaauugccaaaaugugacagacaugcaaagugagcgcaugcuuuuggaaaaauggcaccaaugaacuugcuugaagcagguuugccacaaaccuucaauguguaaaaaacagaguaucugugaagcucaauaaaaugaaguaugcuuguaaguauucauauguaacuacauaugugugccauauuucauaaauauagccauaagcccaaagaacuauauuauaacuuucucuuuuccugauguuguauccccauuauuuggaucuaaauuagagcccaaauugugggggcccuggucccaaauaaauauugacuugaucucuaguagcagcccagaauucuugaguuugaugaguggauugguauguuucucagccuuguaaugcuggacagccaauucaugcaaacacuaaaaugccugcuauuuuaggagauacccuaaaauagaaaacagaaugggucuuugggauaacguuccccccaccuuuuaguauauuaaauauaaauuguuuuuaaugaaagaaucauuuuauguuuaaucccuugcugcucaaaauaugauccacaguucaucaguauugguaucgccuugaagcuuguuugaaaaugcacuauuuuagccccaccccagaccuacuaaaucaggaucuacaguucaauaaagagucucaaguaaauguauguguacauucaaguuugagcaguacuguuuuaauccuuccaaauauucuuugucaaguaauugaacugugacuuggauuugauuuuuauuucauagaaauagaaggggaugagaauauagucacuauguaauacaauuuuuuauguaguauugugcaauaaauauagguuuuuuucuauagcuagagaagcaaguacauaggcauuuauuuuuccguagugaaguuuuaaaauacucuggcuguuuuuuaauauauaagagaugauaaaaugauuuuauaugagggaugagaaaguuuuuuuuuuuaaaaaacagcuuuuaaaaacauugacuagguacuggagaacgggcuuucaaaaguaugggcauguauuuuguagugugagugaauguaaugaaaaucuucaaacaucuuucuucaacaugguggugagauaaugucaaaucuuuaagaccgcaacauuguuccaagguugcaaaaugcaucuucuaguuucauugucuuuuauuaaauuuuauaguuuuauuucaccagucuucacucaauucaaauaagccucacuugcuuaguuuuaacuguuaaaaacaauuauaauagaggucuguguccuguuugcaauuauaauuacuguuauaaccaaguuugcacagcuagauaauauaguuccacaucucuugccaacaggauucugaaaguuggggauggagguaagaauggcaguaauuccuguuauuuuacuuuguuacuagcaugggucuuacagcaaucuuaaaaaucuagaauaguguugcguaauagaaauauaaugugagccacauguguaauuuuaaauuuccugguagccauacuaaaaaaguaaaaagaaacaugacauuaacuuuaauauuuuuauuaagccaguauaucuaaaacaucauuugauguaauuaguauaaaacauuauuaaauguuauuuuacuauuuuuucauacuaaaguuuugaaagcaaguuuaugguuuauacuuaacaacaaacuucaauuaagacuaacuacauuuccagugcucauagucacuugcaacuaguaucuacuaaccacauuggacagugaagauacacagcuuuuuggaacaggaguggcuuaaaagccuucauuucuaggaaucuguugaacaccucuggccuucauuucuaggaaucuguugaacaccucuuauucucccuucucauucuucauuuauuucugucuaggucccagguuuucuugcauuaggauuaguuucccuuuuuuucuuucuucuucucucuucaguuuccuuguuuucuguuggucuaaauuucccccacaguauuucacuaaguuauucgcuccaccuccucucucuuucuugauuugugcucccccacucucuucugcccuuucuccuucucaucccuucucuacuucuuccuuucgccccuucaucuucucacucuuuucuucacccuuccuugucaccuuucucuuccucccucuuuucucaguucccucuccccccuucucuguucccccucuccuuccuuuucuccguuguaccacuguagaguaugcaguguaucucuguaaugaaggcucuaaacuuuuuguacuuuuugucuuguuuguuuuuuguuuuaccauauccuuuuuaaaaugauuuucauauaucccucuggccuuggugcaagcuuuguagcagccccuuucuuugcuauguugccaugauuuuaaaauccugauagccaaacuuauuagaauuugucuauucuaagagugaguacgcccugagucaggaucuuaggggcugucccaugaauaaaguccaugaacuuuggacuucauaaaaucuauuuuggcugcuuagugaugugcugggaaaagcaugagcuuuagaugaaacagauggagacuugcagcccaacugugauuaacugucagggcaaucuuaggcagauuucuuuacucagagguaaucuugcuuucuguagaggcaaggucucagucuagugccugacacauaauaugugcucuguaauagguagugccuugauucaaccucauguuugguuuuuguguuuuguguuuuuuuguuuuuugucacuucucuaguuuuuuagcugacuguaagauggugagucugcuuaauaguuugaguugucaguugguaaacuauuacuguaaaucaggguucuucaaugcuggcauuacuaacaaauugagccagaugauuauuuguuuugagaagcugcuguguguauuuuaggguguucagcacugccccggccucuaccuacuagaugccaguagcacccccaccccaaaccaguugugacaagcagaaaugucuccagauauugccaaauguucccugggagacaaaauugccccccauuaaggaccauuucuguaaauaaauguguguguagauuuuauuauaaaauuuauucaaauaugcagcacagaacacugaauuuaauuguacugugucuugaauuccauuuguuagagaccuggguuuauaaauauuuagguaacuaguauuccuauaaaaccuguaaauucauucauuugcuuauugaguaaaauuuaggaauucucagcaauuucugagaauagcucuauagaauaagaaaauaagaaaaauaauuaugaugccaggacuaguggaguuuguuugcuacccucuucuguguuuccauuauuugauagauaugccuacuaaauuuuaucuauuuuauuauuuauuguggguugcucuguuacuaaacugaguuucucaaacacaaaaaaauacguaguauuuauuuuuccacccucauaucccucucuacucaaaagcgugucacauaauauguguuuaauuaaugguauuauauuagauugggaagaugaugcauuuuaaauaugaguuuuuguuuuuacuggcauuuguuuuguuguuaaguauaagccuguuaggauuaaguuaucuuaauagaacagugacauuaaaauguuguauagggugaacuucagcuucaaaacuaaacuuccuuuuaagguauaaagaaacggagcuagugaugugauccuuuaaccaugugaaugucacacacccaugcuugccuucugacaucaucucacuggauaaaguaauguguauaacagacugcugaugaguauaaucuuaguauucuauuuuuauaacugacaacaugcucauaaucuaaagaccugcuuuuuaaagaugaaaauauuuuagcucguuuauaucuuaaaaguucucuuuuccuauauuuaaucucauauauuuauauuaaaagcuuuaaaagaauauuuauuuuguucugcuuuuuaaaaacuuuaagguauuauaagcugaguaaaaaaaauuaaaaugguacagaagaauauaugauaaaaagugaaauucuucccuuucauacccuucccacccaccucccuguucugacagaaauaccacucuccagagguaaccacuagaaaguauccuuuucugguauaauuauaaauguguauguguauuuucuugggaauugugagauuuaaaugagcaaaauaaaaugaaguguuuacuaucaugcucaguuuauuugccauuuauuauacaguuauacguaauuuauuuaccauuauuacacaggguaugguaaaggaaugcaucguuaggugauuucaucauuuugugaacaucauagaguguacuuacacaauccuugaugguguaguguacuacauauccaggcuaugugguauagucuguugcucuuaggcuaugaacauguacagcauauuaguguacugaauacuguaggcaguuuuaacacaaugguaagugucuaaacauagaaaagauacaguaaaaauauaguauuauaaucuuaugggacuacaauucuacaugugauccaucauugacugaaaaguuguuaugcagugcaugacuguagauguauaugcaaaaagguauuuuuuaaaugacagcaugauauguguauauaaauguguauguguguauauauaucuuuguauguaaauguguauugacuugcaguuugcugcuuuccacaucccaauauaucauagcaugcuuuccuuuucuauacaugucaaucuacuuuuuuuguagcucuguguguguguguuugugucuaaauugccauguaaaagacugugccauggaauucuaguaugugagauaacauuuuuuaaaauuaggguuguuguuucuuuugcuuauuuacaacuauuuaaccuucagaguaauacaaguaaaaugggaguagcauuuagaacuaccuaguuuuaacuagucauuacauuuuuuaaaacuugaucauuuuaauaaacagacaaauuuuuaauacuuggagauaauauacaguucuguuguaacuuugacaggauauaauuguuuauagcccuuuuugaauauuuuaguauuuguguaagaaagucauguagauuuauuauaacaaauaacugauucacugaugauggacauggauuuuaauagucaaaccagugacauuaucaaaaucuuuaacccgucuuaaaauaagauuuguauaauaguauuuguuuugcuuuuauaaaaauguuaaguuuaacguguuauacucauaaaauaauuguggacuuaagauacugaaaguuuaacuuguuuauaaguaauaaauucaacaaacuuaauucaucuuagcuaaaauauaaagaaauuuuuuguguacauaauuaggaauaucaaauguuggauccuaauuucagacaagacaacccagggguugagacacugucaauuacaugcugccacucuauuuuucauuccuguuuucuuucagguugucuucauucucagauaaacacuuuccaugggacuaagauaaaauacaucauccuuaauacuucuagucuugaaaagcagagaguaacccucucuuagcaucuuuguauaugaacucugauguuauuuggucagguuuagcuaggcguugugacugauagccaauuaaaaaaaaugcauggauggcauggggagugccaaacccaaugaaaaguguggugucuaauaauuuagcauuuuaugugacuguaaacgcuaauucuuaacauuuuguaaagucuuuaacaauuucuaaacauagucaaugauuuguucuuaauauauaauaacaagccuauauaauaggguagucagaauuacauuuuaaugacuuacauuaauacaggagauaggaugucaacaguaacggcaaaaauaguagugacgaaacugcuaccuaauuguugaagauuaauuagcaacuugauuauuaguagaggcuucgcaggauguccauguuuuaacucacucuauguucuucuauuucuucuuguaucuuucauaguauauuaguccauucucauacugcugcaaagaacugcccgagacuggguaauuuauaaaggaaagauguuuaauugacucacaguuccacagggcuggggacaccuaaggaaacuuacaaucaugguggaaagggaagcaaacauguccuucuucacauggcggcaggagagauaaaugaguguugagugaagggggaaggcagcuccuuauaaaaccacugauaguucucucagaggacuuuuuaagggggaaggaagucccuuauaaaagcggugauagugagugaguucucucagaucucaugagaacuuacucgcuaucacgagaacagcauggaggaaaucacccccaugauucaaguauuuucacgugaucccacccuugacacauggggauuauuacaauucaaggugagauuugggugggaacacagagccaaaccuuauaauucugcccuggccccucccaaaucucauguccucacauuucaaaacacaaaugugcccuuucaacagucccccaaagucuuaacucuuuccagcauuaacccaaaaguccaaguccaaaguuucauuggagacaaggcaagucccuuccgccuaugagccuguaaaaucaaaagcaaguuaguuacuuccuagauacaaugaggguacaggcauuggguaaauacacccauuccaaaggggagaaauuggccaaaacaaaagagcuacaggccccaugcaaguccaaaacccaauauggcagucauuaaaccuucaaguuccaaaaugaucucccuugacuccaugugucacauccaggucacacugaugcaagaagugagcucccacagccuugggcagcuccaccucuauggcuuugcaggauacagcacccccuccugacugcuuucaugggcuggaauugagugccuguggcuuuuccaggcgcccagugcaagcugucgguggaucucccauucuggggucuggaggauaguggcccucuucucacagcuccacuaggcaguacccaguggggacuuugugugggggcuccaaccccacauuucccuuccacaguguccuagcagaaguucuccaugagagcuacaccccugcagcaaacuucugccuggacaugcaagcauuuucauacaccgucugaaaucuagauggagguucccaaaccucaauucuugacuucugugcacccacaggcccaacaccauguguaaauugccaaggcuuggggcuugcaccaucugaagcaacagccugagcucugucuuggccccuuuuagccacggcugggauacagggcacuaaagacuacacaaagcagcaagucccugggcccugaccaggaaaccacuuuuuccuccuaggccucugggccugugaugggaggggcugccaugaagaucucugacaugccuuggagacauuuuucccuauugucuuggugauuaacauucagauccuuguuacuuaugcaaauuucuguggccagcuugaauuucuccucagaaaauggguuuuucuuuucuguugcaucaucaggcugcaaauuuuccaaacuuuuaugcucugcuucacuuuuaaacauaaguuccaauuccagauuguaucuuugugaauauauaaaacugaauguuuuaaagagcacccaagucaccucuugaaugcuuugcugcuuagaaauuuuuuccaccagauacccuaaaucauuucucucaaguucagaguuccacagauuucuagugcaguggcaaaaugcugucagucucuuuguuaaagcauagcaaguaucaccuuuauuccaguucccaacaaguuccucaucuccaucucagaccaucuuagccuggacuucauuguccauaucacuaucagcaauuuggucaaagccauucaacaggucuauaggacguuccaagcuuucccacauuuuccucugucuucugagcccucuaacuguuccagccucugccuguuacccaguuccaaagucacuuccacaugucguguaucuuuacagcagugccccacucucugugguagcaguuuacuguguuagucuguucucacagugcuauaaagaacugccugagauuggauaaucuauaaaggaaagagguuuaauugacuuacaguucugcauggcuggggagaccucagggaacuuacaaucauggcggaaggggaaucaaacacauccuucuucacauggcagcaggagggaaaaugagugccuagaaaagggggaagccucucauaaaaccaucagaucucgugagaacucacugucagacgagauuggguguguucagggugauauggucauagauggaacucacuuucacaugaagagcaugguggaaacugcucccaugauucaguuaucuccaccugguccugcccuugacacguggggauuauuagaauucaaggugagauuuugguggggacacagagccaaaccauaucacauagaaaaagagcuaaacaguuuaauguguacuuuaggguuugguuauuuaaauuaggagauaacuaguaagguagucaucacaagaaguuuguaucaaagucauucuuauucauaauauuuugagauuuauauaugaauucuuagugauuagcagugaaaguauaauauuucuuugauaauccaaaauuuagaauucuauuacuaucuucuuuccuauucccaauauauaugugaauuuauuuacacauagaaaguuuaaucacugcucgggauaauucuaauucaaaagguuuuucauuuaagacugauuaaagcccucuucuacgguccuggaaacaaccugaaggcauuuaaccauuauugaaugguuaaaugguuaaauuuaaccauuauugaauuccauuuacuaugucuggaaaauaggcacuaauuaauaacaaauauauuguguuucugccauaauuguucuuuuuaguuauuuaugauuuuccaguuuccagcugauucagcaucuuucucaaaaacuuuucuugcauuugagaugcauugacauuaauaaucagaaaaugacacaccucucuaaacacuuuuuaaauggugcguguuuguuuuuuaagauuauaauaccuuugaauuuuguuuaacuuuuucacuaaaacugcuaacucuaggaaauguuaagugauaaauggucauauauuuuucucgucugagaagguagauaauuugaaaauuguguucucugaaucuauaguuuucuacaagguugacuggcaaguaugaaaaauauaaugcaggaaaugagagucaaguacacacuuaggggaaaaaccaaccuuuuaaaggacaagacuuuguauauuuguagaauuuuacaaccuuucauuuuauuaacauucauuauuacuguagcagaggaauggaaauacucccuuuuuaagcaguugaguugauauguguaaauuauaauuuaagaaaguaacauuuuuucccaguuugaaagcacaauauuuuguauguugauauaaacaaauucuaaccuuaauuuuucuauauuauauauauuugaauauucccaaggaugaaguaaugauaacacuguaagcugaccauauuuuucuuucuuacucauguaugguaccacauagugauaaugcuaguauucugaaauaugugagaaaucuuuaaaauaauaaauuauuuuaaggagugaaagugcaguuuuuuauauuuuaauucuuugaaaugggcaguuuuuuuuuaaugguauauuuuuaguuagcaguucuggagaaaacaauaguuaaauuuucuuauuuguuuuauguauauauauagccagggugcaguucuccagauucuugaugccacauuugaggcuggagaaaugaaauaagaugguaauguucaauuguuuuuuacuuccccuaacccccaacccuguguaaauaauuucaauacaaaauuauaguaauauuuuucauagugggcucuggcgucaaacugguuugaucugauuuccagcuuuaccacuuaauuaggcuuuguggccuuaggaagucauauuaaccucucuaagccucaguuguuuucauuuacagaaguacuaccaggguugagaagauuaccagucaauaauuguuacuucuguguguauucaucaauacuauauauaaaacuauuccuagauggugugauacauguuuaauugugaacauuuauaaaauacacaaaaacgcagaggaguuguuguuaaaaaaauuuuugguguuaaaauuuugauguauauccuuuuuuuuuaaaguguguuuuuaagaaauaugucuuacagaaucuuuuccccauuuagcaauagauucugcauauuuuucuuaugauuguauauuacaguauuuuaauggccucaugaaguuccuccuuuauaaacauuuuauucccauuucuuuaauguuauaaauaaugucauaagcaucuuguacuugaaccuacuuuauauuaguaaaauaauuuaaaauacauaaaucuccaaaaguggaucuugauccuagugcauuuuuccaauuuauuuuauaaaauauuuucaguuuucaaucccauuaccaguauauaauaauauuuaaaauaauauuuuacaauauauuuaaaaacuauuauaguaauauacaauauuuaaaacuauuuucugaaauauuuacaauaauaaaauaauauacaauaauauuuaaaacaauauuuugccauuuuugugaguuguaaguagaacuuugcaauucauuugauuuggguuuuaggaaaaaugaauauaugucauauuuauuugucaauuauauuucuucaguaaauuccuuguacauuuucuuugccuguucuucuuugggguccugagaaguuuuuccucaauuuguuucaaccuuuuacauuauaaggaucuguauuaguuugcuaggugaggauggaaugcugugagcugaauugugucucgucaaaauucguauguugaauuucuaaccuccaauaccucagaaugugacuguauuuggagauagggccuuugaaaaagauaauuaaagaaaaauguggucauaugggugggugggccuaaucuaauauaaucucuuauaaaaaguguagauuaggagacagacauacacauaggaagauauagaaaauagccauauguaaggcaaggagagagacuuuaaaaaaacaacaacccugccaacaccuugaucuuagauuucuggccuccagaguuaugaaaaaguacauuucuguuguuuaagccacccagucugugacauauguuauaguagcccuagcaaacuacauacagugccuuaaccuuuuucuuaccauauuuguugcaaauauuuuuuacuaacacauugucacuuuuaauuuuagguauaugguugguuuuuuagagguauagaaguuuuaucucaaaacuuagaaaauuuuauguuauuuuaaauauguauguauaaaaacgcauucucuuaaauuuguaacuacuuucaacacuguacaagacaguaaaaacaaaagaaaaacauacucuuugaaagucugaggccucuuuguucgucauaucagaauuuuaaggaauaccaguauuguaauaucagcaguguugcaauaucugauagcagcuauucuaguccugucuccuacccuauucuguuugggacccccuccccuccccuccucuccucuccccuccucuccccuccucuccccuccucuccccuccucuccccuccucuccccuccucuccccuccucucccuuccccuucccuccccuuauuuccucuaaagaaaaaauuggacaggaaauuuuuacaguuauccuaccaauaggguagugaacuuuuaucagcuuuuucuuaggguccaugcuucucguggaugugaugugauauguugaucacuuugguugcuuuauacuguaugguuacaauguuuauaacuucauacugagaaagaauauuagcacuuuggagacccuucuuggucuucaguguuaaauaaaugauuuaucuucucuuuaauccauuucaguuagccgcaauaaaucaauuaaggacauuauauguaacuuuuagguaaaagucaauucuccagacucauaucuagauuaaacuggcauauauucauccaggugggauccauaaagguaguauuagaccaccgcucucaaugaaaacuaggaaaaccuguuugaaggcagcaggaagcugcucgggcaacaauaagugcagacaccaaccuuucagaaaagagagaaucuuguacaaauaagcugcuucaacaacuuuuucccaggggacacuugcugauguuaaguaugggcaggaaacgggauucaagcauuaggcccagaaauacuguugccgaaagucaaaaaacagcacagagguuuugguggaguccuaccuagaugcaucaagcaugaggagauucuccccucaguucaguuguuuaauccuggggcuaccugggaugagaaacuuaaaaccuaaguagaaaaucuuugaaaaucaggaauggaguuugcaggacaaaaauuaaauuuuucauccuccuuggacuaguuuucuuaacaauaagcuuucaguugaaacuucagguggcagggaaaaagcagagguaggccuggucuuaccagggcaaccaccuaacguggacucaacaccaucuagugguuuaacagaaagaaggcugaaccuucuguggagacagauaacaccaucaaaucuuugcaaguuuuuauauacaaucaaagacuaaggagcuaccaaaggacaggauuacaugacuagaacaaaagggaaaacaguuaauaacagauccagagaugauccacaucauucagguuuauuagaugaaaccuauuuucaguaacaacuaugucaugaacauagaggacguauggagaaaauugaugugaaaugaagaauuucauuagcacauuggaauggcuaaaaggauuaaauggaaauucaagaagggaauaauacaguaucuacauuuaaaaacucauuagauacauguaauagaagauuagacacaucagaaaacagguuauagaaaauauucaacugaagcauugagauaaaauggaaaaaaaaaaaaagaggauuuacggauuugugauacacaugagaagaucuggcauacauuuaauugaauuaccagaaggagaguuuggacagaaguaguuuugaaaauauauuguauagaauuuuucaaaacugcagaaguagaucaacccagagauuuaggaaguuuuguuuacccuaagcaggauagcuacaaaggaaaccacaccuagaaacauuguaauaagauugcuggaaaccaaagauaaggaaagaugucuuuaaaagagucugagugagaggccgggcgcuguggcucaugcccauaaucccagcacuuugggaggccaaggcgggcggaucaccugaggucgggaguuugagaccagccugaccaacauggagaaacccugucucuacuaaaaauacaaaauuagcugggcgugguggcacaugccuguaaucccagcuacuagggaggcugaagcaggggaaucgcuugaacgugggaggcggagguugcggugagcugagauugcaccauugcgcuccagucugggcaacaagaaugaaacuccaucucaaaaaaaaaaaaaaaaaaaaaagagucugagaggcccagugcgguggcucacgccuguaaucccagcacuucaggaggcuuaggcaggcagaucguggaucaccuaaggucaggaguucgagaccagccuggccaacauggugaaacuccgucuguacuaaaaauacaaaaauuagcugggcgugguggcaggcaccuguaaucccagcuacucggagggcugaggcgggagaaucacuugaacccgggaggcagagguugcagugaucucagaucaggccacugcacuccagccugggugacagagugagacuccgucucaaaaaaaaaaaaagaguuugagaaauaaaugacaugacuuucaaaagagucaacaauaagacugauggcagacuucacaacugaaauaguggaggccaucuugaaacuguuggaggaaaauagcagcuaaccuaaacuucuaaauauccagcaaaauauucuucaaacuucaauguaaaaaaaaaaauuauuuccagagaaauaaaaaccaagaaaaucauuaccagcaaccuggucuaaaauuaaaacacuaacagaacaagucaacagcaacaacagaguucuucagguaaaaggaagauaucccaauaaggaaccaucaaaaugaugaauaauaaaaaggguaaauaugugaauaaauauaaacugauauugacuaaauacuguuaaaacccauuaacaguaauacgguauaguuuuuaaaagauagaaaaaacaauuguaaagugaaaugugaggggagaaagugaaauuaaagugugagauucuggcauugaggacauugugaagugauacuuuuuguuagauaagucaacaaugcauguuguaaucuuaauaguagccacuaaaagaaccauuuuuaaaacaguaaauuauugagaaggaaaauggaauaauagaaaacaaaugauuuuuuaaaaggcaggaaagauaaaagauuaaagaaacuuaaaacuggcaggucaaaugagaaauagaugauacaaauaaagcugcugauuugaacaguaaaaucauauuuuucaaaauauuauuccauaaaaauaccuuauuuuccaguguaaauauauaauguauauaaauaugugaaaauauacaacacauaaaugcacacuuauuuuguuuuucugacagcuucuuugugauauuggccacagugaagaaaaacugggcuuucacuaugaggauaucauaauuugguaagugugguucauuccccccucccaucccuuucagauuuuaguaauuuuaauuuuaguaauuuuaaacuagaaauagaauaauacagcaccucauauuugauuuuauagaaauaguugcuugaacauuagaaaaaaucuaagagcuacaguaguuuuguuuuugugagucuuugugauauuuucuaauuacuaaauaugaagaaccaaagugaauguucaaaaauaucuggacuucuauaauuuaaacuuuuaaauuaaaucugaaauuugcagacuaaauuucucauauuauucccaggaacaacuauaacucuaggucuuaccuaagagaaaguuugugcuuacaacagacuugauuugcccaugcacacuaauagaggcauguuauauggcuuuauaacuaucuuuuagguacucuuaggaauuaaaauugauauaaaaggucugugccugcuauuggcauaaauuauuauuaucauugauuuaaaccaaugauuuuugggagguauggaaccagguaggcagagagaggauauucgauuguagagacacaaaugguacagcuugaaaaaggcuguaccauuguuuauauaaaacaaaggcuguuuccauuguuuauauaaaauaaaguacagaagguaagaaagaacucaauaacauuuucuugauugguaagaauguacuaaggaggcacagauuuaaaaaaacaacacuaagugaaauuguguggcuuggagugaguaauuuuuauauauguagaaugcucuuagaauucugugcaugacuagaauuuuugcauauuuuggcugaggaauaauuugguaauauaauuuuguguguauuugaaaccugugcagcaaaacuuguauuuuguuuguuuucauacaguuugcgguuagcuuuauuaaaugaagcaaaagaagugcgagcagcagggcuacgagcgcuucgauaucucauccaagacuccaguauucuccagaaggugcuaaaauugaaaguggacuauuuaauagcuagguaaauuuccuagacuuguuuauauauuuuugaaauuuuguguugaguuuuuagcaugccugccauaaaguguauagauuuguacuguaguguaacuuugaugaauuuuguguguguguauauauauauauauacacacacacacacacacaaccaaguaacaagauuuagaacauuuucagcaucccaguaaagcucuguuacaucuccaaucaguuguaaacauuauucugacuuuucccauugcagacuaguuuuuccuguucuugagcauuguguguuggacguauacaguaauuacucuuucuucuucucauuauuaucuuugagauucauacauguugauuuuuuuuuuuuuuuuuuuugcuguguaacauuucauuuuauaaauagaccacaauuuauuccauucuguugaagcuuuucuggguuguuuucaguguuugacuauuuggaauaaagcugcccugaauguucuuguagaaggcugcaagaauauucuuauagaagaggaaaugcacucauuucucuuagguauauguagaacuagaauuucuggguuauaagguacauguauguuuagcuuuaguagauauugcuaaauaguuugcuaaaugauugcacugauuauacuucuacuauuauguauaggaguuucagucuccccguguccccaucaacacuugcuauuuucaguuuuuaguuauauccuuucuuguguggggucucauugugguuuuaacuuguguuccccggugagugaugauguuaggcacuuuucauuugcugguugaaaguuuggauagccuaucuuuugcucauuuguaaauuggauuaucuuucuuguuauguaggaauucuugauguauucuggauaugagucuuuacagauauauguauugaaaaugucuuguuucaguuugccuugccuuugccuugccucuucauucuuuuaaugggucuuugaugaacaaaaguucauaauuagugaaauccagaaugcuuuuugucuauuuggaagagaucuguguuuucuuuuaaagguuuuauuccuuuauacguguuuaagucuuugaaccaucuuacuugauuugaucucauuugaugguuguguaagauaugagauagauggcaagucaugauucauuuuuaucuuuaugaauauccaauaaaauuagcaccuuuuauugaaaauauuuucguuucacgucuagauuugugucaccuuuguuguaaaucagguaguucaguagcaaucuauuguuggguucucuauccucuuuaguugguauauuuguccuugcaccaguuucucaacuguuuuaacuacugcaguucuauaauguuuugauaucuguuaaugugagucuaauuuugcuucuucaagacuauuuugacuaaucuggguucugcauuuucaucuaaguuuuagaauaagauaguccauauccacauaacuugcugggauuuuagcagggauugcauugaugcucuagauuaauuuggggugaauuuacaucuucauacugaauuuucuaaacauuuauuuauuggaaacuuugauuucugucaacaguauuuaguaguguguguuuguuuguuuuuugcagaaguccugaacauauuuauucaguuuauucuaagauauuuuucugauaguauuaauguaauuuaaaacauucuuuucuguuuuugcuacuaauauauaaaaaaauuggggggagauauugaccuguuggagauauugaccucuuauuuaacaguuuugccaaauucacuuuucaguucugguuguuuguagauuacuuuggauuuucuauguguauaagcauuaauuacagaugauguccauuuuauaucuuccuuuccaaucuuuaucuuuuucuuaccuuacuacaugaguuagaauauugcacugaauaggaaugauaauaauggacaaguuuguuucgaucuugaacucagguggaaagcauuaaguauuucaccauuauuuauacuuucuauaagcuuuuacuagauuuucuuuauauuccuaguuugcauucuuuaaauaaacaccacuauuugugauauauuguucucuuuauauguaacuuaauuuccuugcuaauauuuuauagauuuuugcaccuauguucaugagaguuguugaccauuauuuuuccauucaucuaaagucuuugucugguuuuaguauugggaguauguauguuuguuuuauaaaacaacuagggaaauauggccuuguuuucauauuaccuggaaaauauauguaagauauguauuuuuuuuuguccuacaugauuauaauucauuaauggaucucucuggcuggguuuucuuuuucagccuguuuuaaaauuauagacucaauuauuuuucacccauauaaugcuuccugacuuuucuuuuucuuguuucagauuuugaagcuuuguuguuacuucauguuuagaacugcuaaaucuucuuauugggcuuaauccuuuuauaauuauaaaauaacccucuuuauuccuaguaauacuucuuuuaugaguguucaugucaucuaauaauacauuaccaccuuucuuuugccuagugguugcaugguauaccuuuuaccauccuuuuacuuucuuuuuuugucuuuacauuuaagugucuccccuguaaauaucauauaguuuuuuucuuuuuuuauaucugguuugaccaacuuugucuucuuauuggaguauuuagacuauuuaugucuagugguuuauuaugugcaugauuuauggacuuugucuaauguaauuauuuguguguauuuaugaguuuguugucucauuacuagcuuccuaauacuugaauuuguuugcuaucuugguauuuguauucuauuugucacauauguucuuuguucuuguauuucuccuuuuuuuugcuucuuuugaaauaacaauauuuuuccucuuuucgugucuuggcuaugaagucuuuccuucuuuuuaguaguuguccuagagauuggaacauauauccuugauauauuaaguucugcuagucaucuuuugucuguaaaucccucuauuuugccuucauguucaaaggcuguuuucacuaccaguuacuuauuuuucaaugcuucaguuguugucuucuagauuucuuuuucuuuuuucuuuuaacaguugagcaauaaguagcuucucuuguugcuucuuugggauauaucuuuuuaccucuggcugcuuuaaagauuuuuuuuuucucuguuguauauucuguccuauugauugguacuccaucuauacacauguuggaucuuuucacugucccacguuucugaugccauuauuguauuuuucaacguuuuguugugguuaaucuuuguauuucagugugcuuaguuucuacuuaccuguuuauuaaaaaccuuucauccugcuaguaaaugacucucaugaauucuuaauuucaguuaugauuuuauuauuuauuuuagguuuguuuuuuuuuuuuuuuuuuuuuuuugccuguuuguuugagauggagucucgcucugucgcccaagcuggagugcaguggcgcaaucucggcucacugcaaccucccucuucuggguucaagugauucuccugccucagccucccgaguagcugggacugcgggugcgcaccaccacgccuggcuaauuuuuuucuauuuuaguagagacaggguugcaccauguugcccaggcuggucuugaacuccugagcuccagcaauccgccugccucugccucccaaaaugcuaggauuacaggcgugagccaccgcaccuggcuuauuuuaguuuuauuuaaagauuucaggucuccgcuucauuucuucaucuuuucuucuauuuucuuuagcauauuaaccauaauuacuuugaaguccccucugacaacuccaauaugugaaucaccuguguucuauuuguagugccauuuucuuuucuuaguuuuugguucuugguccuuuguuuguuuuaaaccgugccucauauugucugauagaaugugaacauugguauucaaaauuguuggggcugggcuugguggcucaugccuguaaucccagcauuuugggaggccuaggcgggcagaucacuugaggccaggaguuugagaccagccuggccaauguggcgaaaccucugucucuauuaagaaaacaaaaauuagccaggcaugguggcauacaccuguaaucccagcuacucaggaggccaaggcaccagcucugucucaaaaacaaacaaaauauccaaacaaacaaaaaaacacaauuguugucucaggaucauguuauuugccuuguaagagaguuaaguuuuauucuaguauguugguuuauuacacugauucuguuaaaguuugguuuuagauuugccuuugcuccuagcaguggcuauuuaggaucucagaguguagauauugagcagaaucuuuucaccuuaaccagucuugaaccuuuaccuauuucuuagaguauuguguuucugcugaaaucuauacucuguuccuuuguuucuuagaguguaauucugcuuuugcacaauguggauguugacaagugucuuggagagaacacugcaugcagauuuuagcucacuuucuucuguuuucuucucucagggauuuuaccccucaagucccagcuacuuuggcugcccugaaguuaaaccucugucuuuucaguacggccagauuucugcuuucuguuaggacucugcccguaagaccagggauugacauugacagaugcacccagggaacaaaugugguugaauguggagcucccugugcuucuuuuuucagggauuauucuucauugcccuuuuaacaguuguuuuauacuguaaaguauuuuuuuuuuuaaaucuucuugguuguuuuugggaagacagucagaaccucucaucucugacauggccaggaauggaauucuaaguccauuugaauuuuaauaggauugccuuagauuaauuguauucagauagaagaaaugcuuuuugaaucacagacuaucuauauauaaagcauugauuagaauaaugaacugucuaaauaaaaauuaugcuucuacauaaaagacuuucaaaacuggauaauuuaauaaauuuuacaaagaaaugucaguuuggugcuauuuguuuggacaucaauauuugaagugaauucagaauucaaauuauauuuugguaagauagaauuuuuauggauagugccuaauuuaguuuaagcccuggucaaaauugcaauuaaaugaaaacagccuugaauuauuuuuccuuuacaauuuuuauaaaaugucugaauuuuaucagagauaagugaauuuuuuuaguagacuuuuuacacuuuauguuuauuauucuuucuuuaugaauagauguagucuuguaaauuacuauacuguucuuuccuaacguuuuaaaagaaaaaauuggucuuuuaaaugacagauauuuaucccucgagauguauggguuaauuaaauaaauauaugcugguacugagaaaucauauaccaaaacaauaauauaccauauugacauugugaaaauggguuucaucuaucaguauugugauacaaaaaguuguuuaauagaauuuuaucaaugauuaauauuuuguguauuguuuaggugcauugacauacaacagagcaacgagguagagaggacacaagcacuucgauuagucagaaagguaugcucuaugugugagaguaaaaggcaaauuuaugguuuuuauguuaauauuuacauuuuuagauuagacuuuugugaaaucuuuauuaagauuaaagacuaaacuuuuauuaaacauuuuuauuaaaguuuuauauuaaauaaauucauuaaacuuugagguaaacaaauauuuuguggaauucuaugugauuggguauagguagggcaauauuucuuauaaaauguuuauuuugaagaauauuucuuccuucaguagacauguaaauguaguuacugcuuugauaaguuacuagaggaagaggauuacuugcuccccauccugauuuucucuuaauugcauacuuagaguuaauaguauuaaauggaagucacaaauacuaagaaguucauuguuuuaaaggugaauuuggauacaaucugugggcaguugcaauaaacaauucaggcccuuguacaggauaaaaggucacagccuacacuccacaagagaggguguuaaggacaauccauaaugcuucucuugagaggccuucagggaaugcuuuguuguuuuuacuugauacccuaaugguggaagaagagagugaacugagaguaaauaugguugggacacagccugagugagacaagugucagucauauuuuaucuuaauguucaugagaaucaugaaguauauguuuguuugcauaaaaaaucuaaaaauauuuuccaguugaauuuuuuaguucuuuuuuucucuuccuaucuuucaacucaguacacagguuccaaaaugguguacuguucaauuucuauguuagcuaggguucccuguuuuucccuuuucuuaaaauugucuaccuuuugguuaguaauaguaauaguacucacaggugaacaaguaaauggaugaguuaagccuuaaaagaaguuugaaauucgacuaagaaugauaccggaaauagauuaggagacucuuguuauaggcgaacuguuacacuaggauuguaauuugacuuuucaaauucagauuuuaaaaaucuaugguuuuuauuuauacaauucuuccuucuuccaugacugagaauucaagauaaaacaaaauuuguuucugaagaaccuagaacaauuuuuugguuauuuggguuauaugucaguauuuauaauguuagggacuaaaauauauauuaauauguuuaaaauaauaaacacauuaaauacaaauauaaauaacauuuuuaugaaaaccauauuuuauuuuauuuuauuuuuucaauaauuuuugggguacaggugguuuuugguuacauggauaaguuauuuaguggugauugagauuuuugugccccugucacccaagcaguguacacuguaccccguauguaaucuuuuuaucccucaccuccucccaaacuccccccaccucugguccccaaguuaauuauaucauucauaugccuuuguguccucauaguuuagcucugcuuauaagcagggaacauacaauauuugguuuuccauuucugaguuaauuugacuuagaauaauggccuccggcuccauccaaguugcuucaaaagacauuauuucaauugcuuuuauggcugaguaauauuccauaguguauaauaccacauuuucuuuauccacucauugguugaugggcacuuaggaaugacuauauuuuccaaaaaauaaaauuaaugagaagagggcuauuguuuuagaguuuugcaacucucuuuaauuuugucuugauaaacgagucaauuggauuaucauauuugcuucugcauucagucuguuuugauaacacaugcgguggagcccccggaaaacuuuaguacacacuugugagaaaauaagaguaaaaaggacaaauaaugucuuuguauugcuaugcagaaucucugaaaauaucuuaaggacccucagaauuuccuggucuacacuuugagcauaaccgcuuuagagacugcugucagaagaaaagacaauuucaaauggauucagacaauuaaauucaauuuuggauauuuuaguaaauguuuuacuucaauuuuguauuuuugcauaaguuaaaauuuaauuuaaaguaguuuuuaauugcucaaaaauaauagcauaacaaaaauaucauuucauuugauugucuucugagaugcagaguaguugacucacauaccauuugugaauccuagaacaggaaaauugcugauauuugguggugggauauagaaucagcgguagaauuguggcacagggcuuuuccuugguuuaugcuaaaaggguuagagugagagcacauuugcugaacgaacaguggccucuaucggccagagaaacuauaauuucauuagugcuuuuggcaucugaagcacuuuuuuuuuuuuuuuuuuuuuuuuuuuuuuuuuaguaaaaccuuggcagcuguacuacagguugaguauuccuuauccaaaacgcuugggaccugaaguuauuucccauuuuguauuuuuuuggguuuuggaauauuuguguauacacaguaaguuaucuugugaaugaaaccuaaaucuaaauacagaauuuauuuacauuucauauacaccuuguacacauauccugaaguuaauuuuguauaauauauauauauuuuuuugagauggagucucgcucugucacccaggcuggagugcaguggugcaaucucggcucacugcaagcuccaccucccggguucaagccauucuccugccucagccuccccaguagcugggacuacaggcacccgccaccacgcccugcuaauuuuuuauuuuauuuuauuuuuaguagagacgcgguuucaccguguuaaccaggauggucuugaucuccugaguucgugaucugcccgccuuggccucccagagugcugggauuacaggcgugagccaccgcgccuggccaauuuuguauaauauuuuuaagaauuuugugcaugaaacaaaguuuauguauauugaaccaucagaaagcaaaguugucagaugcugaauuuucuacuucuggcucaugucagucucagaaaguuuuugauuuuggagcauuuuggauuuuuggauuagggaugcucaaccugcaguauaaauuaauauuuaauauuauaauuacuauaucacugaguuuuuuuguaugaauucccaagagucuuaaaauuucuaauaaaaguaugucuauuauauuuuaaaggauaaggaaaaacauuuuuugcuuuaggauaacuuacacuaugaauaauuaaggaauucuuauguuacuuuuucucuuauuuuacccaucucauucauuuggaaauguucugucugcuuuuuucuuuuccaugucucugauuucccccuucucucucccccuuccaaugcaggcagcucuuuucuggcuuuaucucccucauuuuuaauguaauuuuuccacuagucaguuacuacuauucuuuucuuaaucuuauuuaaauucuacucgcugcccaccuaauuugagcugucauuuuuuucauauauaguuucuuuauucauguaauaaggaauuccacaaacuuuuuacauuugaaagagauucauuggcugguaucucaugcccuugauacauagcaagauaguggcaaagccagagcaagaacccucuucugcaaaauuuccaaaccuacauuggcccaugaguuugaaguucaaccugccaacuuuggccuucagagcccaguuuugguccagccaacuauuuuuaucugacaugucuuuugccaccauguguaggcaaacuacccaccacuacuaccacaauuguuacuuccuuccuacucuucauuuucagcccuucucaccuuacaucgaucuucuagucugagcucaaauauuagauauuccccuuagguaacucagugcuucucuaauuccuuugugucaguuccacaaauuuauuaccuaaucaugaucuuuaauuuguuuuauaugucugcccugucaugccagaagagauuauuaaacuuuuacaguuuuaacagugacugcauuuuauggcuucucccuuacugagcauucauugauuuaugaggaaagcauucucugauuuacacacaauuuaagaguuucuuugcauauauuuaccuggaaaauaagaagagugauuuuauuuguaaaaauuuuauguauauauuucauagcacaaucuggugaauuaaguauauguuuaguagacacaagauuuauauagaauuuuauacuugaaacuuuagaaaucaucuguucauacauaucuucauuuuacaaaugaggaaacugaggcacaagagaggauugguuuagccaagguaacauaguuuauuauagcagacuuaacucuaaaaaccauuuugccgguuuuuucagccagcucuuuacagaauauauuacaugcauuuugcuguuuggagaaauuuucucauaagcuccuuauaagaauaauaauaaucagaaaguauuaaaaaagaacuuaccgacauaagauguuagaauucuuucacccaggaagauugauuuccuauacuuccuauaccuccuuccuucucccuuucuuucucuccuuuuucaguuaauugaaaaaacugacuuagaaaugaauaugaaagcuuuuguagauucuacaguuauuggagauguauuugauuuaugcuuguagaacuguauucuguaauuucaggugaacuuuguaauaugucuuaaaaaugcuguuuaaaugacaaaccacuuacaacuacugaucaaacagaucuuucuuuugaucuucuguaagacuuaauugugugucuuucauuaguuauauuacauccucuaauuguuucaucucacaaguuuuauuuuaucaacaggacaauaaaucuaguaauaucugggucaaauuaauuuucucuaauauuuuauuacuauacaaacaaaauauuuuauuuccacuccaguaaccugcuauuuugaauuaauuugcaaaauagucuuuauuuauuaaacaguaauuagcuacauaauuuucuguuucccaaaucaaagacauauguuaccuguuuucaauauuccaaauguuacugccaguuagaucuuuaaugugagauucauacaaaauuuuauuacaauauauuuccaucaggauuuuugaaauauuaaaaauagauuuggauuaugaacucugcuuucugguauagcaacaagugauugaugggagaggugacuagagaguaaggagaucauuagauaucuauugcaguagucagagugagagugagggcccaaguuaaucaauuaauuucaugaggagaggggaguagagauaaagauguuauggaaguaaauugguaggacuuggugaugaugguauauggagaguuggucaggaucguaaaaguacaguaguauauugacuacuauuguccccucugguuuaccuugucuagguacugaaaaacuguuuaagauuuaggcccuauucuagaguaauuuaaaaucucagaaacauuuggucagugaauuuauagucuguacuguuagaaaaaaaucuaacacauuuuccauaguaauggcuauuaacauuuguuacaucaauuauuaguuauauuaaucuuuugaaauauccauaagcaaaagauuaaaauugauaccuagaucuuauucuggaucuuauucuguuauuaacuacuucagucuggacaaaauagguuuaagaaauguauuacuaaaguaacuucuuuuucugauuccuucuguuacagaugauuacugugaaugcuuccuuguuuccuaguucugugaccaacucauuaauugcaguuggaaaugauggacuucaagaaagagacagaaugguccgagcaugcauugccauuaucugugaacuaggucagaauuuucuucaaguaaugaaaauguaauauuuuagaaaggauauauaacauuugagauauauauaucuaucauauaucuaucauauauauaucauauaucucauauaucucauauaucauauaucucauauaucucauauauaucauauaucucauauaucucauauauaucauauaucucauauauaucauauaucucauauauaucauauauaugauauauaucauauauaucauaucugauauauaucauauauaugauauaucugauauauaucugauauauaucauauaucugauauaugucagauauauauaucauauaucguauauauaucauauauaucguauauaucauguauauaucauauauaucguguauauaucguguauaucguguauauaucguauauauaucguauauauaucguguauauaucguauauauguauuuuuuuaaauuauacuuuaaguucugggauacacgugcagaauguguagguuuguuacauagguauacauaugccauggugguuugcuguacgcaucaacuugucaucuacauuagguauuucuccuaaugcugucccucccccgaccccugauaggccccggugugugauguuccucucccuguguccauguguucucauuauucaacucccacuuaugagugacaacaugcaguguuuaguuuucugccccuauguuauuuugcugagaaugauagguuccagcuucauccaugucccugcaaaggacaugaacucauccuuuuuuaauggcugcauaguauuccaugguguauaugugccacauuuucuuuauccagucuaucacugaugggcauuugaggugguuccaaaccuuuuguauugugaacagugcugcaauaaacacaugugugcaugugccucuauaguacaaugaguuguaaauauacccaguaaugagauugcugggucaaaugguauuucugguucuagauacuugaggaauugccacacucuucuuccacaaugguugaacuaauuuacagucccaccaacagugugaaagcguuccuauuucuucacauccucucuaacauuuguugguuccugacuuuuuaaugaucgccauucuuacuggggugagaugguauuucauugugguuucgauuugcauuucuuuaaugaccagugguaaugagcuuuuuuucauauguuuguuggccacauaaaugucuucuuuugagaagugucuguucauauccuuugcccacuuuuugaugggguuguuuuuuucuuguaaauuuguuuaaguuccuuguagauucuggauauuagcccuuugucagauggauagauugcaaaauuuuuuucccauucuguagguugccuguugacgcugaugauaguuucuuuuacugugcagaagcccuuuaguuuaauuagaucccauuugucaauuuuggcuuuuguugccauugguuuugguguuuuagucaugaagucuuugcccaugcauguguccugagugauauugccuagguuuucuucuaaguuuuuuaugguuguaggucuuuaauccaucucaaguuaauucuuguguaagguguaagaaagggguccaguuucaguuuucugcauacggcuagccaguuuuccuaacaccauuuauuaaauagauuggaauccuuuccccguugcuuauuuuugucagguuugucaaagaucagaugguuguagauguaugauguuauuucugaggccucuguucuguucuauuggccuauguaucuguuuugguaccaguaccgugcuauuuugguuacuguagccuuguaguauaguuugaggucagguagcaugaugccuccagcuuuguucuuuuuacuuaggauugucuuggcuauauggggucuuuuuugguuccauaugaaauuuaaaguauuuuuuccaauucugugaagaaagccagugguagcuugacggggauagcuuugaaucuauaaauugcuuugggcaguauggccauuuucacgauauugauucuuccuauccaugagcauggaauguucuuccauuuguuuguguucucucuuauuuccuugagcagugguuuguaguucuccuugaagagguccuucacaucccuuguaaguuggauuccuagguguuuuauucucuuuguagcaguuguuaaugggaguucacucaugauuuggcucucugucuauuauugguguauaggaaugcuugugauuuuugcacauugauuuuguauccugagacuuuggugaaguugcuuaucagcuuaaggagauuuugcacugagacgaugggguuuucuaaggagacccaucuuacgugcaaagacacacauaagcucaaaauaaagggaugggggaauauuuaccaagcaaguggaaagcaaaagaagcauggguugcaauccuagucucugauaaaacagacuuuaagccagcaaagaucagaaaagacaaagaagggcauuacauaaugguaaagggaucaaaacaacaagaagagcuaacuauccuaaauauauaugcacccaauauaggagcacccagauucauaaagcaaguucuuagagaccuacaaagagacuuagacucccacacaauaauagugggagacuuuaacacuccacugucaauauuagaucgacgagacagaaaauuaacuaggauauucaggacuuagcucuggaccaagcagaccuaauagauaucuacagaacucuccaccccaaaucaacagaauauacauucuucucagcacuacaucacacuuacuuuaaaauugaccacauacuuggaaguaaaacacuccucagcaaaugcaaaagaacagaaaucaagacagucucucaggcuacaguucaaucaaauuaggacucaggauuaagaaacucacucaaaacugcacaacuacauggaaacugaacaaccugcuccuuaaugacuacuggguaaauaaugaaauuaaagcagaaauuaauaaguucuuugaaaccaaugggaacaaaaacacagcauaccagaaucucugggacacagcuaaagcaguguuuagagggaaauuuauagcacuaaauguucacaggagaaagcgggaaagaucuaaagucgacacccuaacauuacaauuaaaagaacuagagaagcaagagcaaacaaguucaaaagcuagcagaagacaagaaauaacugagaucaaacaagaacugaaggagauacacgaaaaacccuucaaaaaaaacgaaugaauccaggagcugguuuuuugaaaagauuaacaaaauagaccgcuagccagacuaauaaagaagaaaagagagaagaaucaaauaggugcaauaaaaaaugauaaaggggauaucaccacugaucccacagaaauacagacuguuauaagagaauacuauaaacaccucuacgcaaauaaacuagaaaaucucgaauaaauggauaaauuccuggacacauacgcccucccaagacuaaaccaagaagaagaauagaaaauaacaaguucugaaauugaggcaguaauuaauagucuaccaaccaaaaaaagcccaggaccagauggauucacagccaaauucuaccagagguacaaagaggagcugguaccacaccuucugaaaccguuccaaacaauagaaaaaguggaacuccuuccuaaucauuuuuugaggccaguaccauccugauaccaaaaccuggcagagacacaacaaaaaaagaaaauuucaggcuaauaucccugaugaaaaucgaugugaaaaucuucaauaaaauacuggcaaaccaaauccagcagcaugucaaaaagcuuauccaccacgaucaaguuggccacaucccugggaugcaaggcuaguucagcauacgcaaaucaguacacauaauccaucacauaaacagaaccaaugacaaaauccacaugauuaccucaauagaugcagaaaaggccuucaguaaaauauucaacaccccuucaugcuaaaaacucucaguaaacuauguauugauggaacguauuucaaaauaauaagagcuguuuaugacaaauccacagccaauaucauacugaaugagcaaaagcuggaagcauucccuuugaaaaccggcacaagacaaagaugcccucugucaccacuccuauucaacauaguauuagaaguucuggccaggacagucaggcaagagaaagaaauaaaggguauuaaaauaggaagagaagaaaucaaauugucucuguuugcagaugaugugauuggauauauaacauuuuugaggccuuuaaugcaugaauucuuuauuguuccaaaaaugugaaaaaguaguacauuucugguagggaaguggagaacuuguuauuuaacaaauaauuucaaugcgacauuaaaauucuauaaauuuuaaacuuuucuucaucauuaaauuuaguauaggaauugucuaaauuccaguaauauuauagaaucuacuaaagucuggcucucuaacauuaguuauucuguauguuuguauuaguucauuuucacacuauuaugaacuccuugagacuggguaauuuaugaagaaaaaagguuauuugacucacaguucugcaugacuugagaggccucaggaaacuuacaauuguggcagaaggcaauggaagugaggcaugucuuacguagcagcaggagaaagagcgaaggggaagugucacuuuuaaaccuucagauuucaugagauucacuaucacgagaacagcauggagaaaaccgccccauaauucagucaccucccaccaggucccuuccucgacacguggguccaauuugagaugagauuuggguggggacacagagccaaaccaaaucauucuugauguggguuaaaaacaguaaacaauccauuaugccuaaaaauaauaaacucuaggccaggugugguggcucacaucuguaaucccagcacuuugggaggccgggggcaggcggaucaccugaggucaggaguucgagacuagccugaccaauauggugaaacccugucucuacuaaaaauacaaaaauuagccaggcaugguggcaugcgccuguaaucccagcuacucgggaggcugaagcaggagaaucgcuuggaccugguaggcggagguugcagugagccgagauugcgccacugcauuccagccugggugacagugcgagacuccgucucaaaaaaaaaaaaaauagaauuguaggugcaaaggcaugaaagggcuaaacagggaaaaaacuggggccaguggggaacauggaugaauauuuaucugaucauuggaaggaaaaggaguuuugaguuaucaaaagaaaucacacagggauuuuggcagcuauagauauuacuauaaggagucacaaaaacaagcagugccagaacaauccaauaaaaagguaaauguaacaaguaaaauaaguaauuuauuuauauacaaaccaauaggaaaacaaauacaguuggccuuucauauccacagcuuccacaucuguggauugaaccauccgcaguucuaaaacauuuagagaaaaaaaaaauuuuaaauacaguauaaccauuuacauaggguuuacauuguaggguauuguaaguaaucuagaggugauuuaaagcauaugagaggaugugcauagguuauauguaaauacuaugccauuuuauauaaaggacuugagcaucugagaauuuugguaucaucggggguccuagaaccauuucccuguggauacagagugauggcuguaauucucaaagaaaugcauggcuaagcaacauauuuuaggcugggcaugguggcucacgccuguaaucccagcacuuugggaggccgaggcggguggaucacgaggucaagagaucgagaccauccuggccaaccaacauggagaaaccccgucucuacuaaaaaacaaacaaaaaaaagguacgcauauagucccagcuacuugggaggcugaggcaggagaaucgcuugaacccgggaggcggagguugcagugagccgagaucucgccacugcacuccagcuggggugauagagcgagagucuguaucaaaacaccaccaccaccaacaacaacaacauauuuuaaaaguucaaccucacuuauuaucaaagaaauauaauuuuaagucacaagaaaagauguuuuuuugccaccugaaguaggaaugguguugguuacauuccuucuugaggugauaaaugauaacaaaaguuuaagcuaaaaaaaaagagaaccaaaaccuaccauugaggauuuuuuaaaaagaccacaauacuuguugauuuaaagacagagucagaacugugauuagggaaauuuaaaaaauauguaguaaaacuugacugugcaccagucuguaggacugccuggaugccuagaaagcuauacucaaagauaauuuuucauuagaaagcucauuauaauuaagcaaaaaauaagugagugaaccaguauaacucaagaaauaccaaaagaagaaaaaaaauccauuucauguuaagcagauggagaaaaaccaguaaaagucuuaauuauugaacaagauagauuauguaaucuaaauuguuaauuggaagaagaaacuaaaauccacaaauguuuggaaaacucaaagauuugaaauacaaaagauuaauaaauaaaugaagagaauaguuuuuauguuauucggaaacuuaauaauaugaauggauuuucaggauaaauuuuaauuuccagucacucacaaauuguaaaauacaaauaguucaaaagcuauagaaguauuugaaaacauugauaaaauaauugcuccaaaaaaacucauccagguacuuuuguuuuaaaaaaaaaaacagguaauucuuacguaguguuaucugauuuagagcauuaaaaagauacagauuucuuucuuuuguuuuguuuuguuuuuguuuuugagauggagucucacucugccaccaggcuggaguguaguggcgcaaucucaggcucacugcaaccuccgccuccuggguucaggcaauucuccugccucagccucccaaguagcugggacuacaggcacgcaccaccaugcccagcuaauuuuuuuuuguauuuucaguagagaugggguuucaccauguuggccaggaugucucgaucucuugaccucgugauccacccgccucagccucccaaagugcugggauuacaggccugagccaccgugccuggccaaaccuacaaauuucuuauuauguaacuagcauuuuauguacauguacacagauacacauaugccuagauacauagauaauuagaaggcuccuuuguuaacauucaagaauauuuaucucaaaucaacaaucaaugcuauucuuaauggugaauuucuacagauaccacauccuuguaacuauuaauuagcauuauuuuaaaacuuuuagccagguuauuagccaaaauaaaauauguuuauauauuggaaaggagacaguguuacuuuguagaugguaucuuauauauagaaaaacucugaagcgaaaaccaacuuaauuuuagguaguaggacuaugugaaaacacagauuugacagauuuuuguguuucaacaauaaucaguaauuagaaaaagcaauacuauuuuaaaguagaaaagaaaauauauaagacaaauuuuauaagaacuguguaugacuuguguguguguuugggaaguacuuuugaauuugucaaauugguucuuaagaagacacaacuaaucuauaaggguagaaaugagaacaguggcugccugugcaauggaggaggacucauuggaaaguaaugugagagaucuuucuaggauaaugagaguucuguguguugagugggacauuguucauaguuuauugaacuauaccauuaagaucugugauuuuacuaaauguaauuaugccucauuuuagaaaauagaagaaaagaaacuugauucuaaaauuuucuggaagaauaaacaguaaagaaccaaccaugaaaacauuuuugaaaaagaguaaaaauaaacauuuuugaaagagaauauauuuauauguauauguauguauaaacuguuaacuguuuauauauauauauguauguguauauauauguauauauauauguguguauguauguauaauuuuaaacuguuaaccuagguuguuaagggagagaaaaaugaaagagaaucaagaguugcugacccugauaaacagaaaacuuuaauguaucauaaaguacaaaaacuaguuugggaagcaucccaggauaauugauucaacauuuggaagggggaaaauugaguuuaucaucuuaacaaaacucagcuuccuaacagauugaaaaccgaaguguaacuaauucaugaacucuuuuaaaacacauauguacacaugcacguaugcaaauaaaugccugaucuuuggagcaagaaauuuuugagcuuaaaauuauuaaacuguguguucuauguguguguuuaauaaaaauauagagaaaugaaauacaccauuuuaaucaaaaucugaaguuaaaucacaaaugaaagauuugagacagauaaauggcuaauaucccuacuuuauaaagaacucccugcaacugauaggaaaaaaagccauuccguuauuauauggacaaaggguaugaaaagacaauccaaagauauuuuaaauaucagguuguggggaaguauauucagugacucuuacauuuuccacuuguccuuuuaucuaccuguucuuauaaauguugguauuagaaaguuuuucaagucagaaaggcaauuaaguuuuaaagccuagauuuuuuauuacuuuuaauaauuaccccaaauauaauauguuaaguuuuucucuuuuagcacuucagaauccagaggugguggcccuucgagguggacuaaacaccaucuugaaaaaugugaucgauugccaauuaagucgaauaaaugaggcccuaauuacuacaauuuugcaccuucuuaaucauccaaagacucgacaguaugugcgagcugauguagaauuagagguaggaacuuuaauauucuuuucuaguuuuaaaauauuauuauaaauguauacuuuuacuuugaaauacuaaauuuuauagaugcagcaccacauuaauuaucaagccuaaauuagccgacacuaauuuauucccagcucuguuuuacagaucauucaguuuggacugaauugaaaacauuacucuuaagaauauuucaucaauguguaaauuuuauuuuuguauuaucuaugaaaaguuuaugaaccaaauuagaguacaaauaaaguuauguaacaaauuuaccuauuuaagauuaccauuuguuuuuaaggccuuuaguacauugugugugaauagcuccugcuaauuauacaauauuuaugaaaccuaaaauuaucugaaguuggaagcacuuuguuagcaacuaauuauaucuacuugaaagaaagcauguauguauauuuuguaaauaccucuuaaauuuuuuacugauucaaguaagguuuauuacaguuagucaaaaguaacagggcuacuguauaccuuauaagaaaguaugucguggagguuggaacagaauuaugcacuguauuauaguuucuucgugugcauguauugcauuguuguccuuugaauauaguauuuggagucagcuuaaaucaaggauuuguuuguauuuagguaugaaaucaugugugauauaaaagauugauuguccccuaauuuguuuuuccaaaucauuuuuugaaacuuaaguguucuguuuuuaucaggacuauuuuuaaaaaugcuucacauuauaaaauugacauuagccuauauuauuaacuaacaauguuaguauaauaguccuaauaagugauuucaaguauauuauuuauuggaauccugugggaauaaacuggcacuguugauauuuuauaauauguuuagcuuuaauuuuuuuucuuaucaaguaagaaaacuguaauuuuaaaauuggagagaugaauaaaagauaauauguauaggcucuguguuuugcuuuuuguuuuguuuugagauggggucucacucuguugcccaggcuuaaguguaguggcacaaucacaucucacugcagccuggaccucccgcacucaaucgauccuuccaugucaaccuccugaguagcugggacuauaguuacaugccaccacaccuggcuaauuuuuguauuuuuuguagagacggggcuuugccauguugcucaggcuggucuugaacuccuggagcucaugcaguccacccacuucagccucccaaacugcugggcuuacagguaugagccacuaugcccagccagcugaguuuuuauuccuauauaucacacaguggauuagcaaagccuuuauguaaaugaaacaaaccucaaacacaggaaaaccagaggccuacuuagucuuaucaaaauugcauuguagccucaauuuaacuuaguuggacguuagaauaaggugaucaguccccuuaaucuaccugucuagcagaggaaagaauaagccaucucuagugggagauaacaucacuuggagucuuuuauaaagugcacaaugccugacauucaguuggaaauuagucacguaaaaagacaugacuguaugacugaaaacccaaaagaaaaaaaacaauccauagaaacaugcuugcaggugauucagauagaggaaaaagacauuaaaacaaccccgauuaauuuguucaagaagagaaauaaaauagaugaaauaauggagaauuuuaucauauaauuggauaugugaaaaaaaucaaauggaaauuccaguacugaaaauacgauaucuggaauucagagcacaaugaaauuaaaauucaguuugaacaggaagauguuauuaguaaacugaaagagaagucaauaaaaauauccaaggguaaaacaaaaauaauguuaauacacacaguaaagcacagagaaaaaagaaauaaauugaacagcacaaaagggauaaaacguaauugcagucuuuggagagaaaaaauuggcagaagcaaagauccaaagagaaaguggccaaaacuuuguuucuaaaacugauaaagcuucauguuguaaagcucagaaaacaaacaagauaauacauagggaggaacugagcccucuugccaauaaucagcaccuugugaaugacacuuguugacgcagauccucuagcuccagucagaccuucagaugacuacaggcuuggcuagcacuuggacugaaaucuuaugagacuuugagccauaaccauguagccaagccucuccuagacucuuaagucauugaaacuguauaaauuaauaaauaugauuuguuguuaaaaggagacauaaagacuaaagggaauccucaguuaaaaggaaaaugaccuaaaacaaagaaaugcaggaaggaaugaagagcaccagaaaaaguaaauauaugacuagauuuaaaagaaucaugacuguuaaaaguaguuauuaaucucuuauguuuuaaauuauauuuagaacuaaaauucauguccacaguaaugccguagacaagaugggaagguuguuaauaaaauauaguaguucuaaaguagccgguaaucccagcuacucuggaggcuaaggcgggaggauugcuugagccuaggaguucaagguugcaguaagcugugaucacaccacucacuacaccuuagucugcacaguagaguaagaucuugucucuuaaguacuaaaguaaugaguuauuuuagcaagguugcugaauacaaacaacaccacacaaaaauaacuuggauuuucuuuauaccagcaacaaaaggaacgugcaguucauuaauagaacuauuuaaauuuucaaacacaggcaaaacuaaucauagugucagaagucaagacgguuaucuugggauagauacugauugugacuacaaagguauaauagagcuuugaggaugccuauaauguuuuaucuugugcuaguuacaugagugugcuuaguuugagaaaaucacuguuuuagauacauguuaaaccucaauuuaaaaguucagaacuucaauuuguacauuaaaaaaaaucaccaaacauauucccugaugaugaguuagaagaaauaagucccccaagcaguaaacccauuaaagauagagagaaauggaauguuacauuccauaaaaugcaggaaggaugcauuuuaaaauaaagacucuuuucuuccuuuuuuuuuuuaaauagagaauuuuagcacccuauacugauuuucacuacagacauaguccagauacagcugaaggacagcucaaguaaguaacauugguuccuaauaauuuuuaagauaauguauauguuaauacuaaagcuuuuagguuugcgugauuccauguacagccagagaaaugugaguuuaaauaaauuuucuauuuuauagaauuaguugcauuucucucauaauuuacugugguuuaaaaaauuuaaagcuuugagaaauuuaaagauuaauuucuuauuuccaaaaauauaugguagacugugacagaaaccaaggucauuguuuuuguaauguauauauuuuagcauaauuacauuuaaaaaaccaaaagaaugaaauaacaguagauaguagaaugaagagugaccuuaacuuacugagucagcagaaugauguaauauguagaauucugagaauaaguuuaauacagaaauaaaugagaauagaguaaauauuauuaucuagaaaugagacaguauaauuuucaggguguuuuuggagagaaaggcacauguucacuagguauuuggagauaacuuuaacauaauuuagggaucaaauaaagcacucuguaaagauuuugcaaaugacacaauuccauuaaauacgcuaucuaguguuuuuucugguagacuuuauugcacugcaaugaguuuaauguagacauaaacuuacugugauacauaguauacauugccagggaaauguuuuuauuguuuuucauuuuuccccugaguuaaaaauagugauuccuguaauccuagcacuuugggaggccgaggcggguggaccgccugaggucaggaguuugagaccagccugaccaaucuggugaaaccccgucucuacuaaaaauacaaaaaaaauuagcugggcauggguauucccagcuacuccagaggcugaggcaggagaauugcuugaaccugggaggcggaguuugcauugagcugagaucacaccacugcacuauccugggugacagagcgacacucugucucaaaaaaaaaaaaaaaaaaaaaaagugguuucauaccuucagucacauccaucauugugaacucauucucacccuaacauaccaugaucuacuuugagcuaagagaucaaaguagauguccucuaagacuucucaaacuuauuccugcaaacuucaguuaugaaucggaauuuguaaggcccuuucuuggcuucuuuugaaauauagacauucucuuauuguggagaguguaugaguuuucuguugcugcacaccaaauaacaauaagcaugauggcuuaaaacaauaccaguuuauuagaucacaguuugauaggucagaagucuggcucaggucuugccuggaggcucuggugaagaauccacuuccaaggucauucagauuguugagaaaauuuaguuucuugcuacuguacaacugcuaugccuuuuucuuuacuggcugucagcuggggccuacuuucaccuucuagaggccucccacauuccucagcacauggucuucucccucugcaaaggcaacaaugcuggaaucuuucuacugcuuucagccucucugacuuuuucuuuggcuaccagcuagagaaagcucucuaauuagaucaagccugcuauaugcuguauacucuuucuuaugcucugcuagacaauauaacauaaacauagucacagucauagcgcugauaccucaccauguucacaggacccagagaucaggucauggaaucuugggauagggccauauauagaauucugcauaugaugauggacaacaggugaaccuagauauuucuuagaauugggaggguggggcuauuccaucagaaucuuuccuauuugguucuguacuuucuucuaaguuucuggaguauaagcagguagauaucaggccuguaaauaaggguauauuaugaccagggaacagggaaaugacugauuuuuaaaauauuacaaguuuaauagguuagagauggauuaccaaacagucaauguaugucaccaacuuuuuuaagagaaagcacugaaagcuuaaucacacaggugucugauucucccuucuuccaagccacccccgcccccauuuucauuucuguuauuuucucauuuuagcuggugcugcauagcuuagucuuuuucuuugagcuuuucaauccacuuuuguagacuaauugcucacucauaucuaauuugauauucugucauugcuguuuauuccuucuacuuuuuguugcuguuuuucccaguucugugauuuuuuuguaugcucacaaccauuaaaaauuuaaguaggaaagauuaaaaaaaaaagguggcacaggaaaaaagggacaaucgacaggguagacauggugguuggagugacauaaagagacacaaaauugcuauuaaguauugaaacuggccauaagccaaccaugaaaaauguuuaauagauauaaaaaauucaguugcuuaauugucauaacuauuguagaggagggaauaauggaaacaguuggguacauaauugucaaggaagaaaguagcuggugauguuaauauguaguuauuucauaacauuucagugacuauauagguuguugaacuugcuuguuggaaacguucaaauaaguuuagagcaaagauugugaaguaaacagugugugugauuaaaauuaagagguuuuugugauaauuuucuuugcuaaggggcagccuaguaccacagaugcuuauuaagcagacuuaaugcuuaauuaaaucuuaucuaagaauaguuuucagggagcaggaauauagaacugaguagaaaagcagaauuuaugacuuaaacgauguugugaguuuaaguuugaagucaguuuauaauuggcuaauuugcuuuaguguagaucugaucuuugucuuguuuuaauuuuauguguaaauguuuaaacauuagugauagcucuuauugugauuuaguagcaggaaaaaacucauuuuaacauuuuauuucauugauucuccccgcugccuccccacccccaacagagaagacagagaagcacgauuucuagccaguaaaaugggaaucauagcaacauuccgaucaugggcagguagguuacucuacauugcuuuauaacauccaagaagaaaaacuagacugcuuuuucaaauguuaaauuauuauuguagcaccuaauucagaugcuaaucuagucuuacuuuguauauuauuauuagaaccaaaggaacucguacaaaauuauuaaaauauggugaaggaaauuuguaauagucaauaggaauuagcuaauauuaugaucaguauacacauauuuauuauuugccagucacugugcuaaugauuaccugggcaauuaaaaaaauuuaagcaugaucuuuaccaaaaaaaccuacaaaacuugaguguuagcuguguauguaacuaaaguuuguuacuuaaaguacaguguagugucauagauacaaaauaagcaagauaggccauuaauaguuccaaauuucuugagaauagggauugugcauguuuuaucuuuccauggaauaaaaaguaaguauuguuuuuaaaauaauaccaccauuaaauguguuguuaauaacauugggguuuugccauuaagaguaauugagaguaauggcaaaaaccgcaauuacuuuuguacccaauguauuaaugauuaucuucuuccuucuugauuuaguauuauugugaagggguagcauggaaaagaaguagcaauaagcaaaaaaaggaaauucaccuaaacauuucuguguaccuagguaacccuaacuuaaaaauaccuuuuccauacaaauguuuacuccagccauuuguaugggaaggccacuuggccccuaaccaguauguuuccagggauuuucucugaucucuuagcagcuugguaaaaagcucugccuugcuauaccucauaaauaccuauuuuccuuaugcugauggacaaccauaggauucuaugaugacucaacagucauacauacuuuuuuuaaauacuucaucagcuccccaguacuuuguuuucuguaguuacagucaucuuccuuuaccacuccucaucuuccuugucauuagagcuguuuguaucuuaccaaaaaaauuaauucuauccugcauccuagcuacuaucuccuuauucuuccuacguccagacucuacgcuuccuguaaugaugucuguuucugccagucuuuccuuauugcucuuaaacauuuuuuuuuacuguguuucaauuuccccuggagcccuuuuauaaugauucaucauuagaaacuuagagggguggggcugggugcagucgcucaugcuaagguggguggaucaccugaggucaaggguucaagaccagccuggccaacauggugaagcccuguaucuacuaaaaauacaaaaauuagccaggugugguggcgggcaccuguaaucccagcuacucgggaggcugcagcaggagaauugcuugaacccaggaggcggagguugcagugagccaagaucgcaccacuacacuccagccugggugauagagcgagacucugucucaaaaaaaaagaaagaaacuuagaggggugggagucuucuaccuuucuauugaaguaagaagagaaauaucagcauuauaaguuaaaaccuugaaagcauuugucucguggaaauaacuuccuaaauaauauuuauauucuguaguacuguuuauaaguuaaauaaacuuuuguguacuuguaacauuauuucugugauguauuuccaguuccaaauaacugauugaaaaaugaucuuuuagaacacauuuuuuaaugaggugcaacagccuguuuuccauauuagcacagaguaugaucuuuugagacuauaucuuaucuguaauuucucaaacuacucucagacaucaaaauuugcgaaauaguauuuugauacuuuaagcaaauaagcuuaccuaguauguuucgauuugaauuuugauccugaaucuaaagagaacauagagacuguucauaaauaucuguacgcuuagcuggaaguacagggaacuuuggaguccuauaagacauuuuaaagaauguuuucccuaacaugucauaaaaaauuugaaacauacagaaaaauugaaaaaacuauacagugaacacccauauacuuccaccuagauuuuacuguauuugcuguauuauauaucuguccaucccacugggcguucaucaguccaucuauguuauucuaauauaucuuaaaggaaguugcagacauaguccucuucacuccugaacacugcagcaugcacauuauuaacuagaacuagaugucuguuuaugguccugauuuguugucggggggagagauuugagguaaaauuuacauacagugaaaugcacacaucauuagucuacuguuugaugcguuuugacaaaugcuuacaccuuuguaauucaaacccuuuucaauauauagaacauuaucauugccccagaaaguucucuuauacucuuuccuagucaguuuuugacuccguacuccuaagaaggaaccaccauuauuuuuguggcuuaguuuugccuauucugaaacuuaauauuaguggaaucauacugauaaggcuuuuuuuuguaaggcuucuuucacuugacagaaugauuuugauacucauuuauguuauuguauauaucaguaauauguucuucuuuuuuauaauauuucaugcaaugaacauuucaguuuuuguuguucuuuuuuuuuuuuuugcccuucuguuacuagauuugacuauucaaagcuccuuuaucaaagauaaagcuucuuugagcaauuccauacaaacuuuuuuuguggacaugaguuuucauuucucuugcguaaauaccuaaauggaauugcugggucugagauuggauguauguuuguguccaugagaaacugccagacuuuuucccaaaauacuuacacuauuuuauacucccaucaucagcauaugugacucccaguuguucugcauccuugucaguauuugguguugugagucuuuaauuuuagccauucuaguagguauauuuugauuucuuguuauuaauauaguuugcauuucccugaugacuaaugauauugagcacuuuguguguguuuauuggcuauucauacgucuuuugugacaugauuuuaauauguuuaaaauuguucaacuuaguucuguaacuuaaaaauuuugaaucauauaauuuauuugaagucuauuacuuauacucaugugcauucaguauauuuuagaauugaacuuuaauaaaugccaaguagaguuuuucacuuuaaagugaggaguauaaaagaggggagacagaccauugucugauuuuucucccguguucuuacucccagagaagaguucaucaggcagucagacucaugaacuuucuggguauuaaacagauacugaagauggaauuuaaaugacgaaauuauugguaaucucuaaucaauagagaaauacagaguaugcuucaaauauauuucaguuauauaauaguucuuaugaugaccaaauaguaucauaaucauauaauuuugccuagaaaaauaugacaaguuuuauauuauacauugccauagaaauuuuuuugaaauucaugucagugauuuuuuuuucuuucuguccucuuuagguauuauuaauuuauguaaaccuggaaauucugggauccagucucuaauaggaguacuuugcauaccaaauauggaaauaaggguagguaaaaguuauuaggauuguuucauuccuggaccuuuaacagugggaauuaauuauaaaaaaaaaauuauuucaggugauguguuuuccucauuaguuguuaaucuagaucauauuuuuaaaauacagaaguaaauauuuacuacuuaguuaaacccuaaauauaauaggaaucauuuaaaauauugcuguugucugggcacgguggcucaugcguguaaucccagaacuuugggaggccgaaguggguggaucacgaggucaggaguucaagaccagccugaccaacauggugaaaccccaucucuacuuaaaaaaaaaaaaaauacaaaaauuagcugggcaugguggcacacgccuguaaucccagcuacucaggaggcugaggcaggagaaucgcuugaacccaggaggcagagguugcagugagcugagauagcgccauugcacuccagccugggugacagagcgagacuccaucucaaaaaaaaaaaaaaaauugcuguuguuaggaauaauggcuguauuaaaaauugaguugaggccggacaugguggcucacgccuguaaucccagcacuuugggaggccaaggcagguagguggaucaccugaggucaggaguucgagaccagccuccucaauauggugaaaccccgucucuacuaaaaauacaaaaaguuagccaggcaccuguaaucccagcuacuuagguggugggcaccuguaaucccaaguacucaggaugcugaggcaggagaaucacuuaaaccugggagguggagguugcagugagccaagaucgcaccauugcacuccagccugggcaacaagagugaaacuccaucucaaaaaaacaaaaaaaaguugaguugaaaauaugaacuuuauuaugcuuuauucauuaaaacaauauaaacaacacacaagggcauucucacuauaaaagguucaagcacuacagacuacguuuaacaaaagguaaauguauuuaugccuucuaacuuauguuuuguaauauguggugagauuuuauuuuaacgauggugguuuugauuaaaauggaauuguuaauauuucuauauuuauuagguauauuucuaaauuauuuguaagaauuuguauuauacaguuaaaucgaauuugaaggaaaagagaauucuuaaagugauuuuuuuccuuucuccuuaaauguuuuuauuuguuuuaauuuuguuucuuucuuuugcccuuccuuauaugaaccaaaccuggaggugaaaaauauuauuagaaaauauuagccaggugugccuuguuuaaaugugaaauaaaaaguauuuagauaauggaaauggaaggauauaauuauaaauggaaagaucuguaagcagguaacaaacuugagauaauucacuucuuacuguaauagguggaaaaagaacauggucuuuggagagucugaccaacuggaguuuaaccucugguuuuauuuacuuuuuuguuagcuccaugaccuugggacaauugcuuuuuugcacaauuagguuaaugaaaaauuuaaugacuagauuaagugauguauguaguaguaagcauuuaguuaucccuucucuaauauaggccuuauacaguuucaaaauaugguauaaucaugcauugguuaaugauaggaauguguucuaagaaacucacuguuagaugauuucauccugugaacaucccagaguacuuacacagaccuagaugguacagccuacuacacaccuagguuaugugguauagccuguugcuucuaagcuacaaaccuguauagcauguuacuguacugaguacuguaggcaguuguaacacaauggaauucguguaucuaaacaucuaaacauagaaaagguacaauaaaaauacaguauaaaagauuaaaaauacuggccgggcacaguggcucacaccuguaauugcagcauuuugggaggccgaggcgggcggaucaugagaucaggagaucgagaccauccuggcuaacacggugaagccugucucuacuaaaaauagaaaaaacagccgggcaugguggcaggcaccuguagucccagcuacucgggaggcugaggcaggagaauggugugaacccgggaggcggagcuugcagugagccgagaucacgccacugcacuucagccugggccacagagcgagacuccaucucaaaaaaaaaaaaaaaaaaaauuaaaaauacagcaccuauauaggcuacuuacagugcauggagcuuaugggacuaauaguagcucuggaugagucaaugugugagaagugagugaauguuaagaccuaggacaugacuguacacuacuguagacuuuacagacuuguauacuuaggcuacauuuaauuuauuaaaauucuuuucuucaaaaauaauuagcuuacuguaaccuuuuuaguuuauaauuuucaaauuuuuuaaacuuuugacucuuuugcaauaauauuuagcuuaaaacacaaacacauuguauagguguucaaaauuuuuuugguuuuauauccuuauucuauaagauuuuucuguuuuuaaauuuuuuuacuuuuuaaacuuuuuuguuaaaaacaaaaacacaggccaggugcgguggcucacaccuguaaucccagcacuuugggaggccaaggcgggcagaucaccugaggucaggaguucgagaccagccuggccaacauggugaaacccccaucgcuacugaaaauacaaaaauuagccgggcgugguggcaggugccuauaaucccagcuacucaggaggcuggcggcaggagaauugcuugaacccgggagguggagguuacagugagccgagauugugccacugcccuccagccugggagaugagcgagacugccucaaaaaaaaaaaaaaaaaaaaaaaaacuccucccccgccaaacacacacuagccuaggccuauacaggguuaggaucaucaguaucacugucuuccaccuccauaccuuguaugucuggaaugucuccaggggcaguauacuggaaugucuccaggggcaguauacaugaaugaagcugucaugugauaaccaugucuuguuauggaauaccuaccugaggcuguuuuacaguuaacuuuuuuuuuuuuuuuuuaagaggcagggucuugcugucacccaggcuagagugcaguggaaugaucauagcucacugcauccucgaacuccucgacucaagugauccucuugccccagccucccgaguagcuaggacuacaggaacgugccaccacacccagugaauuuuuaaauuuuuuguagagaugggguuucacuauguuccuagucucaaaauucuggccucaagcaguccucccaccuuggcuucccaaagggcuuuuuuuuuuuuuguuuuguuuuuuaaaguauagaaguacacucuaagauaaugguaaaagguauaguauaguaaauauguaaaccaguaacauagucauuuauuaucauuaucagguauuauguaauuuuacauaauuccauauauaaugcuuuuaaacaacuggcagugcaguggguuuguuuacuccagcaucaccacaaacaguucaguaauauugcccugugacagacaauaugacugcugcuacaguuucacuaggcgauaggaauuuuucagcuucaucauaaucuuagggaacgaccaucguauauaugguccaucauugacuaaaauauuguuaugugacaugucauuguauuaauaguucuguuuuuaucauuuuaaaaaaugugaauaggacauuuaaaaaucuuaaaaguguuucauaaaaauaaaugagguguauuuguuugcuaauuuagcgaggucuacuugaagugcuuuaugauauauuucgucuuccucuaccuguugugacugaggaguucauagaagcacuacucaguguagguaaguauugaaguacauuuguaucuuuucauauauuguaauuuuuauuuaauggagacaguuccuaaaaggagaaauacuaaauuauugaacacuauuuucuuuucuugcugcauaauugugacaggaaauuaauauaaaaauaaaaccucaaguuccuaagacugagaaauuuuaauuucuucuuuaucaccuuggcucuaagagcaauuaaauuaauaggaaugggccaaaaaaggaagagaggagacaguaagaaaccuauguaauccucagauuaucuaauucucaucuuauuugagccaaaugacuuaaaguaccgaagucccaaaaugaagaaaauuagaucugcguguauuuacauaacuaauuuuugucuguaucuuuuugaauguaugguauuuaaccagcacuuuuuaaaguucuuuauagccuggcuagcugaugguuuuauacuuaucugaaauguuucagugauaucuaaucuuuucccuaccauauuuuaacuaauuuagauccagggagguuccaagacaguuggaggcuuucagauggcuuuguggcagcugaggcaaaaacuauucuuccucaucgugccagauccagguagaauuuaaaauaaaaaggguuucaauuuauuagaauucggguuuuuauguuagacuguguaaucuaugaaacuuuauuuaaauuguuucugugcuguuuuuuccaggccagaccucauggauaauuauuuggcacugauacucucugcauuuauucguaauggacuuuuagagguaagacuuauaaaccuuauuuuauuccauuuuguuuauuuucucuaacagauucuuucaugccagguguggugacucacgccuguaaucccaacacuuugagaagccaaggcaggcggaucacuucaggccaggaguucgagaccagccugaccaacauggugaaacugugucucaacuaaaaauacaaaaauuagccaugcaugauggcauaccccuguagucccagcuacucaggaggcugacacacgagaauugcuugaacccggaaggcagagguuauacugagcugagaucuugccguugcauuccagccugggcaacagagcaagccucuugucuuaaaaaaaaaaaaaaaauuuugaaaaauaaaucugaugcauaaauguuuucauauguauuauuuugcaacagugguguuaucuuuuuauuuucaaagggucuaguugaagugauaacaaacagugaugaucauaucucaguuagagcuaccauccuuuuaggagagcuuuuacauaugguaaguuuagcaacuucugauuauauguuucauaccuuuaauguuugaauuuauaaaacaaguuauuuuaauaguguugcuuuguauuaucucaaaaauaaauuugcauuucuuauaaauguuuaucuuugcauuagaaaaagcccuugguacuguauccugagauagauauguacgugcgcgcaugcgcaugcacaugcauauuuugauugguuuuguaaauggaauaaauauacaacaugcaaaguacugaaauguugauuuuuacacucacuuucaaaguugacauuuucguccuguaaaucuuaauugaucucagaaagacuuccuaagaagcaagaaauugcaaaacuauggauacuacuucagucugcuaagaauguacuugauacaugguagucagugccugaauuuuagaaagcuuugugcagaagcuuuaaauguagucuugguugaacauuauagucuuuucuauaaacuuguaguuugagguucagaagauggguuuuuuuuguuuuguuuuguuuuuuuuguuuuucuuuucaccaugauuuugugauuacaguaacuuuuggaaaguaggagcuaggaaagugauuugacaauucuuacugucagcaaaucaaucaaugagggaucccugauaguuugcaagguaggaauuuauauuuuuagauuacuuacuaguuaguaaauacaaaauaaaaagaaccauuuaaaacucauuaaggaagaauugauucuauggcaaaucuuuugaaauuaugucacaguuugcuauuuuuagcagauguuuuuuguuuagguuuuucuuucuugaucucuuccccuccuccccacccuuguuuucccuucauagcaacugggcuaugugagugagguaaagagcauuaagcagaauuuaauuuaacuuucuuuuuuuaaaucagugaauuauuuagcugcuugcucuguucuuuuuuggcccaucugugaaagaauuauauagagucagaggcuuucaggucugauuauuugucuuuuaauucuuaaaagauaccauuuccuguucaagaauaccaauauucagaguuauuugcuuuuauaugaaggaaucucuauacauuuuaucuuuuucccuugucccauaccuagaauucuauaauuuucuugaaauaaaagagcugguuauuuugcuuauuauucuuacauuuucuaucuuccacauuugaucgauguacuugucuucauugauagcugguuggguggugagguuuuuguuuggaaaguagaaauuaauauuucuuauuuuaaagauuauggcauaugggacacaucuauuuugagaaaguaguuuuuaaaacuuaagaagucaacucauaaauuuggauauggcaucuagcauuuuaaauguuauuuuaaacauaacuuagguugauuccuguaauguuuugacauauaaucccuucuggcauuuaagaauugaguuuaacuggguaccacuuaaaaccauaauauuauaauaaagaaucuaugaaacuuaaugguuauguuaauauguguguaucuuuauauuccauccuuguugaaaguauuauagauaugauaaaaauauaaauaagcauguauuggggaaaauaaguuaauuuuaugaguaaaaccucagaauuuguaauagucuugaauacagcauuauaugugcagguaaucugugacauaaacucuuucuacuucugaaaacucauguaaaauguuaugcuucauuuuaggcaaacacaauucuuccucauucacauagccaucauuuacacugcuugccaacccuaaugaauauggcugcauccuuugauauccccaaggaaaagagacuguaaguaucagagcuuuagcaaagcuuuuguuugauauauuuaauaucaaauuagauuauugucucuucuuuuuaaaaaaaauaguauggauagguuauggugggaaauucuuuuaaggaauuugcuaaaggaaaaauuaauaguucuaaaaauauuuaauaauuugucuuuuaggcugcaaaauacuaauaguguaauaaaaucacuuuuuucuagcauguuuguagacaaggacauagaaugguuaucauauuacuaaaaauguuagcugagagguuuuuggacuccuuuaugucaugagcagcaauucuggcucuuuuuuuuaugucuaugaacuauuucaaauaaagcuuuacaguauuaauauauucuuuuauuugcgugguuaaaaauguugcaauuuaguaacaaguacuacugggccacauagcaauaagcugaacuccugcuacuaaaggagauacugcaaacauagaauuuacgaacaaaauuaugguaauacaauuguagcucugcuggaauuccagugcuaauaauaaaauauauauaaaagguaaugauggaaggguucaauugggaagugcuagaaggaacuuaguuugacuuggcaaagauuauaucuacgcuaggaaugucuuuuugugguuguuuuuuuauuuuguuauuaugaucaaaaacauacauggacgauuuuauuuuuuugcuugauguuagugaaauggaguuuuuuagcuauucaaaacuauguauuuuuguuaagaguuauaguacauuuuugaaaaguuuacuuagcuuuaauaauaaaguacgcuuaauaaucuguuaauuuucauucugccuuuggaaauacuguuuaacagaccaaaguugucuuauaaacugagggcauuaggaguuaucucaguucugucucuaggcuuacaucaguaauaguagcuuuuagcuuuuauauuaguaguuucaugauggaagaauguacuuucccaauaccugauagaccuaaacucuggguuagauuauggccacaaauuccaggguuuaucaggaauucaaauuuaucuucagaauuccaguaagaauaguccucuuaaaauaguuuuaucuuuagcucaguaagcuuucuuuauugauaaauacuugccagucagcacaucccaauauuuaaaaauuccacuuacuagaaauucugaaggugagacuugcuaccaaauucuugaaaguggcacuuguauuuaccacaaagaauuaaauauaauuuauaaaaauauaccauuuacaguuacagaccaauguggaaaauagagacuguucaguugauacugggaucauugauuauccauaugggaguacagugaaauuauuucaaccucauaucauaaacaaaaauaaguuucaggcggauuaaggauuuauacgugaaaagcaaagcuuuaaaauuucgauaagaaaauauagaaaacuagguuucugaccuuguaguucuuaaaaccaauauacaaaaaauaccuaccaccauagaagaaaaguuuaguaaguacauguucaauugcaucuaaauaaucagugugucuuuauauaaaucaguaguguuauuuuuuguauuugucucuccaaauuugaugaaauaauuuacuuuaucaauaauaauuucuagccuugaucuuacguaagcuuuaauaauuuaccaagguaaucucuuaaauuauauuggucuugcuacuguauugauugaauuguuuuucucauuaggcgagccagugcagccuugaacuguuuaaaacgcuuccaugaaaugaagaaacgaggaccuaagccuuauagucuucauuuagaccacauuauucagaaagcaauugcaacacaccagaaacgggaucaguaucuccgaguucagaaagauauauuuauccuuaaggugcugacaugaaaucaugauuuucaucuuaaacacaacaucuuaauuccuuaaccacuggauuuuaguaugcauguauuugaguuuacacuucucuucaugcauaugaauuuucagauggcuucugaguuuuauaauuuggagauggguuuuuauaacuuuaaaguuaaaaaaccuugaucuauccuuaaauggaaaagcugccuuucauuuuuucaaauuugaacuuaguuuucugauaugaggacaguuugccuuaauuuuucuuauuacuuucugaugauuuuaggauacagaggaagcucuuuuaauuaaccuuagagauagccaaguccuucaacauaaagagaaucuugaauggaauuggaaucuuauagggaccauucuuaagguaugaaaagauacuucaugguaauggcuugucuuuaauuuuauuauuaauuauaacguaauuaucuuauaugugugagaauugauaaguacauauguaauauaacauauuauguuuuucuaguggccaaauguaaaucuaagaaacuauaaagaugaacaguuacacagguauguaagaacuauuuugcauuuaaauuuaaagaacuuaaauauggauauuaggccuaauaccugcuaaaauauguaauaauuuuaaagacauauacauacauuuuaacaaugucucuucaauagguacucauauauauuuuuaauauagucuuauuuuauaaccaaaacauauuagcaaauucuuuuucuaguuauuuacauucugcuuuuaguuuuggaauagaugaaguaguugagauaaaaguuuuucaaauugggguaguaucaauuguauagugggucuuagcccugacauaugaggaugacauaauaaggacuuauauuuuuaauauacaacuuuuauuccuguuugacuuuggaguuauccauuauaacugcuguuuacauucuccuuaaccacaccuuccauaacccgugcaaauguuuguagcaugaagaacacuuuaagcuacgaugcuguucuucauuacacccauauguuuuuacuccugaguuuagacuaaccagcuauuacuacugaucucagaaagagguccuuaguauguuugagaaauucaugucauuaacauuauuauuugauugcauucuguauucaugauauguaaccuaauaucuauaaaaguuuuaagaaauaaagauaacuuauaaauugcacugaaauaaaaaagcauaguacuaacuuuuuauacuccuugagaacacagaugaugucuuacucaacuuuguuuucccagcuccuggauuggacaccucuauuggauugaauuguagugcaugaaauugaacugaacuaaauucaguagaagcuuagaacauaauguugaaagauauaauguugaaagaucauaaauuaugucuauaaauucauuggccuaaauugcaacuuucaugcuugaccuuuugccuaauugugaaaaaccaacaaaaucauaguguaguaucuuacaauuauuaucuuaacaauagaacauuauugagccaugggacaaaguucuucaugaauacaauagaagaaaauuuaaguucaggugacauccucauuuaucaaauuuuuauauucuagcuauguuaaaucugcauucauccaucuagcaucuuucuucuccuuuauuuuuucuaaccaucucaccauaaaauucuuacuccacagagauuuuuuuuuaaaugaagguuuuuuguuugcuugguuuuugggguuuuuuuugguaugaaauguacuguauuaguccauucucaugcugcuauaaaucacugccugagacuggcaguuauuuauaacugccucuacagauaauauagaaauuaccuauaaaggaaagagguuuaauugacucacaauuccacauggcuagggaggccucaggaaacauaauuguggcagaaggggaagcaaacauauccuucuucauauggcagcaggagagagaaguacagagcacagggggaaaagcuggugauaaaaccaucagaugugagaacucacucacugucacgagaacagcauaaggguaaccgcccccauaaucuuaucuccucucaugaggucccuuucaugacauguggggauuaugggaacuacaauucaaggugagauuugggugggggcacaggcagaccauaucauguaccaaacacuuuuaauacauuucuugccauuuaucccaaugguucagacccaaaacauauucugaaagccuuauuaugucauaaguaaugguuaagauucuaaaauaauugcuucauuucuuaccuuuuugcuacuuguguuuugauuuuagguuuguacgaagacuacuuuauuuuuacaagcccagcaguaaauuauaugccaaccuggaucuggauuuugccaaggccaaacagcucacgguuguagguugccaguuuacagaauuucuucuugaaucugaagaggugggcauucugaauauuuuccagagcaaauguuuuuuauugaauuugcuucccuuacccucccucuguuuccaccuuguguuuugcuuuuauuucugaauaugcauaagccguauuuggaaacauaagaaaugaucccagaccuagaguugaaucccgacuuagucacuaguuaugagacugggcaaguuaucugcccucuagaaaaccugguuuacucuucuguaaaauggagaauaauaucaucuccaugcagcauuguguugaaguggauuagaaaacaacagguacucacugauugauagcuauuauugguaacuucaucauuauuaguaaguuuuuguacuugauugaaguugauuuucuaauuacagauuuugaaugcuuuucucacaauaucacaauguauuuacuuuuaggaugggcaaggcuacuuagaagaucuaguaaaggauauuguucaguggcucaaugcuucaucuggaaugaaacccgaaagaagucuucaaaauaaugguuuauugaccacccuuagucaacacuacuuuuuauuuauuggaacacuuucuugccacccucauggaguuaaaaugcuggaaaaaugcaguguauuucaguggugagcauucccagauuuuguugcaauauauacaugaacuuuauuuuuaauguaguuagauaugguaugcuuuuuauucuguguacauguguuugguuaaguuuuauuuuaaauuagcauuaucuuugcuuuaauauucuuuuuaaaauuguuguuauuaaaugcuuucuuuccaaaaagcuuguuuauauuaggaauuuuaaaaauauacguugaauugacuucaugcucuucccacuccagcauucaaaauaguaacuauguaugaugauugauguguucauugauugugguaaucuucacaauguauguguauaucaaaucaaguuauacacuuugaauaauacaauuuuuauuugucauuuauacuucaguaaagcuggaaaaaauauuuguuuaauuaauguaucaauauaguaauuucuuuuaaccauucuuauuuuuuuuuucuuuuaagucuccuuaaucuuugcuccuugaaaaaccaagaucacuugcuaaaacuuacuguuucuagcuuggacuauagcagagauggauuggcuagagucauccuuuccaaaauuuuaacugcagcuacugaugugaguauaacauagccaguaaaacuauauuuauaaccaauuaauucacuacuuuaugaauuuugggcuaaguaaaauuaaguucuaagaauaugauauggaaauugaguuuacuuuaaaauuuuaguuucuccaaggaacugcauauaguacucagauuuuuguaucgggggaagaagcugcuagauagaaagggaaguauucuauuucacaagaaccaaaaaaguauucauaucaagggcuagaccaccaauuccaggcauucuucccuuuucaaguagcaggacuaucccaaaauaaaaucaaauaggcuauuuaugcugaaguuuuuuuuuuuuuuaauguauucauuuauccuuauaggccugcagacucuaugcaacaaaacauuuaaggguauuauugagagcuaauguugaauucuuuaauaauuggggaauugaguuguuagugacccagcuacaugauaaaaacaaaacgauuuccucugaagcucuugauauccucgaugaagcaugugaagacaagguaaagguucauuuuuuauaauuuaauacuuaaauuuuuuugaaauacucauuugacaauuauguaaaaguauauaauaggcauuuuggaacuaaaaauuuugcuauuuuugugcaauuauaaaaaaauaaugauaaucucuuuuaggccaaucuucaugcucucauucagaugaaaccagcguuaucccaccuuggagacaaggguuugcuucuccugcugagguaaauuuuaaguaaauuuucuguuauguuuuuuuguuguguucuuuggcaguguauauuaaagauagauucaaauccaaaugggaaguacgcugaagaguuuaccuuuuaauauugaaacauugucuuuucauuauuuuggguuuuucuuuuuuuuuaauuuuuuuggucuguucauacuuuucaugacauuuuccuuuuuuuuauugagacggccucgcuuugucauccaggccagagugcaaugguccaauguuggcucgaugcaaccacugccucccaaguucaagugauucuccugccucagccucccaaguagcugggacuaaaggcgcacaccaccacgcccagcuaauuuuuuguauuuuuaguagaguuggaguuucaccauguuggccaggcuggucuugaacucuugaccaggugauccacucaccuuggccucccacagugcuggaauuacaggcgugagcccccgugccuggcugacauuuucuuuauugugauuggguucgcguguuguugcaaagauugugaaaauuuauuuguaauugaaguuauaauaaauuauaguugaccuuuuaguuuuaggaacgaacuauuccuaaagucuuuuagcuccuuauacuuuuuuaaauuuuaguuauuuuagcuucuuaagauacguuuuugccagacucaauguuaaacuauugcuuguuuuaauuugcagauuucucuccauuccaaaaggauuuuccuaucugaaugaaagagguuauguagcaaaacaauuggaaaaguggcacaggguaacuucuuauuugaauaaaguugaauuuguguguuuuuaucuucugaaauugauuugugaauuuagaggaugguuuuuuuauaucaguguuuugaaauuaauaagguuaaauauuuaaacaucaauaucaaguugaauccuaaauucugcauaauugcuaguauuuauaguuauacauuuuuuuaaacuacaguuauuucuuucauucugaacuguugacuguauucguucuauugaaauuugacucucaacucauuugauuuuauaaucuaauuuuuggcccuguuuaucauuucuuucauucuucggucccuuaauauggccuacaacuuugcaugagcccuuuaagcuaaaaccaaaauaauuuuuuuaaaugaagggagauugaaaucccaaggagauauaaucauuuaguuaaacuuuacuuuaggauacuacuuuaccuaaaucugagaaugaacuucuugcugucauagggaaaccugcuaagaagggaguaguuugaagauaugaaacaacuuuucuagcuuuucuuuagcuggugauugcuguggcuucauuauuuuguuugaaguauuauaagucaucgaagcaucuuggaaacccauggucaaaaugaucuuuaccgauauaaaugauuuuuagauuuuucaucauuucagaucaguuauccuguuuucucuuuuuuguuaacauaguuacacauucuuuuauagugucuauauugaaccauauuucauaagagauacuccuuaaauggacuaaaacuuccaagcauacaacuuaaggcaugaagucuuuuaguauuugaugaauuguagaacugagacaagaugugauagguuuguuuccuagaagauauuuaaaucaucauaauaaaauuuauuauacaaaucauaguauuagaaaauugcuuagaauauuggugcagugcuugaaaauagcauaaaauauaagagcuauaacaaaguuacaugcaagguauaagggaacacagaggagagauuaaugauucugccuuagggauuaucaaaagaaauguugaauaggagccguagaugugauacuugaaauggucuugaggaguaaguaggcaaauaaauuagaagaaggguauccacggaagaaggagcagaauaaagcuguauagaucauuggaacauuauagacuuaugaagaaagucauauuccaauguaguuggaacuaagguaaguguggaguggcaagaugaggcuggaaugguaaauuaaagcuagauuguaaaaggccucguaagccauauuauaucauccuaagggauuucaauuguauauauaguggggaauccuuaacagcuuuuaaagagugaucagaguugugcuuuaguaaucugacagguugcagugaagaggaggaauuuugaucauugaagguaaagucuagaaauauugacacaaguuuagaaacaagaauugaugagugccugaacuucacugguaguuagguugauuagaugaggacgcauuuucuggguauuuucaaaauaagauggacagaauuugugggcugauuggauacaguaaauaagagguccaacuuggcucauaagguuucuaauuuaaugacaauauauaauggaucacuauuaagagaucacauuuauaaaaagugauucaagauuaggcuaaugaauuuucaauauguugaacuggcauugucugugcaguaaccacgugauggcuugaaaauguggaucuggagcucagauuugugaggaaaauggcagauaugggggucauuaguauauaguacuaguugaaaccugagccaaaagcuuauggauaugauagaacauuugcauucauaauaccuugaucugucuacccuuugcuaaguaucugacauauuuuaaauuuagugacucauugugauacuaugugcaauuaaaacaauauuauccucuaggaauacaacuccaaauauguugacuugauugaggaacaacucaaugaagcacuuacuacuuaccggaagccuguugauggugauaacuauguucgucggaguaaccaaaggugcguacccaguuaucagauuuaaaacuaguucaucauaaauuauuuuuaacauuucugaguuuuuguauauucugcuucuaacaugauauaggaagaaucuuaaugcgcagcauuaauugcucaaaaauucaguggcauucauggcauguugaauauccuuacugauaacgcauucacauauacuccaugcuggcaccccagucuguauuucuaggccuagauucucuuaccaguacuuugagcucugauaaacuguuacagguugaacaucacuuauccaaaaugaugaaauguuucgcauuucagauuuuuucagauuuggaauauuugcauauauauaacgagauaccuugggaaugguacccaagucuaaacaugaaauuaaucuguuucauauacgccuuauacacguagccuaaacauaauuuuaugcaguguuauaaguaauuuucuguaugaaauaguuugcauuaaauacuaauguguggaauuuuccacuuacagugucaugucagugcucaaaaaguuuuggauuuuggaucauuuuggauuagggaagcccagccuauauuuuaccugagaaauccucauuccuuguuacuuucauauuuuuauuuaugcuggagaguuguaucuaauuuuauuuaucaaacauuuauuaaaauucuuuuguucuaauuagcauauuuaaauuagccaagagauauaguaaucaucuuuauuauacuagauuacagcguccucacgucuaccugccuauacaccuuuauggacaacuaguacaccauaaaacaggcugccauuuguuggaaguacagguaaaaacauaauucacuuauuuuaaguagcuacaauaguaaaaaaaaaacaaaaucuuaacauugcuaaaauauuaccuuugcaaaaacuucucaaaagcuuuaauaucagugguguaauugcuuuuaaauucaucuauuuuguaauugacuuaggcauucuauauuuauuaaccugagaaauauuaauggccuugcaaugcauuaacugacuuguguaugacuuuuugaauaacuaacuuguuauguagaguaagcaauccaaugaagaucugaguucuuuuuuuagaguuuaguggagaaauucagaucuccaaaaacguacugaaaaaccgaguuuuucuuccacucauugggaaauuaaacugaaccuaauacagauuaaguuauccuuguugagcaauaaauugaaaguugcugguugugagcacauuuuauucucgcguacuucauggaauguuaacaagcauaggcaagcaguuguucuuugaguuauaauauguacaccgcauuuaugguugugaauaugucaugcaacuguuuccaauaaauguaacguuucucuuauuuuagaaauaaaguuauaggaauauuuguuuuugugacagaacaauaguuauuuaacaauuuaguucccgauuguaucaguauucaucucaagagcacaaaguuuugcauaaauguacucuauaguuucauguguuuuuauauuacgucugugaaaacuguugggacaaguauuuucauauuaacauuugaaaauuucacuaaaaauuuaaaugauuuucucaguguuacuacuuacauaguaugauaaaaccuaagcacuaauuuacuuucuguuuuaaagaauaaguaugauuauuuaguaauacuaagugccaaguacuuugguaagcacuguaugugcaauaauuuauuaaaucuugaaaccuuaugaugcaaauguuauuaucacucuucuagauauuaggaaaucaaaggaugaggagaugaaguaacuugcccaaggccaugcaguuaauaagugauaauucuagaaugugaauucagaaccccugcccuaugcugcuucucaagaaauuuuacauaaaauuauuuagaauuuaaauaugcaaaaaugacaaaaaacaaacguuauacugguuuuaugaugcaauaauaauauauuaaauacauaaauauauuauuacucaugguauuuuuuuuucuuucuccagaauauuauuacagaacucugucguaauguucguacaccagauuuggauaagugggaagaaauuaaaaaacugaaagcaucucuuugggccuugguuuguaauaaacacuucuguaagaucuucgcaauuuuuagauuuuuaaguuuuuuuuucauuuauacuaaauagauaaauauuuucuuuggaacuacuuauuagauuaauauuuaagacuggauuguuccugccaauauaaguguauuaucucuauguugaagaauagaugguugaacuauugguuucaugacuuuuguuuuguugcuaagacaacuagaauuaauucaugccuaauguuuuguacuugaggaggcuuuuacauuuuuucucucucagagaugagguuaaauuuguuucuugguagcuuuccaaaucuuuugaaagagugacucuuauauuugauguaagugauuucuuuucuuucagggaaauaucggcucaucaaauuggggucucaauuugcuacaggaagaaaacgugauuccagauauacuaaaacuugcaaaacagugugaaguucuuuccaucagaggguaggucauuuaacucagaaaucuuucuaauguagacguuguuauucacaaauggauguuaggggaaaguauuuuaugauuaagugcaaugcauaacuguuaauccacugaaaguucuaaugauacaagauuauuaacuguauuaaguuaaacaucuaaacgaacuccuuguuuacuacuauaauuugauuuuuauuauauugaaguuuaccuuguagguaacagguaaggcauaguguuguacagauacuccaguauuccuguaacccagcuguuccagauuuauacuagaaaagcuaauauaccuuuuuugcucauguugcauuguguucuuuuuauuuuguuguaauuacuauuuuuauugggaagguuugcuuguuuuuuauugcugcuaauuuauuccugacuagucuuaauaaguuuuuuuuuuuccacaaacgcaaccauuuugguggguuuuagagaaaguucaaaguauguauagcaaauuaaucugugguggcuuuaagaaaucucagcuuggaauuauaacuguuuuuacugcaucuuuuauauacaggaccuguguauauguacuugggcucauagcuaaaaccaaacaaggcugugauauucuaaaaugucacaacugggaugcugugaggcauagucgcaaacaucuguggccagugguuccagaugauguggaacaacucuguaaugaacuuucaucuaucccaagcacucuaaguuugaacucggagucaaccagcucuagacauaauagugaaagugaaucugugccaucgagugaguauccugacagguucauauaaaguuagccaauguuaacauuuauauuugaauuuuagaauuuaaauguauuuguuacauuuguaauuugcuuuugucuaagauaauuauuuggcaauaauagccucuuggagaauguguauauuuucauaacaaagaguauaaucaccagcuuacauuuuucucucuccuuauauucuaaguagcuuuugaggauuccuacaaaguuauguaauaagccaugugccagaagaaccaguccuccuuuuuuugacagaaaagaaacaaauauaacaaguauuuauuugucuaccuucuuuauuuaaucuuuuuacucauuuuucagauacugagauuguugagccagaauauauuuuuaacugauauuauauucacaucuucauuuuugagagaagcacuaaauuuuaaaauagugaaauuguuaauagaguaacaaaaauaguuauauauaaaaugauuugugguuuuaaguccugugcuaagugguguuagguguacaaaauuuaaggcaugguucuuccuuuuaagaagauagugucagcuuuaucagacuguguauuucaccaaaucugagaugccaugaauuaugaaauaugccaauauuuuauguaccacaaaagaagaagaaagaagaagugcugccuauuaaacuaggacauacuacaagaugcauauugauuuuagaaucagauucugugugaaaauagaagggauuaaaugugaaaagugugcaucuuagaauugacaaaauauagaaaugguaaugcaguaugcaaauucacuuaggauuuucuuuuaccuucuuugaaaauauauuugaaguauuuguaauuauucaacagaaaaguuaauaaaagaaaaaucguauagaugucauuaggcacucacuuggguugcgucuucuaguagaauugggcacuaaauuuaaugaguuucuuaguaucuaagguaaaaugagaaauaaacauaauuuaaacaugaauuuauaauguuaccacuugguucucuguaaguauauuuuaagauugggaauucauuucuuacaaggugaauuucuccugcuuauaguaauuuaaagaagaaccacuaggaaucuguaguaauugaguaagcauccauggccaagucuccuuuuucccuuuaauuucauccugaauauuuggagaaucaaaagaaacuucauguaaccugugccauagugggucuuauaauaauuuuucuuuggaaauaacaggagauucucauaaauuacauaauuuuacauuuuauucaaguccaaacucuggguuucaagaaagauauuuucaaguagcugaaugguuuaaccguuuauuuuuaaauuuuuuccucuagaugacuaaaaaaaaauuuccugaaaugugaugucacuaauaguuaucaugaauuugucauuuuauauguguuuuuauuaauugauccuucaaucauagguauguucauauuggaggaugaccgguuuggcagcagcucuacuagcacauuuuuccuugauaucaaugaagauacagagccaacauuuuaugaccgaucuggacccauaaaggauaaaaauucauucccuuucuuugcuucuaguaaacuugugaagaaucguaucuuaaauucgcuuacuuugccuaacaaaaaacaucguaguagcagugauccaaaaggagggaaauuaucaucugaaaguaagacaagcaacaggcgaaucagaacacuuacggagcccaguguugauuuuaaucauagugaugauuuuacacccauauccacuguacagaaaacauuacaauuagagacuucauuuauggggaauaagcacauugaagacacugguaguacaccaagcauuggagaaaaugacuuaaaauucaccaagaauuuugguacagagaaucacagagaaaauacaagccgagagagguuaguaguagaaaguucaacgagcucacauaugaagauacguagccaaaguuucaauacagacacuacaacaaguggcauaaguucaaugagcucaaguccuucacgagagacaguagguguagaugcuacaacuauggacacagacuguggaagcaugaguacugugguaaguacuaaaacuauuaagacaagccacuauuugacgccacagucuaaccaucugucucucuccaaaucaaauucggugucccuggugccuccagguucuucucauacgcuuccuagaagagcacagucccuuaaagcacccucuauugcuacaauuaaaagucuagcagauuguaacuuuaguuacacaaguucuagagaugcuuuuggcuaugcuacacugaaaagacuacagcaacaaagaaugcauccauccuuaucucacucugaagcuuuggcaucuccagcaaaagaugugcuauuuacugauaccaucaccaugaaggccaacaguuuugaguccagauuaacaccaagcagguaagcaaauauauguuuagaagugaccaauaaugguugcauuuuaacaaauuuaaauacaaaauguuagccagguuuuacacuaugugagccucaucacugaccuauuauaauuguuuacuaugguaggcuauaagcuccuuguuacccgauaugacuugaaauggauucuugcagcugcgaggggggaagaaaauccuauaggcccugaaaauaaacauacaugcuuugcaaaggacauacaagucacaagcuuuuuuuuauuuauuucucgcuucugcaaggaucgauuuuaaaaagaagcaugucgggggaaucaggagcuuaagaccuacaauaacaaacaaccuuuucagguaggucaauuuaaggcuccaaaaguugaccucuuuauuauuuuuuuaaaaagauaaaugaaaauuucagugaaauuauuuucacuuuaaguagcugugauuauuaaauaggaaccuaauaaacacuaaaugaaauacuugguccucaugacucagcagggauuucuauaccauauuuagauuauaucaagcuagucaaagugaacaguuuagauuuuacuuuuaaaagauacacaguauuugcugcaaaaaaauuuuguaccuauaauuuuugugguuggaccaaaugcuucuaaacaacuuuccuuaguuuuaaauuauucauuuacauuuauuuaaguggauuaauauaugucagguacuuauaugucaacaauauauguuagaauacuuuagcacauauuaagcacucaauaaaaguuagcuauuuaucaucaucauugguaguuauuuaauguaauccaucuagcccuuacauuauucuuaauaacauuaagcaguuuuguuucaauaaugcuuaacacauuuaauagaggguuucuugguagcagacaaugaauuguguacccuuacaggauuuaagaaauuaugcagcaaugucucaucuaucuggaacucacuagcuuuggcaaccuuguccaggacaaagccagggaaaguucucaacagcucacuguuacaaaucuaugcaguaaaguucaugaauuuugaacauuccuaagccucaguuaccucaucugguggagauugcacuagaucagugguuguaaacuuuuguauuguuguuuuuuaagcagagaaauuauuuuuucacauaaagauuucuguggaaacccaauagguagaauagauagaaagggaccuauacugguugaaauaggaauugggaaggggaauaauccaauaauuguuuuccucccacuccaguaauccuugaagaguuuuaugggaaccaaagaaauguaacagauuacaguuugaaagaguguuuuuuggguggaaauuaggagcaugguuuuugcuauguuaauagcuacuauuuagaaagcauuucuuuuguguguuuuacaaaauaauuauuugauuuaauauuaggcugcauucguacauuuuaaagacuugguuuuccaaacaaaaauaucuucauauaaauguauauaaauguggaaccuugcauagugccuuguauauauacagcagauaccaaguaaauauuuuagcaugucuguugcauaaguaagaaucuguaugagaaacauguaucuuauggaaauaucaguguaucauauuuguuauggaaucucuaguaguaaggaguacauuguggaaauaucaguacauuguggaaauaucagugcuuuuuacaaggauaucucgucauaaaugaccauuuugcucuugugucugucuugugugcuacauaaaucuuauguugauaaugaaggcauuaagguaauuaucacacaaauaaugauauguaauugaucucauuuuuuauaaauauaauauuaaauagaguugauacacauauccuuaguuacauaaaugccaaaucuaguagucucaagugauuaugaagauaguccuuggaccaugcucugacuacugaggucaguuucuuuuuuuacuucuagauguugaaaguuauucuaauugcccaccuuuucaccuuuaccugagagaccauaacaguuguuuuugguaacagucaacauuacuggugaccuuuuacauagcggucuauaacagcuaauauuuuaaaguguuuauguguugccaguaaacaagaugacacugcuuaauacaugacuagcuacuugucuuuuaugaagguaggaauauauguuauuucuucauaugauuaaaauuacagaucaagaaacuaaugcaagugguuucuuuaugguuuuauagguucaugaaagccuuaaguuaugcaucauuagauaaagaagauuuauugaguccuauuaaucaaaauacccugcaacgaucuuccucagugcgguccaugguguccagugccacauauggggguucagaugauuacauuggucuugcucucccgguggauauaaaugauauauuccagguauuaucauacauuuuauuguuuuccuaugaguugguuuccuauuuuuucauaugcuguaacugcuuacuagaaaucauaauuuagggugggcaccaguuuggggcagcaugauuuuuaagaccguuuuguuuaaagaaacuuuaagauuaaaauuauuuugcccuuuucaacuacucuguacucuuuuauuuaguccuuagaacauuauccuucccucucuucccauauuaaaucaguaucucauuugauuucuuuauccauauauucucuguagaaauuuaugaaauuucuaacuuguuuuuuagucacauuuaacuuauaccucauuuuuaaauccucauuccuauuuaucccauaaaagguagccagccauaugugguacccaguaauauaaggugacccuaaucccaggagauacccacagaucucuagaugguauauaguacuaaagaacacauuuucuuagaaguugaaagacauuuuagauaaacgcuaaaauaauuaauguccauuuagucacuaauaauauaauaaggacuuuuuggguuauuuuguuaaguuuugguaguugaaccuucaguaaacuugauuauagguucauaugcuaugguaauucuauuuuaauuuuauuuuguuuaauuuugcuaauuuucauaaagugggcuuauuuuuauagcaggacuuaccaugguuuauaucuuuuuuuagguaaaggauauucccuauuuucagacaaaaaacauaccaccacaugaugaucgaggugcaagagcauuugcccaugaugcaggagguaaugcauugugcauuguacuugugagaugccucuuuauauuaaaaagaaaacucuuaguucuuucuaguaggauaacacuaaaaauuuaggaagacucacuuuuggaucaacuuuaaaauuauaccaaaacaauuguuaaagucagcuuaaaauuaaaccacauuuuuguguaugugugagggacuuaacaguguuuucagugaaguacucaaccuuucaaggaaauagaaaccaaauuaguuguuucuguuuuuuaaaaguagcacaugaacaauguauaacacuaauccucauagauccaggaaauagcuguuuguuuagaguaaggagaaagaaauguacuuauaaaauacacggucuuuguuuugaacuguuauauuuuaauauguaaauauaagccacagguuuuauagcuuuauauucuuaaugacuuuuuaaacaaaugccucuuuauacuuagaauuauuacauaucuuuaggcaaauauugacgauaauugaaaugauguauuauauaaucucaauuuuccauuuuguauuuaaaacacuauauauuaaaauaauaaacaucugcuggcuuuccuuauuuuuauaacuuaaagcaaauuauucuuuuuuucuuuccaguuagauuuugagucauaaaaugugcuuaagcuuucuuuaaaauuucacauaauuuaagguaccuugaaaaguauuaucuuuauuggauuauguuuuauauuuacuuaugcacaggucuuccaucuggaacuggaggucuuguaaaaaauucuuuucacuugcuacgacagcagaugagucuuacggaaauaaugaauucaauccauucagaugccucucuguuuuuagaaaguacagaagacacuggacuacaggaacauacagaugauaacugccuuuauugugucuguauugaaauucuggguuuccagcccagcaaccaacugagugcaauauguagucauucagguaagugaucacgucccaccuucagaaaaaccuagugaugacuaaaguucucugguuuacuuuuccaaauuucuuuuugguauucuaauucagaguuucccagcuggugagcugcagcacacugauaugccaaauuauguuaugcugagaugcugauccucucacgguuccaggucacaguggggccugagucugacagaucccuggauuaggucuuuuccacugugaacagcccuguccaggcccuuugcaugcuguaguuauuuucauuuucuaugaggaaaaaaguuuuggaaguguuugguauauugcauacaauuagagaagauguuauuuuauauuauuucuuuuuagcaugcaauguaagcacaggaauuaagccguuauggugcuuuaauugaaauaauuauuuuuuucuucagacuuucaagauauuccauauucugauuggugugagcagacuauccauaauccuuuagaagugguucccucuaaguuuucggggauuucuggaugcagugauggggugucucaagaaggcucagcuagcagcaccaaaagcacagaauuguuacuaggugagucuucagauucaaauccaaucauuauuaguaaaacuguucugauuaguugguuuuguuuuguuuuucguaaauacuguaaauuaaaguugucucaaaacaguaauacguccauuuuagugaagcaauuuaacacuguuaauuauugcaccuauaucacccacugacauagagccucuuagcuaucugcuuuuauuagaguuuugcucccaaaaugauugguagaucauguguaauugaucucuaggucuuuaggugaaguuuaaaaauaaauuucaugaguuuuaaucauuuuauugugacauagauaauauuuaacuucucccugaaaucuuuucagguguuaaaacaauuccagaugauacaccaaugugccguauacuccuucgcaaagaaguucuaagauuagucauuaauuugaguaguucaguuucaacuaaaugucaugagacugggcuuuuaacgugaguaaacuaugugcaugaguauuauuuguuuauucuguuuuuuaagucgagaaaagauacuugaaauacuucaaaaguuaggcuaguuaacuuacaucaguaguucuaaacugcauugcauaccugugugaggcuagauuuucuuuaauacuucagccaaaacaacauauggcaacagauugaauguagaagcaaguaugagaauccagcuaucuucuauuaagccagacuuuugaagagaucugcaaaaaauguaaaauaaugccacucuucucacuuuuuuacuuuuggaaaauacaguuauuuuuauuaaaauacauguuaacauguaauggauuuauuuuuaaaauaaauuaaugcauguuaggaaauucucucaauuuuaauuucuaauauaguaguuaaugguggcuguaacccacacaaaaauaagcuuuuuugggucuucaguaauuuuuaagaaaguaaguccugagaccaaaaaguuugaggaaagugggcuuacauguaacaagucauauuuucuugguuuaauuuuuuucuuauuauuuaaagcagugguucuuaaaagaaaugcaccucagggucuccugcagggcuuuuuuauuuuguauuuuguauuucuuuuuugagacggagucuugcucugucacccaggcuggagugcaguggugcaaucucggcucacugcaaccucugccucccggguucaagcaauccuccugccucagccucccaaguagcugggauuacagguguguaccaccacaccuagcuaauuuuuguauuuuuaguagaaacagaguuucgccagguuagccagguuggucucaaacuccugaccucaggugaucuccugucucagccucccaaagugcugggauuacaggcaugagccaccgugcccagccagcuguagggcuuuuuuuuaagggugauauagguauuggggucccacauagguaucagggucccacagcagaccucugggcugggagcucugggagcgggcccuuaacuggucacucacccaacucacagcugauucugaggugcuuuccuagcuaaaagcugcuauuugaaguauccaaagaaauagcccagucagggauguuaauaacuuaacuuuaaagauguauuucuauuuuaaaacuuaauuuggaacauauuuuaaucauccuaggcugauaaauauauuuugcaauuucucaugccaauaaaaaagaaugcuucaauuuuacaagaaguauucagguuuugauaaucauuuuuuuuaaaaaaaaacccaaacucagaaugucuaagugugugacaggaauauuuaauauuuuauauucucaagucaucaccccaaguaugccaucuaauccauaucuguagggaaaucuauuuuuaaaguaagugauaccuuggaggaaaaauagauacaucaugauuacaguuuucaucacaccauaaucuuuuauuuuagaauuaaggagaaguauccucaaacauuugaugacauaugccuuuacucugagguuucccauuugcugucacacugcacauucagacuuccgugucggagguucauacaagaauuauuucaagauguacaguuucuacaaguaaguaugauuaguacuucucaaauuuaucuuccaagaauaauucuguguuugaauugaauuaaaauacagauuauagcuggguguggugacucaugccuacaaucccagcacuuuguggggucagcgcgggagaauugcuugagcccaggaauucaagaccagccugggcaacauagugagaccgugucaacacaguuuuuuuuuuuuuuuaauuagccgagguuggugucaucugccuguauucccagcuacuugggaggcugaggugggaggaucauaugaacccaggacucagagguugcaaugaacaaagauggcaacauugugcugcauccugggaagacugagcaagacccuaucucaaaaaaaaaaaaaaauuagauauuuauauaaauauguuauaucaucuguuuuuauaaaaguaauugaugauacaccauuuuuucccuagaugcaugaagaagcagaggcuguguuggcaacaccaccaaagcaaccuauaguugauacaucugcugaauccugaccucauauuuaugauggauauagauacauacuauauauauucauauuuguggauuuccuaaaagccucagaaaauacgacugacuaggcagcaaagacaggaguaucuucuguacacuguuccgcaguuacugguacaugaacaguuggaacugcugacuuuccuaaccaaaacaacuuccuucucuccuuuguugagccuuuugagggguucaugauucauuaccacaguuuuaagaguuucaguuaccauuguaugcaagagccaagcacugaauaccuacauagguuuucuauuuucuuucauuuuaaaagcauaaugacaguggaacaauaaugggauaugcagaagcacccuucacaaguuauuucugaaugauuuuuaggguaaauaauacagaugccuuguuuguuaacuaacuuguggaaagcaggaaucagugucucuaaggcugcauccuauuaccacaauggggugugcuauaacugcugguauuagagagggaacuuuggcccuuucacguuuuucuuaauguuuguaacacuacuucagagguuuauaaccucaaagcagaagaagagccucaacaacccgggacuuauaaguuauuuuuauguuacuagacuugcauaaagauucuuguuuuccaacucuucauuuuguugcaauguguuauuacaggauauaugaaccaauuaagguuuuucacuacaguucuugaauaaaauuuaaaaaucauuuuuuauuuuaauuaaaaauauuucccauuuauagaaugcauauauuugcaauggacuuccacuuucaucaacuuuccaucucaucgcuuuaaacaggaacuugaacaagcacuguuaguuuagaccuaaaggauaggaaagcauuaaauaauacuuuggaucuccugaggaaaagauaaguuugcuugcaauuuacacauuccauggggaaagaagagccauauuuccuuaaaaaaaacauuaauaaagcuuguuauugagaaaaauuguagugaaaagccuuaaguaccaaauuuuaaagcagcaguaacuuaauuuuuauaucaguguuuuuguuuugcacaaacuaaaugcagugguagguggguuuaugaguauauuaauugccuuuauccauuugugaaguuaaguugaugagggcaagguuuuuguuuguuuaauuuguauaugucuaaagguauuuggaacuuuuuacaggaauuaaacauauaugcaaauuuguauauaaaaauagcauggccaucauuugaaugcuuguaaaugaaaggauuaucuuuuuugagaucuauauauaaauagaaauagaaaauccagcuggacugauuaggauucuuuuuuaauucauuuguguauaacauuuuuauuacaauuacacaucaguuuugacacagucauagcaacauuaauauuuucccaugaugcagauccuuuuuguaaugggcuuguucuuugagaucucuguaaagaacccugugaacuagaaaacauaacucacagagauacuuuuuuaaaaaauuuauuuacuggaacugaaaguuccaguugggaugaagcauuucaucucacuucauaacaccucuuugacugcacuucagugaauuguucuuaugugcacuguguagcaacuuacauuauaacaaagcagauaagggcuguaagcugcugcuuauguugaaaagugguucuucagauuuucucucauaaaauccaguugaagauaaauaauuuuuuuauacuuuaucacugaacccaaguguuuauuuaaaugucaacaguacuucuaagaacguugccugucaucguggucuuuggucuuggauaacuaaacugccuuuccagagaaccaaaugucagaguuacuagaccaaauagugguuaaaaccuccaaaggaaguaauguaaucuuauucauaaugggauuaacauauuuuagacauucauuuuaaacacuaccucaguuaauauagaguauaaaaaucugugguuuaaucccucaaaaguuaacaguaauuuuuuuuuugucuuacacacacacacacccccucccccaccaucacuaucccuguacccucaccuuggucaucuauccugaaauaaggcuuaguuaguauuggccugaauguuuuguguuuuuuuuuuuguuuuuuuuuuuuacuguuacuuugaaaaauauguauguauaccuuaucauaucugccuauaucacuuacuuuggggagauacucagagcuuugugguuaucaguauacuaaaaaaaaaaaaaagucuacgcuuaaauuuauagugcuauuugguuucuccaugauuucacugacaggucuaauacauuuucuuugaguacuuguuuguaaaaaguagacuuuauggugaaaaauacaugcagugccaagugauuaacuuaaguguuuaaaaauauuaaauuauagcagaagagguuaggaaugauaucagcaguaauagaaauaauugagaaaaucaucuauaaauaauagauauuacagacuauagaauaccaaaauaaugucaauacuguaguuuuuaaagauuuuaggauuaaucuuaguccauauaaauuuguacuauugguaauuauugaauaauugggaggaaucugggcaguugugcugguuguaaacuaugaauuucuaaucguaaagugaauuguuauuucuaauugaacuuuuuuucaagaacagauuucagccucacauacuaaguaaauacugauaaauaaggaaauuagaaauuuaguauucauaauuaaauaugcucuaaaauuuccuauacuuuuauuuccuguuuauucuuagguagauuggaagggggaaacagucuguucucccuaauuaaauuuuuucuaauaacgauuaguagaauauggacauucuauaugacagugacauuaaaagaggcucuuuggaaguauauacauuauuaacauaauguguacaaguccuuuugaaaugacaacuuuaauggguuucagcucuuuuaucuagagcuugagauaauucaagcugaguuuuucagggcauaucacaacggccaaguguucagcagugggauaucaaugcuuauuuacauuuuccuacugcuauuuauauaaaauguuauuccauucagaggaugccuuuuauccccacauuaaagcacagaucauuaagcaauaaaaaccaaauugucugucauucaaauuauaacugcaguuauuuuugcaugguaagagugaggugcuaauuuugugugagaugaacuuuguaaacuacuuugggaaauguucuuuggaaguaagguuuuuucuccuuuagucuuaugcuuccacuuuugucucagauucacaauccauuaaaacauggggaaaaaagaaaagguaaaauugagagacuuuuguuagaggagcuauuuggaaugaaccaacauuucagauuuuccaaaauguaaguuaggaagucuccauugucucugcauuaacaaaauacacuguuacuaucuuaaucucaagagugucauuacagugagaaucucauuuaaaagcauaccagugaaauuaauagcagugcuuaucaaagaacacugaaaucugugagaaucuuucuaggagcauucuuuucuucuuuuaguuccaaguuccaggguauuuuucauuccuaguagguuuauaugacucacagaauguggacuuuuuuccuguuuggaguauuuuuguaauguaaguaucggauagcugcaccacagcaugcauaaauugcacauuuuguuuuacuuucuuuauagaauauuuaauuucaaaaauauaauuuaugccaaaaaaagcauaccuuucaauuuugcuacuugguugauuuagcacaaaaugcaaagucuuggggcagagagggggagugaaaaaaauuuuauagguaauuguuacaaaaauaccugucagaaacccuaaagcugcauuguaaaacaaaugguguaaacuaguuuugaaaagugguaaggaauugugaaaaaaaucucagacuuaaugcucucuaaccacaugaguuucuucuuuuuuauuuaguaauacgcugcuacauauuuggagguucugguguuuguaggucacugaacagacauugaaaucugauuuauauuguauaacuguaacauagaaagaaaaaguauuuauauuuuuucuguaagaauauuucauugaguuguguauaauuuaaauaagauuuguccccaaaugguuuugcucaccuugauuuuuuuuguugugauuuucuuguuuuuguauaauguguauaguuuaugucaagggcauuaaaagccuccugaagcauaaucuuaucaaagggauacauuguuaauaaaauguacuuaaaauucuuaaac

SEQ ID NO: 17725 - RNA, 90696 nt, Homo sapiens
gccucggaaggcuccuguuauccucuaagagaggugaaaugcaccuuucaaaggcccagacacgguaaagauuggauggcauuuuuggccgggcgcaguggcugacgccuguaaucccagcacuuugggaggcugaggcgggcggaucacgaggucaggagaucgagaccauccuggcuaacacggugaaaccccgucucuacuaaacauagaaaaauuagccaggcgugguggcggucgucuguagucccagcuacuagggaggcugaggcaggagaauggugugaacccgggaggcggagcuuacagugagccgagaucgcgccacugcacuccagccugggugacacagugagaugccgucucaaaaaaaaaaaaaaaaaaagguugaagauuggauggcauuuuuaaggggaaaaguaaaccauguguagcaugucguagcauugggaaauaaagguuucgggacuguuguagccgaagaaacuuugucggacagggcguuucuggauagaacgcgaguaggggaaaaauggggaccguuugauucgguucaaacacguuuucguugcucuggacgccaaauggaaacacggccaaaauuuaguuaaaggacuucucuugccugaagauuuucggacggggaucucacggguuuggccucuggguugggaugacaagugccccugugggauacacagccccaggccucaucggucacucggcuuaccucugguuccgccggcuggcccgugcguccuuggccggggcaggagcagcgcugcgcgcggggcacggagccucggccgccgaguuuucgguuuccaaguuuccuucccaggccucucccacuuccucuucucaccagugcccgcccgcccgcaaaguccggguugugaggcugcgccucccccaggaucgcggccgccuccccccgggacugaagggagggaauuccugugggucccaggagugccaagagugcgcagcaagacgggaaauugcaaaagaccucaccccucugcccucccccgcgguuuuccaguaacucccgccccuccgcgcuugccccgcagcugauucauagccccggcccgggccgccucugcacguccgccccggagcccgcacccgcgccccacgcgccgccgaggacucggcccggcucguggagcccuucgcccgcggcgugaguacccccgacccgcccguccccgcucugcucgcgcccugccgcugcgccgcccucgguggcuuuuccgacgggcgagccccgugcugugcgggaaagaauccgacaacuucgcagcccaucccggcuggacgcgaccgggagugcagcagcccguuccccuccucggugccgccucugcccagcguuugcuuggcugggcuaccaccugcgcucggacggcgcucggaggguccucgcccccggccugccuaccuggugggugaaaacuaaaugauucauuccuuacaggccgcacagugccgagucgcccauuucucagacuguuugaaauucaccaucccagcgccuuuuucucaaaugaugguggaauguuuguugaguggaaaauucccacuugaaucccucuuuccucucucccaacacaucguguggaggaguucauugcuuccccuaccucuccucucguaacccuugacucccaccugagagagccauuuuucugggaauccguguaucucucccaccuggucccuagcguagaagcgggaggagcucaagcacagguggagagaggaauccccgggcgacucugcaauagcguccguccggggcgcuuaccuucuucuccagccacuugaguggaaguggcccucuacauucuggaaaccuaggcacggagggguucaguaacuuguccaaggccauauggcuagcugugagggcacugaaauccgagcccggcucucgcaggccagggcuuuaccccugacaccgcgauuccuuucucgauaguucuucaucugcccuucauccaccuacccaugcaugccugcauccguccauccauccugccugccuugcugcgggaggcacagugcuaggugcugcugauggaguggcuugguaacagaccugccuugaaaacacuuugggaacaagauauucaagagaaguaaauggaagggucuaugaaggcagagaagauagaauugaauguaggauacuuaguuugagcuagaaggaauucugauggaggagaaagaaauuuuuagguuuuauucccaagauuaaaacugacuuuggaacaugggucaaacuacuuaucaccucuuaguuuccuugucugcaaauaauaaugguucauacuuacugugaaccagccccuauucuaagcacuugacauaugcuagcucauuuaagcuucacgggugaggcggguacuaguuuuuuauuauauuuuauugaggaaacugaggcccaaagagguuuuguaacuuuucuaggguuacacagcuagcaggugacaguaucaggauuuggguuuggagucugcucaugaucaccgugcuguagcucaaacucuaagacugggugggguguuucauuauggucuugcuuugucucucuccugggcugcuuuaaaaugcacucagagcccuugauguccccaaacuccgcugugucugagaaucauuucuugagcuuucaaagcaucaaacuccaaacacagccuucuauucagaaucuucaggaaauacucaguuuguuuuccccguagcauuuguucagugccuccaguggcaggaagcucaccaccucacauuuuauuguaggaagagcuaguucucugcuguaaauugccuccuugugacuuacaucuuggucccaguucccguuugucccagcagguguggcuaagccuuuuguaucaaagguggcuuugagagaaaaaggcuggucuuggguguuucuuccgcagggacccgagccgcauuggggagaacacauaaacacugguucuuucccccucuacccuuuucuuuaaccugaacagaccaggaacacaugcagagguguuccuggaucucucauguuuuuguaacccuuuuguccugaggacaaaaccgaaucaggagaacuguuacgguuuucaaaggggaaucagugguacuguauuuaacaagaagaagguguguauuuuccuugugggaaaggacuggggcauucauuggcugcaguagaagagaaucuuagugaguguggucuugcucacuuacaggaacugugagccuuggcccuccuuucgcugggggagaaaauccuucuugauugcuuaaaaaauguguaaaauggggggaaaaaaacccaaaccaaaacaaauagaauaucauggccuugcuggagaaauccccuccuccaagcaggcuucuuuguagcuacaugaagagagaauuucuuuuccaacagcuguguugguggcuucauagccuuccuucccuccucauuuuaguuguacuggucgcucugcauuugugcacuccacguuguauucuauuuuuguguuuuaaaaauaauacaaauaauaacaacucauucucacucaauauagaagugaagugaaauguagacgugccaucaccauccucccuccucccacucagaagagggaagguuaaguuugauaauaccauucuaaggcuuguuuuucuuuucuauaguuuuacauaauacauacauauacauauguuuuaaauaugcaaauuaucuuacuauacuuauuguacagcuugcuuuuucacuuuccaagucuuagagaucuuuccauugucucuagauaccucuuuuguuaauggcuacguguuauucuuuuugugugugugugagauggucucacucugucacacaggcagaagugcagugucaugaucauggcucacugcagccucgaccuucugggcucaagugauccucccaccucagccuccugagaagcuggaacuacaggcacaugacaccacaccugacuuuuuuuuuuuuguauuuuuuguaaagauugggucucuccaugaugcccagacuggucuugaacuccuggguucaagcaguccaccugccuuggccucccacagugcuaggauuacaggcgugagccacugcgcccggccagcuacauguuauccuaaaguagaaauagaauguaauuuauccauccuuuccuauauugauggacauucagcauuagcaacguugcuucagagcagaucacacauucaucuuccugcucaagugugaguauuucuguggaagagaaucugaggagagguauuccugugucaaaggguuugccccuuuuuccacuugauagauacgaaguggaagguaacgauguaacuuaauauuuuuguaaaguuuuagacagcugauccaauagcauuuauuuaauaauucaucuuuuuuccaacucauuugaaauucuguuuuuaucauuaaauaaauuccuguuuguaaaagggucugugucaggauucuauucuguuucauugaucuuuuuuuuuguuuguuuuucccuaaaccaauauuacucugaguuaacuacuguagcuuuauaguguuuuugaaaaucuugugguauauauuugugcuuuuuaaaacaacuuuuuuuauaaaucacauacauuuucucuuuacaaauagccugucaaguuuaauaaaauccuauuuuuaauuaagauuuuauugaguuuauaauuguuagcaauuuuuaaugcuuuaauguccacuuugguaugagcuccaagcuuuaaggaaacugugucaugugaacuuugguuaaugacuuaucugauuucaaauauuggcuacacaucagauuaacugggucaguuuggauaaauuacuugucaacuuucuuauccuuaauuuccuccucugugaaugggaauaauaauauaauccuuuucuuagcgcuguugugaggauucaauuaauaaaugcauguacgucacuuagcaaagcaccuuguagagaguuaguaucuuauacaugcuagcugggaucuuuuucauauuuauauccuacucaugguuuugcagagugcccuauugguaauaggaaccaguaaauauuuccuuuauuuauugguaguauccuaagagacaaaaauauaucauauauuuuaaauauaguaguguuucucaaacuugaaugugcauaugaaucaccugaggauauuauuuaaaugcagauucaagaggucuaaggucuggccugagauuuugcauuucugacaagcuaccaggugaugucaauacugcugguccuuuguccacauuuggguguacagucuuguacaacuauuuaaauuuaugcugcuagugauaguacuuccuauuuguaaugaauaugauugaaagcauuuuuaaauugauuucuuuuaaaauuacaugcuaaagaacuaaauuauaguuguuuuccuuucuuccuucuucucucccucucuuccuuuauuuuuguuaaaagaaagaggguuggugagaucgcuaaauagaauaccuagcucuguucuuagaucuagagucauugaggcaauuaacuaucuggauuauuuuaaacuguugacuuaagaugaagacagucauauaaaauauaugcagccugaauaugacauuuaaugucaacuaaagaaaagcacaauuguaaguggcuucugcaaauagaaaaauguaagacauaaagaacacuuggaaaaauguaagacaaaauaauucucagaaaagagugauugagguuucauuguucauguguaaugccagcuuuugagaagaugugcaucaacagaaguuacgcuuucuugugaguaaauuuuucauacaccgugguauuucuuggucaccucuuucuacuuucaaucucccuaaugggggauuuugagcaaauuuacuucauauauauacuucagugugucugucugucagccggggaugguaguaugauuuuucuacucaggacacugguuacuuuuugcauuuggaaauagaucauuaaaguaucuacacucucucagaaccuaagagguuacauuuucuguacagaaaaacacggcauccucccaggcugauccaguagguaaaaacugccaaccuuuuucaagucuguucaauaccauggguuggacuggaaacacaaacacugucaacuaguuuaaucauguugggauauaugguuucaaguguggaaauaaggaaauugccacuugcacaagacugagcuuaauauguuuaaaacaugcacacacacacguuuuaaggaaugcuuuauguugcagaacuguauaacuuaaagugaguuaucuauaauuucucuuauucugcccaccucccucccuccaucucagcucuaaauuuauaacuuaguaagugggugugucuuuggggcugguuuggaucccucaaguagaagagagcaagccagaaacacaugugcaagagauuuacugggggaaggacuuguaaggggaaagggaguaacuguaggcacagagccuucagacccagugcaggugugaugccuguggaaggagauggggaggaaggaaggugggaaggaguugcuuccagcugcagccauugggugggagcagccuggggugugugaaucuuccacagaucugaaggggcagugucugaaggcugucagucaucuacgcucucuugaagggagcacugaggggcacagcugcacacugccacaguucucuuucagagauguucuuagguauauacuguuuugaaacugacuuauucacugaugugguuuggcuguguccccacccaaaucucaucuugaacuguagcucccauaauucccucauguugugggaggaacccaguacgagauaacggaaucaugggggcaguuucccccauacuguucucgugguagagaauaagucucacgagaucugaugguuuuauaaggggaaaccacuuucacuuggcucucauucuucucuugucugccaccaugugaaaugugccuuucuccuuccaccaugacugugaggccuccccaaccacguggaacugugaguccauuaaaccucuuucuuuuguaaaucacccagucucugguaugucuuuaucagcagugugaaaacaaacuaauacauucacucaauauuuuagaauauuuuuccaugucagugcauggaucuaguucauucuuuuuaacaguugcauguuguuccuuuguagaaaugcaccauaauuauuuuucuguucuuuuugaaaggcucuuggauuuuuauuuuuucccucauguacacagugcuauaacagucuuuaaacacauuugcguacaacaugugcaauacucugucuaucaucuguagggcaaaauuucagcaauagaauuacagaaugauuucuggaucaagagaaauacacauagaauuuuaguagauguggucaaauggaccucuguaagguuguaugcuuugaucauuagugagucacaaugcuuauuucuguaaacucuuaccaaugugagguauuaagaccuuuuuaaacguuaccaauuggauacuacauagacauacacagacauacacacacacacaauugucuuuaauucuuagugaucuugccaaguuuuuuguagggaagggugauauuuguauuucccucuuuucaugaauuauguauucauguuuuucuacagaguuguaugccuguuuuuacuuauuucuaagaacucuuuguauaugagggauagcucuuugugauacauauugaaacuauuguuuucauuuuuuuuuuuuuuuuuuuuuuuuuuuuuugagacggagucucacucuuucgcccaagcuggacugcaguggcgcuauccuggcucacugcaagcuccgccucuuggguucaugccauucuccugccucagccucccgaguagcugggauuacaggcgcccaccaccacgcccggcuaauuuuuuguauuuuuuaguagagacgggguuucaccguguuagccaggauggucucgaucuccugaccucgugauccgcccgccucggccucccaaagugcugggauuacaggcgugagccaccgcgcccggcccuauuguuuucauuuaaagcacuaaaauguuucaauguuuguuaaucaguauagcuaucuuuaucauucuucacccucccccuacauccuuaucuuuuuugcuuaugaguuuuauaucaugccuaacagauuauaaaacuauuuaccuaugauuuaaucuaguacuuuuaaugguuuuauuccuugcauugauaucuuuguucaucuggaauuuauuuugcugaaggaaaugaggcaauagacuuaaugauaaaauuaacauuaacuggguuugcuguauguagguucucauaagcccauuuaauccucaugccaaugcuauaagguagguuauuuuauucuucuccuucuacagaaaaggacauugaaaccuagagggguuaaaucacuugucauuggccauaugguuuuuaaguaccaaaguaggaauuugacccuaagcauuuuaugucagaguccaugguacuuaauuauuaauauuacagcuuccuuuucccacaagucugcgugcuauuguuccaguaccauuuuggggaaugauuucugugaucucaaaagugauuuaaaauaucaccuuuagcauauguacauauuuuuuggauucagaauacccuuggauuccaguuuuucauuuuuuuauuuggcuucauuuaccuuuuagagacucagcuuuaauccuagcugaugucacaaauugcagaaaucuugaacugaauguugcguuuuuaaaaaaucaguuauucaucagcuaauucaauuuuauaaaucaggauuuaccuuauaacacugguggaaacacuuaaccauuauccaguggacagguucaagagguggggugugggggacggacaugaaaggagaaauacucaaagcuucccauggcuguagcuucugacuguggagccuugaggaggaagggaauuggagugaacacuuguaaguaaucaacccuaugcuguaaggcagaggccucuucaaaggggcucucaaauauauaacuggcaguacucuuaaaaaaaaaaaaaagauaaccgagccugagaaucaugcagaacccgcaagaaguagcauucaacucuuuguacugcugcacaggacucuuucauaaaugcauacacccaggcaugagaccuccaagaaagggcuucuuccuuuaaaauggcauuugcauaagacaucaucaggucacccagccaguuuugaaguuugucaacacacccacauucuugggacgugaaugacucuuaucacgcugcuucucaugggcauuauuuguggugaggaaacuucccaggaauauuucaguaaugacagaacaagaaguguggugaggaagggcagacugaaauccauuuaaaaaguuguguuuuauuacgcaugugauauuuuucugagggauuuucauaagcaucuuuacugagaaugagauuuugcaaagagacaagauuugauuaagaaguucuacaaaaucaauggguaauuuuucuuuccuucuuuugcccugcagagaaggaaagucaaugcaagauuuauaaauuaggcaauauuugacaauaguaaaaguagaaaggccugaacagauaucuauuuucauuaaaaaaagauugaaagcaaagaagagagaaugugagaaaauuaguacccauuuuuauucauuuaucaaauacuuacugaguagcaacugucuucugggacugacagacaauggggaauaagauccaggccugccugcaaguggcuuauagucuaguugggaauaauggagaccugaaaaagagagagaaaugaagaacagauuuggggaaaggaccaaguaguggggaugaaguaggaaguauuuuuucccuuucuaaauucugcugcuucacacuucccugacuuccuuuucucacuggaaguuggaaguagcagugcuccucacugacaguagucgagagagaaagccggccggguggaugagagagcuggcugccuuucuugugccagaagcagagcugcagaggagacaccaccaagguugucccggccagagcagcagugagacugugucggggcugcaggggcugugcagauugcucacccccaccacacagcccucacccuugaggcaagcuaggaaagccuggcccaaucuuggauuuucacuugaucugcaggaggggccacaguagaggguguggagcagcccagagcuucgugcgcugaccuccuagcuuuucugucuguacuucugguuuggugauggucuagucuuauggguuuaaguacuauguguaagcacugaggaugccugaauguauaugccuagccaggaccacucccagaccuucaaacuguguauccggcuagcugccugacaucuuuucuuggagaugaaauaagcaucuugaacuuaacauguggcaaauugaacuauugauacagaccaccagguguguuacucccacacuccucugcuccuccauaaacaguaauuccauucuucgaggggcucuggucaaaacuguuguagccauccaugaugugucacuuugucaccaccccuguccugucagcucuaucuuuuaaaucauucucaaauuccaccacugcucacugcuuccacggcugucaccugcucugagacccucaucauucuucccuggaccauugcacuaacccccccaacccccacugccaccgccacacccccccaccuguugucccucacuucacuguugucccucacuucacuguugucccuucaaucucucauccuugcaggcuucuguucaauguaaaccagaccacguuacuccucugcuuaaaaucuacaguggcucccaucuggcccagagcagaagcccaguuucuucccauauuuugccugcucuguucugccugucugcaugcccucuagaugucuucucuggcucucaccagcuugcuuguucacuccucucuagucacaccuggcuccuccucguucccuaaauccuccaagcagcccccaaccucagggucuuugcagaguuuucucccucaccucugggcuuuucguuguguuagucagggucccauccaucaggaaacaguuggcacacuuggaauaggacaacuugaggagaauuuauuuacaagguauagaacugaggacuucuugggucuuggaagcagcuaacuuggaaucauuggugucuguguuuuuucauacugcaucagccaugaggaagccuguuccuauggcauuuaucaaagaggcuccacagugucucuggaauguucugccagguguugauuccuguucugcacguuuugauauacuuuauugauuuuagcagaagguuuuugggcaguagcuaggacucaucuucccucugucugugguccucagguggccuggggccugaaacacaggggguggccuuguccagucccacugcuggaaauaauaaucacuuugcucauguguaggcagugacuacuguguccugcuugccccugcccaacaugugugaacugaugacagaagaaaacagggaaucugagcacaaaagcuaaccuucuaggauucauagccugacauaugugagagacaguauaaagggcaggaauuccagauaagaccaucuugugaucuuuuauuuuugguuuuagagauaggcucugacacccaggcuggaauguaguggugugaucauggcucacugcacccuugaacucccagaaacaagggauccaccugacucagccucccuugaaacugggacuaggggcacgugccaccaugcccagguaaucuuaauuuuuauuuguagagauggaucuugcuauguugcccagucuggucuggaacuccuggccucaagugauccuccagccucggccucccaaaaugcugggauuauaagcaugagccaucaugccuggcccagacaagacuaucuugaugauucucaaaggcucuucuuugguacccaaaccauagaaauacaucuuuuguaaauacucaugucuuuccauuguguugcuugacagcuuuuauucucuaauuucugcuuacccuuaaauggcaaguggcuucuaauuuuuagucuuaaguuuuucugcccuauaaccuuaauuuuuugugacauguaaaauacucgauauucuaggaaaacaucaaaauuuuagaaacauuuuaaguaguccuuuuuaaaaaacauuuggcaacaugcacaucauucucugaaucaucugcuuuuaaauuuaugagaugagauuuccuuucaguggugaacaccuugcauuccucaaaugauaugaaugugaagaggaugauauacuaagcccacagaauauaagggauauuuuaaauuucaaagugagugucauuuuggaggauuuuucuuugacuuccccuugcuuaugacuagaaacuauuuccucuagaauuaguuuucccccggcuuuaauauucaguuguaauacaaacucauuugaaauuuuauuuaaaauugacacauaauaauuauacauaauuaugggguacaguugugauguuucaguguauguauacauuguauacugaucaaaguaauuagcauauucaaaacuuuacacauuuaucauuucuuucugauaacauuuaaaacucucucuucuagcuaucuuuuuauuuuuauuuuuuucuugagauggagucucgcugugucgccuaggcuggagugcaauggugccaucucagcuuacuguaaucgccgccuccuagguucaagcaauucuccugcuucagccucccgaguagcugggacuauggaggcgugccaccaugccuggcuaauuuuuguguuuuuaguagagaugggguuuuaccauguuggccaggcuggucucaaacuccugaccucaggugauccucccaccucagccucccaaaaugcugggauuacaggcgugagccaccaugcccagccucuuccagcuaucuuuuagaaaauuguauauauaauaauuguacauaauuuaggggguauaugugauauuuugguacaugcauaaaaugcguaguaauuaaaucagggucuuuuaggauaucuaucaccugaaacauuuaucauuucuuuguguuggagaaauuuuuuccuccagcaauuuugaaauacacaauauguuguuguuagcuauaaucacccuguggugcuguagaacacuagcccuuguuccuccaaucuaacugcauguuugugccuguugacugcccccuuccuaacccuuuucagccucagguaaccaucauucuaucuucuauuuccaugagauccacuuuuuuuuuuuuuuuuagcucccacauaugagugagaauaugugauauuuuucuuucugugccuggcuuauuucacuuaacauaaugaccuugaguucuauccauguugcugcaaaugacaggauuucauuccuuuuuauagcugaauuguauuccacuguguauauauaccacauuuucuguaucacuugucugguguacaacacaguuuaauuccauaucuuugcuauugugaauagcgcugcaacaaacaugggggugcagggaucccuuuuauauacuuauuucuuuuccuuugaauaaauaccuaauagugggauugcuagauuauaugguaguucuauuuuuaguuuuuugagagaccuccauacuguuuucuauaauggcucuucuaauuuacauucccagcaacaguguaugaguucccuuuucucugcaucauugccagcauuuguuauuuuugccuuuuugauacuagccauucuaacugggguaagaugacaccucacugugguuuugauuugcauuuccuugaugauuauugauguugggcauuuuugccauauaccugugggccauuuguaugucuucuuuugauaagucuauuuggaacauauguccacuuuuuaauggaauuuuuguuguuauuguugaguugaguuccuugcauauucuggauauuaguuccuagucagaugaaugguuugcaaauauuugcucucauucugcggguuuucucuucacuccguugauuguuuccuuugcuguggagaaacuuuuuaguuugguauaguucuguuuaucuguguuuguuuuuguuuccugugcuuuugaagucuuagugauaaaauuguugccuugaccaauguucagaagcguuucugcuauguuuuuuucuaguauuuuuauaguuuaggcauuauguuuaaguguauaauccauuuggaguuuauuuuugucuaugaugagaaauaggaaucuaguuucauucuacugcauugguauccaguuuucccagcaccauuuuucgaagaguauguccuuuccccaauauauguucuuggaaccuugguugaaaaucauuuggcuguaaaaaugugaauuuauuucuggguucucuaaucucauaaauugguguaugugucuguuuuuauaccaauaucaugcuguuuggguuacuguaguuuuguaguauauuuugaaggcagguguugugaggucucagcuuuguucuuuuugcuuaggauugcuuuggcuauuugagaucuuuugugguuucauaugaauuuuagaauuguuuuuccugugucuaugaaaaaugucauugauguuuugauagggauugcauugaaucuguagauugcuuugggugauauggucauuuuaacaauauuauuucuuccaauuuaugagaauguauuuguuuguguuuucuccaguuucuuucauuaguguuuuguaguuuuccuucaacaucuuucaccuccaugguucaauuuauuuuuagguuuuuugguguaguuauuguaaaugggauugcuuucuugauaucuuuuucaaucaguuuguucuuaguguauagaaacacuacuaguuuuucuauguugauuuuguauucuaaaacuuuacugaauucauuuaucaguucuaagaaguuuuuguggagucuagguuuuuauauauacaagaucaugacaucuguaaauggggacacuuuuucuuucucaauuuggaugccuuuuauuuuucucuugccugauugcuuuagcuaagacuuccaguacuauguugaauaugaguuguaaaauugggcauccuuuucucauuccaauucugagagaauaaauuuugcuuuucaccauucaguaugauguuagcugugggucugucauauguggccuuuauuauguuaagggucauuucuucuaugccuaguuuguugagaguuuuuaucaugaaggaauguugaauuuuaucaaaugccuuuucugcaucuauugagaugaacauaugguuuuugucuuucauuuuuuugauguaacguaucacauuuauugauuugcauagguugaaccaucccugcaucccggggauaaaucccacuugaucaugguguauuaucuuuuugauguguuguuggauucuauuugccuaguauuuuauugaggauuuuugauuccauguucaucagggauauuggccuauauuuuucuuuuuuuguguguccuugucuggcuuugguaucaggguaaugugagccuuguagaauuaguuagagagaauuuccucuccuuuaauuuuuuuugaauacuuugagaauugguguuaguucuuaguaaguuugguagaauuaagcaguaauuuuuucuuuugagauggagucucgcuguugucgcccaggcuggagugcaauggcacaaucuuggcucacugcaaccuccgccuccuggguucaagugauucuacugccucagcccccugaguagccuccugaguaggugccugcuaacaugcuuggcuaacuuuuguauuuuuaguagagaugggguuucaccauguuggccaggcuagucucgaacuccugacuucaggugaucugcccaccucagccucccaaagugcugggauuacaggcgugauuaggacauuuuuuauguccuugacuaauucauagacccaaugguccuucaggagcuauuuuuccaaagaaaauuuccaaaguuucuccuguuauugaauucuaguuuuauucuguugugguuugaggaaacacuugauaugauuuugguuuuuauuuuuauuuuuauuuuuuugaaauuuuuauugaucauucuuggguguuucucacagagggggauuuggcagggucauaggacaauauuggagggaaggucagcagauaaacaagugaacaaaggucucugguuuuccuaggcagaggacccugcgggccuuccgcaguguuugugucccuggguacuugagauuagggaguggugaugauucuuaacgagcaugcugccuucaagcaucuguuuaacaaagcacaucuugcaccgcccuuaauccauuuaaaccugaguggacacagcacauguuucagagagcacaggguuggggguaaggucaccgaucaacaggaucccaaggcagaauuuuucuuaguacagaacaaaaugaaaagucucccaugucuaccucuuucuacacagacaccgcaaccauccgauuucucaaucuuuuccccaccuuuccccccucucuauuccacaaaaccgccauugucaucccggcccgcucucaaugagcuguuggguucaccucccagacggggugguggccgggcagaggggcuccucacuucccaguaggggcggccgggagaggcgccccucaccucgcggacaggggggcuggccgggcaggggacugacccccccaccucccuccuggacggggcggcuggccgggcagaggggcuccucaccucccaguaggggcggcugggcagaggcgccccucaccucacagacggggcggcuggccgggcggggggcugacccccccaccucccucccggacggggcggcuggccgggcggggggcugacccccccaccucccacccggacgggguggcuggccgggcgggggacugacccccucaccucccucccggacggggcggcuggccgggcagaggggcuccucacuucccaguaggggcggccgggcagaggcgccccucaccucccggacggggcggcuggccggguggggggcugaccccccaccucccucccggacggggcggcuggccgggcagaggggcuccucaccgggcagaggggcuccucacuucccaguaggggcggccgggcagaggcgccccucaccucccggacggggcggcuggcugggcggggggcugacccccuaccucccucccggacggggcggcuggcugggcggggggcugacccccccaccucccucccggacgggguggcuggccgggcagaggggcuccucacuucccaguaggggcggccgggcagaggcgccccucaccucccggauggggcggcuggccgggcgggggcugacccccccaccucccucccggacggguggcugcugggcugagacgcuccucacuucccagacgggguggcugccgggcggaggggcuccucacuucucagacggggcaguugccgggcagagggucuccucacuucucagacggggcggccgggcagagaugcuccucaccucccagaccgggucgcggccaggcagaggcgcuccucacaucccagacggggcggcagggcagaggcgcuccccacaucucagacgaugggcugccgggcagagacgcuccucacuuccuagaugggauggcggccgggaagaggcgcuccucacuucccagacgggguggcggccgggcagaggcugcaaucucggcacuuugggaggccaaggcaggcggcugggagguggagguuguagcgagccgagaucacaccacugcacuccagccugggcaccauugagcacugagugaaccagacuccgucugcaaucccagcaccucgggaggccgaggcuggcggaucagucgcgguuaggagcuggagaccagcccggccaacacagcgaaacccugucuccaccaaaaaaguacaaaaaccagucaggcguggcggcgugcgccugcaaucucaggcacucggcaggcugaggcaggagaaucaggcagggagguugcagugggccgagauggcagcaguacaguccagcuucggcucggcaucagagggagaccauguaaagagggagagggagaccguggggagagggagagggagagggggagggggagggggagggggagggggagagaugauuuugguuuuuaaaaauuaguugagauggccaggugugguggcucaugccuguaaucccagcacuuugggaggcugaggcgggcaguucaugaggucaagagaucgagaccaugcugccaacaugguaaaaucccaucucuacaaaaauacaaaaauuagcugggcaugguggcaugugccuguagucccagcugcucaggaggcugaggcaggagaaucgcaugaaccagggaggcagagguugcagugagcugagaucgcgccacugcacuccagccuggugacagagcaagacuuuguuucaaagaaaaaaaaauuaguugagacuuguuuuguggucuaaaauauggucuauuuuggagacuauuccaugugcugaugagaagaauguauauuuugcagguguuggauaaaauguucuguaaaugucuguuagguccauuuggucuaaagugcaguuuaaaaucaguguuucuuuguuaauuuucugucuagaugaucucuccaaugcugagaaagggauacugaaaucccuaaauauuauuguauuagagucuaucuuuccuuuuagauuuaguaauauuugcuuuauuauauaucuggauacucugguguuggguucacauauauuugguauuuuuuagaucuucuugcugaauugagcccuuuauuacauauaacaacuuucuuuuucucuuuuucugguucuuaacaucuguuuuaucuaaauacagcuacucucacuugcuuuugauuucaauuugcauagaauaucuuuuccuaucccuucacuuucagucuauauguaucuuuauggguaaaguuuguuuguuguaagcagcauguaguugggucauuuuuaaaaauccuuucagccuacaccauucaaguggggaauuuaauccauuuacauuacauucaagguuauuauugauaggugaagauuuauuccugucauuuuguuaacauuuugucauccuguuuuuugguuguuuuuuauauucuuuuuucuuuucuuucucucuuauuguucaucauugcaguuuggugguuuucugcaguggauauaucugagucauagcucuuucucauuugugugucuguucuaccaauuaguuuuauauuuucacguguuuucaugaugguagauaucauccuuucacuuccagauauacgauucccuuaagcauuucuuguagggcugguguagaggggauaaauuccuuuaguuuuugcuuaucuuggaaagacuauuucucuuucauuuuugaaggauggcuuugcugaauauaguauucuugccugaaguuuuuuuuuuuuucuuuuaguacuuagaauauaucagccccuuaucuccuggccuuuaaguuuucuacuaagaaauucauuguuagucugauggggguuuccuuauauaugacuugaugcuuuucucuuucuuuuuaaaaaauuaucucccugucuuugacuuuugacugucugccuuuuuugggguugaauaucuuuugggaucucugagcuuucuguaucugaugucuauaucucgugcaagaauugggaaguuuucagcuauuauuuuguaaaauagauuuucaaugucauugcccaugucuuuuccuuauagaacaccaaaaauuugaguauuuggucaccuuguggugucccauaugucauguaggcauucuuccuucauuuaaguucuucucucugucugucuguaucucugucuuucucucucugucugucgcuuuuaugacugaguuauuucaaaagaccuguauacaaguucagaaauucuuucuagucugcuggugaagcucuugauuguauuuuuuauuucaauuauugaauuauucaaguauaggacuucuguuugguuccuuuuaaugauaucauucagauaugaauuguccugauuucuuugaauuguuuauguucuauuguaucucucugaguuucuuuaauaucauuacuuugaauucuuuuucagaaauuucauagauuucuuuuucauuggaaucuguugcuggagaauuauuauguuccuuuggagguaucacguuuccuugcuuuuucauguuucuuguguccuuacauugcuaucugagcaucuggugaaagaguugcuguuuguaauuuuauggauuugcuuucauagggaaaaauuuuuuuccuauagcuguaucaauaguauugguuggguagagagagugguuagguuuugauucuggcuggacacaguagcauagucucuguaugauauauuuggcuguaaucagcauuaguagugucugugaguuccuugguggcuuaggcugcuguuguuaguggaagcuguggugagauuuugugaaggauggggacaccagacaggcugguuguugagccccacugguggugguggcaccaggccuacugugucaguccuugggcccccacaugcccaccugauguacauaagcaccagugguagugggguuggaugggccaaucccugggccuccauguggcuugcuugggugccagcaguggcagugguaggccaggcaggcagacagaucuucuggcccuugggcagcauguguggugcugguaaugguaguuguggcuggucagcccucaggaccccaggcagcacacaugagugcuggugguggcugugaugggcuguggcaggccaguucccagacuccagguacugugugcagguggguucugguggcagugaugauggcaggcucaugcucaggcuuccaggaggcaggugcagaugcuggugguguuagacugggcauguuaaucaccaggcuccuggaugauguaugugggcaccagcaggcugggggaggccuguccucaggacuccagaaagugugaguggcugccagagguggugggcaagacagaucaauucccaggcccccgcuucaugugugcaggcacuagugaggguggugcuauguguggcaagccuguccucaggccucccgauguugugcaugaaugcuagcugugguagguggggcaaguugaucccuagggcccuggacaaugcacucaggcagugcuagugacagugguuggugggguggacugguccccagccccccuaaaaguacaugcagguggguggcagcccugaugcuggagguggggggcagguuagaguugcugucagugacagugaccccaaguaauggacucucaggcuuuugggagcacaugcuuuggcuucuuuuguucugaggguagcuuccccagugugcugcaccaguuguucccccggguauagacugagugagguagagugcuggggacacagccacacugcuggguccauccagcauuacaacaccacagcccucugaauggauauugggugauguccgcagggcugcaggaauguggagagcagggucuguuggccccagcacaggauguagucuuauggaggugggcucucaauaugguccugugcugaugagagggagggggcggggaccccacacacacucccucucuggagcaaugccaucacacaggcuccagagagcucccuaugcuagucucagggcuggcaaggguggaggggcugucuuguggcuaggauuauaggaguucacaguaggaauaugaaccacuggggaucucucacuuaacuuuuccuggcacuggggaguuucuucuugcucugagccaauccuggcugggucaucugcuuuaccucucucuccuucucagggguucucugucacuucccugcugaauuccagugguuucucuucgaugcucuauucaacaugugauuaucuacuuacuguacugguccuuuuaagaggaggugagugccccgucccucuagccagccaucuugaagucccucccucaguguauucuauuugaaguuuuaaguagagauuuuggagaaguaugaaugacuuguuugccaaaaauagaaagcaguggaaagaggugcuuaaaggaauauaaacaaaaccuguucuuugcagacuuuugcuucuguuugcaauugggcuuagcuauagacaggucugaccacccuagaauaauuugaugaugugguuuacccuccuuaucuucacuguuguucccacuuuucuguaaaauauuauuuuuuaaaauagaggacauaggcaguaacaauugauuaucugguuuacugaaucgcuggcuuuugauaaaauccagguggcuggacagaggcaaaaaucgguuucaaauuaauuguuucauuguugcccucugcugagucagaguuugaaggagaaaagugaaauucagugcuuccccugacuaacacauuuguucuuaaauuaagaacguauuaaccuuuuugaggucauccagccuuauucuugauguccucagauuuuucccguggucaaaguaccugaugaaucagugaagcucuuuggcucuuuacaauucuuuucuaaggaaaggaaaaccggaaauuauuuggaauaaugaaaaacugucucuugggagaauaugcuaaccuagguuaaauuuuaaugagggagauagggaagaauggagaugcucucaccuccaaguaauuuaaauuuagcucucuugagacuauuguauuuggagauagggaauaauggagaugcccucaccuccaaauaauuaauuuaaauuuagcucucuugagacuauuguauuuggagauagggaauaauggagaugcccucaccuccaaauaauuaauuuaaauuuagcucucuugagacuauuauauuuggagauggggaagaauggagaugcccucaccuccaaguaauuaauuuaaauuuagcucucuugagacuauuguauuuguucucuuucuaaucagaguucgugguccauauuuaacucuuguuucucugcuugaccuuucuuuaccaaucuuugcuuggucugaaugaauugguugaucaguuauccauugccaccaaccaucaguggcacacagcaauaagcauuuauugcucuuucaccuggggucagcugcucuugucugggguuggcuggcugcuggcugaucuaggcuggucucagcuagagcagcugagguggcccucucuguuucauguguugcucauucuucuucugguuccaguaggugauacggcuuggcugugggcccacccaaaucucaacuugaauuguaucucccagaauucccacguguugugggagggacccagggggagguaauuaaaucaucagggccggucuuuucugugcuauucucgugauaguuaauaagucucaugagaucugaugggcuuaucaagguuuuccacuuuugccucuuacucauuuucucuugcugcugccauguaagaaguacuuuucaccuccugccaugauucuggggccuccccagccauguggaacuguaaguccaauuaaaccucuuuuucuucccagucucagauaugucuuuaucagcagugugaaaacugacuaauauaguaggguagcccauaaaugcucuuuucaugucaaagguagaaacacaaaagaguagguagaaacuggcacaccauccuaccuggcacacuaucacuuaugccucauuuauagacccaaaaaggucccauggggcagggaaauauagucuuccuauuuuggggggacucuaaaguaccaugacaagaggcauggauacagggaagggagaaguaugggagccuuuauugccucaucuaccacaauuggcucgaagaaauuugccaguauugaaaauuaaauaaaauuuuccuucuuauaauuuaucuuuuucagaaaaccagaacugauggcucuauuugcagucuuucagacaacauucuucuuaacauugcuguccuugaggacuuaccagagugaagguaagaaguggaaggaacaguaaagacaaaaaucacgucgggaacaaaugaagucauugaugcuuugggaaaaaguuaaacaguucuuuuuucuuugggaauuacuuaaaauuccugaguaucucccaugaggagauuugucaaucucucuaagcagugguugccuuagucuuggccucugucaucuugauggcucucuuaauaagccacccuuugacccugacuuccuggucagugcacuggucauuagggcaguuguaaauagaccuaaucccauagaauuucaugauggauauauuuuaucagaccaucaucgaaguaguucuuucuguaccuugcugagaaaagacacuggauauaccacaccagugcugaccucuagguuaguacaaguuuuuaugucccucaacuauguucauugagaagcuguuagcuuaguaaaauaugaguaaaagcaaugaaaauaugaaacaauagaaacucuuucaagacucugaaagacaauaugcuaaaugcugaaauguuuuauaaauaaauaauauuugucacuuagcuacuccccaagggaagauauuuugagauaaauuaacuuuauaaauaaggucaauaagaauuuaauaccucuaaaauauuuauugauacuauauuacuuugaacuuguuuagaaguagaucuuagacuugaguuucuauugguucauaauuuuuuguaucuuucaucuguauuuuacaaagcuuuacauuuuccucuuccuguauuuauucuuugcuguacuccccuuuuaaaugagaguacagguguuugcuccuaguaauuauccaugcaguuccuguccacagauucaugaaaaugaucuuugcggggaauaugcauagaauuucucaucuuucuugaaacuccaugaaaauauauuuggaaaaaaaaaaggaaacauuguucugauaauugcucaauucucugucugacauuccuuucaucuggauuuauuuauuuuagguccagggcacaugggaagacacuacuaugcuguuucuuucagcaucuuaaaaaccauaguuugauguuagucucuucuaaucuggggcugaaaggugggaauuaggauuucucauuuguaguauguauaccucucgcucacucugucuuacuugcuaaaaucuaagcacagugcaaccagacugagaggucaaaccauauaauaagaaugauuuucuuuuuuuuuuuuuuuuuuugagacagaguccugcucugucacccaggcuggagugcaguggcgcgaucucggcucacugcaaccucugccucccagguucaagcaauucuucugccucagccuccugaguagcugggauuacaggcacacgccaccacgcccagcuaauuuuuuuguauuuucaaacagacccacugccccaccuccagguguaaccgaaaugcagguucaguugcuugcagcuugcagaguccaauuaaaaugagcaaggucugguauaaaaauaaaaccgacuuuuuauaccaaagcuaacuuaggggaauaaggacaagcuuuccuccuuaaagggacugcuuugcuuuuggaguagaaagugggcacuuuuaaagcagggggccuaugcaguggcagaagugagcagguaggggucugcauacucacuuuggugccuuaucuacugguuaguugaguugacaucuucaugggcagaaauaggcuguaagguggcugaaaauucuccaggugggagagaguuucacagugggcauacuuuggguuguaaaucaacuguuaccucucaaggcagucuccuggugggugagaguuccucucuggagcuucuaagcauaucauuauuaacagaugaacuugccuuguagggagugucuggugaaggggagauaaaagguuauaauugcauuuccaaagggcuaaguaggaaguggggaacagagggaauuggggaaaagagaaaauaauaaaacaauaguaacucauucuccuuuucuuagaaaaaugggguacucgguuacacagggucuccaggaaaucccaggcaucuaacucuaagcuuucagcccagcucauucucuagugaaguucccuuuucugauccagcacuauuuacuaugugccuucuacauacaagccacucuauucucagagcaagcucugcugcucaugcuuucagcuucuuuuguuuagaucagacaugcauuucccuguuuuucuaucaaccaaucuucacugcugcuuccagcuuucucugucaagcaugccuucuuugguaauuaauccugucuuugcccugaccuguacuauuuggauuucuugucucaauuucugcugcauuuaaccaaguacuuacuaaacucccacucaaacuauuuggcuuaccacuuaaucacccagccagauacagaucugaagauuuauuccaaauaaccuggcuuaauuucuccaaucaacgaggcagagccaagacuuucuucaguuaacccuggguacauguuuccaucagccagagauuaugacugcagcaauauuuuccucugucuguuguguauauguacauacagauagagauagggagaugaauacauaguguguuuuuaaauaaaaguuaaauuauaguauauauauaugcucaggauuuuuuuauuacuuaaaacaauuacuacaacauaugaugaguguuuuucuuugauauuaaauguucuucuagaaacaacauuauuuuuaauugcugcaugauaucccuucuuaugaauggacaaugguuuauuuccuugaguaguguuguggauggucagagaaacaggguggggaaagugggaggagaguaugugauuaaguccuggucugauucccaaaccuggccuucuuggccauacuccagcauuauaaaaagagagcuggacagagacccaggagcccuagguucuggucugauugugcggcuguggcaaagucacuucccauuuuuuaaccucaauuuccucgucugaaaaauaaugggauuggauuuaauaaucuuuaugauucuuugaucccacugacuuaaccuuggcauuuuccacuauuucccaaggaaguccuagauugcuuuuaaccagauuauuuuugacugaugucacuugagcaccugagucauucagcacucacugauagcguauguuaauauaaggcguucuucuuuugucuggagcuuccagaaguaaaguuuagacugauaguugacucaugcauucagcaaccaaucgcugaauaccauaacugguauguucuuagucuugguuucucugagcugaguaaggcugagucucaaccuuguuucacucacagucuacagggagacagacauagaaacaggcucuuacagcauguugcaaucagugcuccaaacaagggcuuaggaaaucuaaggaggaauugcacauucugagguaugauuauaguggagugaaucagauagcuuaaggaaguauuucuuuuauauuauaacuuauuauuugauuuucaaacuaauacauguuucugaagaacauuuacaaaauaccaaaaaguauaaagaagaaaauuaagaucacucaaccucaucuuccagaaauaauuacuguuauaaugacuguuaacauuuuauuuuuacuucccuuuauuuguuuaaaaaaaauguccuuuaaaaaucauaaaaugggguacauguuccaauacauuuuuaaaaagcgcaugggaaaauccaauaaaaauauauaugauuuaaauuuggcaauagaaugaaaagaguaggauuauagaaacucaauuucuguguuaugccagcauuuuuaucaugaguaauuagugacauugauucaugauacucauuuggugaguaaauuagcaauauuaguacauucacaauguuaugcaacaaucacccaauucaguuccaaaacauuuucauuaccccagaaaggaaaccacugcuuaagcaguuagucuugauuccccucucucucagccccuggcagcuaccagucuacuuucugucucuaugguacuuauuauucuggcaauuucauacaaauggaaucacaguauaaaaccuuuuguaucuggcuucuuucacuuagcaugauguuugugagguuaauccaauuguagcauguaucaguauucaguuucuuauggcugaguaacaguccuucguguguguauaccacaguuuguucaucuggucauccacugaugaaaguuucaguuguuuccaccucuuggcuauugugaauaacgcugcuacaaauuugugggcaauuauuuguuucaauuccugcuuucaauucuuugggauaucuacuuacaaauggaauugcuggguuauauggugauucuauuuuaacuuuuuuguuuugaagacagggucucacucugucacucaggccggaguuaacuuuuugaagaacugucaaaacguuuucaacaagguggagccauuuuacauuccuaccggcaguguacaggggcuguaauuucuccacauccucgccaacacuuguuauuuccauuuuaaaaauuauuauagccaucuucaugggugugaaaugguaccucuuugugauuuugacuugaauuuccuuagugacuaaugauauugaacaucuuuucaugugcuuguuagccauuuauauaucuuccuuggagaaauguucauucaagucuuuugacuuauuuuauuuuauucuauuuuauuuuauuuuauugugacagggucucacucuguugcccagguggagugcaguggugugaucacgguucacugcagccucugucucccgggcucaaaccauccuccuaugucagccucuugaguagcugagacuacacgugccaugacacccagcuacuuguuguauuuuuuuugguagagacaggguuuuuccauguugccgacucuuuugcccauuuuuaaauugaguucuuugucuuuuuguugcugguuuguaagaguucuuuauguaguauggauacuggaaccuuaucagauauaugauuugcaaauauuuucucacauucuauauguugucuuuucacuuuuuugugauuguuauuugaugcacaaacuuguuuauuuuauugucuauuuguuguuguuguuguuguugcucauacucuggauucagaucuaaggacccacugccaaacucagggucauggaauucacgcugagauuauaguuaucacccuagcccuucccagcaucacauuuacaaaauaucacaagguaacuuucagggaagguagccauuguggcucccuuuccuuuuaugggcauucuuguucaucucacuuucauagaaugaguuuucugagguguuccuccaaauucugagguuaugccucauuugaaucugaagcuuucuacuauguggaccaaucacaagaaaaacaucauguuugucuuguauccaccaggaaugcuccucaguuuaucuggcuccaugcagagccccauccugucaccuguguccugaccaugguaggacuuuguuguuggugccaugcaaaauacuucucagacauuccauuccgugcaaacuuugacugggccaaugcuccugucuuaacaguuggaggacaguacagggggacacagguguugguauuagagagauuccuauuuaauuucacauugcuuuguauauguuauuuacccugauugagcuugaguuuccuuaucuaaaaaauugcugucuaacaguuuuauaguaggcauugcaugagacaacauaaguaaagacccuagcacugugcaugguaaauaacaugugcucaauuucauuguuguuauuuuuacuucccuaagagaaaaauagcaugugcagaauggcaauuuggggacauuuuuucaguauuggagacuguuuccauuguuuauuaucaaaaugagauaaucucuuaccauuuaaacguaacguuugagggguucaaaugacaaggggaaaucccccugaaacuagaaaacugaaugcuuaaaagaugauaucucuuacgccaugagucaucagauagcagcugauuuuaucgaugcaggcuuuaucuuuucaauaccuuuguaccacucccaguuuacuucugauacccucacaguugaaauaguugaaucagcaauacacaauuauuuuacaaucuauaugguguuuuccuccucuuaaguggaaagucaugauuuguucuucuuuaagaaucagcagugacuuaacucacuuagucaggacacauucucucucuaguggcagauauaucugcuuaaaccucugugugcaagccauuugcaguggcgccauuggugguuuaugcagucagccuaagagauaggcugcugcuucccaaggccaccaacuucagcaaaucuguuucauguuugaauuccuauucuuuuacagacugugucauaccacuaacuagucuaaaauuccacucucuugauuauuucauaugaguucaucaugucucuccaacuagcuuccuucuuugagcuaggaaccuugucacaauuauuuuauuucacaucaaauaccugguauguugcuggucucaucgaaagaguucagugaauucuugcuagucuuuaaguuaaauacauugagacacaaaugaccaugucuacagauaauacaugcucccacauuguagucuuuuaccaaacuauaaaauauugacuuucaaaaaggaaacuuucauuucugauguucagaaauguaacauuuccaucaaaaagucuucuuucuuuuuuucagccuuguuauaaauuucccaaccgguuagauuguccaauaaaggauccuucuguuuuguuuaccuguuuaucaauguaugagcuugcuguguauuauugagcaagucauuucauucaucuagaucuuaauuucugugucugcuaagugauuucuaaauucucuuccagauuuccaaggugucugauucuaggaugcacauaugagcaauauuuuccagagcuaaauaaugaugauauucaaguuuaauuauuucugacucuucaaucaugcuccuauuaaauauuauuucauacuucauuuugaucuuuucagucuuggcugaacguuuaccauugacuccuguaucacuuaaaguuuccaccaauucuacgcgucagaguuugcacuuacaauggacuguccacaaccuuccuuaucaucaggaauugaaaaugguauuucagauccagaucaguaggauugaaacauccaaugucaucugggugguaaguaauuuuuuuggcucaauauuuaaaaaaucaucuuuaaaaaaagacaccuugguuuucuuuuauaacaucugaaaaauucucguuuuggaaauauauuagcagcucaaaacaguuugucuaaacaauuacauuucugcauuuucuguuaaugauccaggacaaaguaacaugacaacuuugguuugguagguaggaugggaugcacuaagaaaauagauuuucucaguuuugcucugucuucuaagaagacuguugagucuguccucgugaauacugaauuccagagagccacgaagauuaaccaauucauuccuccuaccucuuucuucuccguccuccagagauuuuccuaaauaagauguaauaauuuggcaacauuuuucuuuccaauguagcuuccugagaguuucuuggccuauacccagcugaagugcagggaagaguaagugcuagcacuuaauguuccauccaacaaggagccauguuggagaguaacuuccuguguccuuuguugccuuacauguggcuuuuuccacaacaaauuaaauuaagaaaauacugacuuucacacucuuuuugucuuugaauucuuugggguggauuuuucacuuaguucaaaugauuauugggucaguuuugccugagguguccccaucuagugcacuaggacacaugagugguuuaugauuuccauuucucaucugggaacucuaguaaucuauaugcacauaauguucagucauuuucacgggauauuuaaggacaguggaauguuuucucauuaaaggaacugaaaauuuuccuacagguaagagaagccuaggacugugcuugggcccucugucagcucaaccaggcuccugucuucacccagguaguggaggcuuuggguacacacauacagcaugguuaguuccuuugguaaggcauacaagucacuaauuuuaacaucuucaguuacuuuccauauucauuauugaaauuugagaucugcgcaaguuaaauaaaauuuugacucuguccacuuaggauucauaccuagucuauaauucuaccucucaaagggcaguuucccacaaugagacuuauuuaguaugaugauuuucaacaacagcaauacuucuguguagcuguuuacucccugcuaucaacacaucuuuccacuaucucaccuuauacuagcaagucugauuuuuguauuuuuaauggguacacuuguugguaauuugggcccgguaaaacauugaagcaaaggucauauugagacuaaggauuaucuacaaaaagaaaaauugagguggaagugcuggaggaauuguggaaaacuagcacuuagcaccguuagcaaaaauaacauuaaccauagacuacauggauccuauucuuuauuuuuccaaaagacaacucauaucuauuauuauguuacaaaaaauaauauuagccauacaccaaguggauuuuuuuauuuauuuuccuaaaaagcaguuguucauaucuguuuucauauuugauucccguaagaguccucuuuucaagggaaagcagcuaguguggacuauuucuguaaucuucuagggcucaagacccuucaggguagaguuuugccuugucuaucguguuguccucacaacacccaacccagccugacuacaacaguggagaaaccacagcacagagagguuuguuguguugcuccaggugacagaggcagggugggaucauccuucacuccugugcccagaaagggaugacagucacaugcagcccccaggccaucgguggacacauguccuauggaauagaugaugccuugagaaaugcuugucugaaucacucaugccugaaguugacgagaacuauccuccuccaguuaaggaggaggaugcugcuucuguuuagaccaaaaucucccuuauacagggaagcucccuguagugcaagccugacagggcacucucauucaugcugggggcuggggggaagcuucuggacucaaugucucggacaccucuguucccaaacaagucaaaggaagagcacuugcagcuggaccagaggcaccgaccugucuccuggaugguacuggccauuuggaacccugaacugcaugguccugcccuccugggucaugguccuccccuucccuuugcuuuuugauuuugucaauggcauaggaaggcaaaguagaguaagagcucaagcuuggaaggaggccaggugugggagucaaaugucucaguaacaaaucagugaccucuauuagacuucuguguaaaugugugugccaauuucuugugacuuacugaugucugcaaggaucaaauuaaaccugccacuucaauaaaugaaaugacccaaagacaauucaucauauuuaaagaaaaaaaaucaaugaauugcaguacuuaaggaaaaguuuuaucuccuacauuaacagggcuguaaagaccacaaagcagaaguugagguuaaacagguuccacacauaaauagugucugggggaaauacaacucauugcauauuaaugaaaugauuaaaucauucaguccagaguuuuagccugugcucccagaucaggcauugugcgcagugugggaaugucagcgcugagcacacuggaaagaaugaggaggugaacacacgcauaggguauucuacacacgggcugugugugcaggucacugaugagaugcuaugagguucggguuaggccucaccuucucccacaauuuggauaaagggcuguuugagaccaaauauccaagaggauagaaguuacuuuagcaaguagaguagaaaagagugcucugagcaggcccaacaggcaugagcagaggcgcugagagaagggaauuuccaggccugaaagcccgcuguggugcuggauccccaagcacaugaggacaggggcacaggccuagaugcacaggaccauggagugcaugcucagguuuuguuuuuuuaucccaagggcaauaagaacaaaggaaguggcaagcucugauuugaauagccgcacagcggaaugugguggggaacuggggcaagggauguguggccgcuaggaagcgagcuguaggguucagccaaagcggagaugcggguaagagaaguggcugcauuuaagggacagaagggagguaaaguucagucugugacuuguuggcauuagagcgaaguugccauuauugauguacuuccuucuagcaggggucugggggaagagaggaaauauuugcuccuuuuuuuuuuuuuuuuuuugagauggagucucacucuguugcccaggguggagugcaguggcgcaaucccagcucacugcaaccuccgucuuccggguucuagcgauucuucugccucagcaucuugaguugcugggauuacaggcacgcacuaccacauccggcuaauuuuuguauuuuuaguagaaaugggguuucaccauguuggucagaccggucucaaacuccugaccucaugaucugccugccuuggccucccaaaguccugggauauuugcucuuaaauuuuaaaaauauuuaagcaaaauguacuugacauugcucauguuaaauagugaggguuucauggaucaggaccucacaacuuguuaaggaacauauuuugugaucuaggaguaaaguaaugcaagaaauggaaauaaaauauaaacauuuaaaaaaacacagucugcagagagugagaaaggaagcccacaauuaaaugcccccuggguggaccaggauguuuucagcccagggcuggguuuaauucugucaggggcacuguuucaaguuugugaccugaauagggggcagacauaauuaguagaaggcauccgaguugcuaacgccaagcagugugugacaugugacuugucccauccccuucacugaggacuuauuauucgcccuuagaaacauggaugcagacucgaacucagguucccccaguaagugucauguguguguugucuccaccuugcagcuguggggcaggaaacaggagcguuggaggaggcacacugaggagaaagcaugccuggagcuuugggggacaugaagaagagaacgugguuccugcucccucgggaccaugcuagagucacagcugauauaccaacagcuagccgcaguauauaggaggggcucagaagggguggagacaagaggaaugcagaggaaagagcaagaaagccuucaugaaagagaagggacauaaccuaggcuugaagaacaggacagauccccauacagcagggaguggaagacaccaaaccaaagacauugccugagcaaagacaggucugaaagcauaaggcauauccagaagugugggggaggugcuauguuuggagagacgauuccugcaagggacugguggguuggagccagauuauagaaggccuugcaugacagggcaagguguaaacgggccuuugaagccuguggaauuagagaauggaaaugccagcaucucagaaagaugaaggcuaaaggcugugucaaaagcccaaauuacagcucaacuuagacaagcuuccuagaaaacaguguaagacauuuugugucacugacagcuucagggccuaagagucugacagauggagcccaagagauggaguguggccauguggccaccguaucugaaaggacaagagacagaaaaccaggggagacucagagagccaucuaucaacuuccgagagaaaauggaacuucuggugugccaugaaagacugcuuucuugacugagauuugaccauccuaauccaaaccuugcuaaagaugaauauuuuuuaaaaacaaacaaucuuuuuuuuuuuuuaaaggaugacuguguuaauucucuacuuuucaagaacuuucuuagcagauucucugggacuggcacagugagcaccuucugucucugaucuguucccccaagaccugaguagcuucuguuuucucucccgcuuauuccacaugaguccccgggaauuggaagaccauagugauuggaagcugaguuuucaaaaggcaggaggucauagcuggcucccaugcgaggcaucagaacauggggaauugacuagcagaaguggaauucacuggcacauaucguggaccugcaauggggucuuagguuugugcuuugggauaagucaagucaagcuauuuuauaggacaagauggcuaugugucuccaauuguuuucucuuugcuuuuaggggaauuacagcaccacugugaaguggaaccagguucugcauuggagcugggaaucugagcucccuuuggaaugugccacacacuuuguaagaauaaagaguuugguggacgaugccaaguucccugagccaaauuucuggagcaacuggaguuccugggaggaagucagugguaagaagugaggugguuacaagagugaaaaggguuaauauauuuuuuaaugaggagcaauagucaaauaguggaaaucuccuuugaggaacccuggguagacacugacauuauuuuccuuuggcuccuaugggaacuaaaaaacacaggugugaaacuuggcacuggaagauauagucugaagucuugcuccugaacuuacucauugagauaguugugcagauucaggcaauuuuguauuuguuuucaaaacauguaaaguuuguguauuauaaaugcuaagugaacaaagcaagacauaaauuguacauauguauuuauuugagcaacacaaaauguguaugcgucuagaguagagguugggaacauuuuucugugaaaggccagauaagagauaguauaagcuuuucagagcauacagucgcuguugugacuauucaacucugcuacuguagugugagagcagccauagauaguguguaaaccaaugagacagcuuuguugauagaaauuuauuuacagaaacagggccaggcaugguggcucacuccuguaaucucagcacuuugggaggccaaggcggguggaucacuugaggucaggaguucaagaccagccugggaaacauggugaaauccugucucuacuaaaaauauaaaaauuagcugggcauggugacgggcaccuguagucccagcuauucuggaggcugaggcaggagaaucgcuugaacccaggaggcagagguugcagugagccuagauuacaccacuguacuccagccugggccacagggcaagauucugucucucacacacacaccaaaaaaacaacagaugguggacucaaauuguagcucccccgaaucuagacggcgggguggggggaagggggguggaauauggaaaaaugaaagugguguguuauuugaaaaaugagauuauuugcgcacguuaaacuaauaauacuaaugagauaauaauaauugaauuaaaucuaugaccuagucacuuuuuaaaguacuauacauauuuaguucucaugucaguccuauaaaaggacuucuuauccucgcuucacagauaaggaaacugaggcacugagagguuaaagaagccaugcaaggucaccacgccacuaagugcuggagcuggaacuccaacccagacagucuggcuccagaggucaugugcuuaacuauuacauccuacuauggaaagaaggacacauacacagggaaagaaaagauauuaaaaagauaguaagagguugggugugguggcucacaucuguaauucuaguacuuugggaggcugaggugggcggauugccugagcucaggaguuugagaccagccugcacaacauggcgaagccccagcucuacuaaaaauacaaaaaaucagcugggugugguggcacaugccuguagucccagcuacucaggaggcugaggcacaagaauugcuugaagguuggauuuuuuaaaaacuuuuaaaaaugaauguuuuaaagaccccucacacuugagggacucgcauuucugagaagguagggagagauaugaucuccaguacaaugaagagauuacgagggauuuuggagaugcauagaccuugccagucugaauguggcuuugccacuuucuaacugagcaaacuuuggcuaagucuuaccugaccuguuguuguaagguacuaagaacgacaugagauaauguacauaaacacuuaacauggccuucagcagggcugggacuugauagaaagcaguuacaauaacccagcaauagcaaucaugcaauuaucagagugguaauaguaaugugcugucuguggcaguaagagcaacagcagugguaucaguguaacaauaggagcagugguggaaaggauugucuugcaugcaccagaggguagagguuuggcagagaaauuuagguugcuauuuucuccaggagguagaaaaagcuaaaguuaucugcugaaggcaaauggauaacuuguuuuaagaggcuugaauuuugagugcgauucuaacuuggcuauuuuuuuuucuugcaguacaagauucuacuggacaggauauauuguucguuuucccuaaagauaagcugguggaagaaggcaccaauguuaccauuuguuacguuucuaggaacauucaaaauaauguauccuguuauuuggaagggaaacagauucauggagaacaacuugauccacauguaacugcauucaacuugaauagugugccuuucauuaggaauaaagggacaaauaucuauugugaggcaagucaaggaaaugucagugaaggcaugaaaggcaucguucuuuuugucucaaguaagugugcaaauucucuguggcccuuucuucucauuuccugaggaauagauuaaaucuccuuuacuagaagacaaauaaacauuucuacccaugaucuugauuuucuuuuguuucccaaguuuucuaggagaggcucugaagucgauguccuuuaguaauauuuccaggauuuccuguuguuuucuuguccuuacugagaguuguauuccuagaaaucaauaguauuaaagaagacacaguucaggucaugaccuggaccacugggaaaauacccuuuuuugcccagccaugcuggaauuacuucgggaucauggagggaggguaggagcuacagauuggacaaccauggagucagccaggauuguggccuaggagaccuggguuugaaucuucuuucccuggcugggugugucaucucgccaaguuuccuagccucucugagccaguuuccuccuuuguaaaauggggacagugauggugauugugaggauuaaugaauguggguagugccuagccccaguaauagcugcaugcaguaggagaucagcaaauggaggccauuacuguucuuaacugugcaguaaauugguuccaucggauacauuaguggagugggaacauuuuuuuauauagguuugugugugcacaacuaguggccuccuguauuuugagcaucuccuucccuugcacaguagggaacaucucccucccugccucccuugccaaagucagucuccagucuccuggaugccugguucaucuauguccccuuagcaugaccacuaagggcagcaguaacgcuggggauuuggaggugcuuugccauucccugaacacucagcuccugccuguugaauuuagcagguguacaaaucugacugauuuccuugcauccccgaagcauucugugagccacagcacccgaaaugaaacauuggcaggcacuggggauacaacccuugucaaauggacauagcaucagccacuugcauaacauggaccauccaugcccaugacaucucagaaaaucacaagggcaggaaggagaaggggccaagaugaggugaccccugaaaagugacuuuuggaggcuguugauagguagccuuccaccucagugaccccuuccuuguucacaguaacucuguggcuucagacucuaaacagagcuuuccauuuggcuuaucuuccaauaaaaagauuuaacuaggucuguuuuccuuuguauggacagaaguacuugaggagcccaaggacuuuucuugugaaaccgaggacuucaagacuuugcacuguacuugggauccugggacggacacugccuugggguggucuaaacaaccuucccaaagcuacacuuuauuugaaucguaaguuggcucugguuacauuauugacaacuucuuccuugcuugaggugcuugugacaacauggcaaaaaucuacacuuagauguugcaggaaauuugaacaaauauuucagaaccaccugccaaggucaagaggaaaccuuuaaguggugacaagugucuaauacuuucuaccugagguuuuuaaaaaaggaacauuuagcauagcaugguaagaaagacaguuaauguauaccuugacgugaaaauaguccugucugauaaucuggguuuacccaauuucugacuuuuuaggaauauuccaaguaaauuaagggauguucuugccacccacggggagucagugauucauguuaagacauuucagcacguaugucaaauuuguagaaacaauauuuucguuauugguauuuguuggugauggauggaucaaugccauuauggggaacauaguuugacagucacugaguaugcccugagggauaagggauacauuugcuuugacaaaaguaaaaaccucguaaugguuguguuauuuuguuuuguuuuuaaagauuuucuggggaaaagaaacuuuguacacacaaaaacugguguaauuggcaaauaacucaagacucacaagaaaccuauaacuucacacucauagcugaaaauuacuuaaggaagagaagugucaauauccuuuuuaaccugacucaucgaggugagacuagaguugucacagcccaccguggccacuaacgugucuuuguuucacagacugugugaucaaguaaaugugcuguagaucuuugccucauucacagcggaggugagaguuagaauuuauaccuauuguucaugccacguuucuccucauggaugcacgcauccccuauuauuuguuucuuuuaauaaugucacgagcaccaaugagcuuacuacccaacuucaaaacuaggacucuaacaauaacuucugucauaucucauccuguaacgcccccaccuucgcuccuuccgccaagauaauuaucacuuuaaauugugugcguguguauucucauuucuuaugugaugguaaaaaugccuuuauuuuguuugguuuuaaugcauagaaaggacaucaagcuguauguaauaauucaguaauuauguuuauauaauauuaaauugcuaauauuugcccauauuguuuaguguugcuguaguccauucacuuuuacugcugcguaguauuucauuguguaaauauuaaauauuuuauucaugcauccccuuugauggauuugcagguuguaucaaaguuuuugcucuuggguacauguuaauaugaacauuuuuauacaugugucuaguacacaucuacaauuguuuuucuugcauauauacuuaagaguuggaucagauguagaauauguucaacuuacaggauaaggucaaguuguuuuucaaaggaguaauaccaauuauacucccacccuguagauucauauauucuuaccaaguugguauuggcacuuuuuuguauuauugccaauuaaauggcuauaaaaugguauuucaugauagucuugagauugaaucucaugaguauuuuggccacaucuguuuucucuuuuaugaaaagcuuaugcaauuugcacauuuuuuguugguaagaauauucauauauucuugauacugauuguuguccauuucuuuacuacuaauaccuucucccaauuuguaacucacuuucuuuuauaugucuauugauuaacaaaaguuuaucauuuuuaaagcagauaauuuuauaaaaauauuuuaaagguaucauuuccuaccccaagaucagaaggacagucaccuauaaguuuuuagcaagaaguuuaaagguuuuuaagaagacaaauuccaaauccaucugggauugauuuuuuuauauuaagugagauaggguuaugacacugauuuuuucuguuugguaaccauuuuuccauaucuguuuaucaaauaacucuucccucccuaugaucugacaugccaccucuuucacuauuaugaaaguguaagagaguucuggauucuuaauuccacugguuggucuguuuauuccugcacuaguauuacacuaacuuuuaaaguuucagaugagucuugacaucggguaggauaagucucucacccuauucuuuuucagaaauauccucacuauucuuggugccauacucuuuuauguaaaacugauaauuaauuuaccaaauucuaugaaaaccccuccugggcuuuucaugggauuugcacuuaaucuauaaaugcaacuuggagagaucaaaaucucuauguuacuaaaucuuccugugcguggacauaguauauuuuuauauuucuuuaggccucuguuaaaaucauuucauaaaguuuuaaauuuuucccuuguauacuucuugcauauuuuuugugcuacugauacggcuccaaugacuggaggaacaucaggguucuucguuucgcgccgguuuggauaaaacgacacagacacacguggagugguuuuaaggagugaaaaguuuaguaggcaagaaagaaggaaggaggaaggaaacagcuccuccaugcgagacagacggaggagggauuugaacaaagagaaaaccccaugugcagcagaauaguggcugcuuauaagaggaagcuggaggaguugguuucugauuugcauagggcugaggggauugguuugaccaggcaugucauucacauagcacagggaaaaacuggcccucccgcccuagccuuuuaauaugcaaaugcagggcaccuugauguucugcacacguggggauaugugggggcugccauguugcuaggcacauguuggggcaaggaagaaggcggcccgaauugccauguuuggguggacccaguuuguuucuaauggccagcauuugcacacugaaguuugggugggguggcggggguggggucgagggagagguucuaagagccagggccuuucugcaagacaggaaacauuucuggagcugcuuuaaaagaaacaaaaacuucccaaggaccccuuuuaacuccuauaacacuauaggcacuuaaaaauuuccugaaaacaguuaaaaucauuguuagcauauauccuucccucuuuucuuucuccauuuugaaauuuuuaaauuuuaacuccuuucucauuuaaaaauaauuguacuauaucaucauugucagagcacauagauauuaccuguuacaucaucucccuuuuaaaucuugcugcaucucguaaguccacaaguauauauguuuaauguucaccauuagagcuuaugcaaauauuucucuggucauuuugauuaucugaaauuuauucccuaguaccuucuucagaaaauguuuaugggaacaacaguccccugaauuuuugaaugucaaugaaaguuuuacucuggucguuguauuuaauggucaguuugaauagauauaaaauuuuuagcuuauauuuucuuccuugaguaucgugaauuuuauuguugcauuuuuuuuucugacauacagcaaggcugaugaaaagccuaguaguaaugauaaucuauuuuuuuccccauuagaagucacuugguuuuuuugccuagaugcccagaggauuuuuuucuuuuucuuuaaaaccuuugucuugguguuggcuauucuagguugauguguucaguaauaugguacauucuuucaauauguaguaucaaauauuuuuuuaauucaggaaguuuuuugaauuauaguuuuugguauuuguuuggccgccuucccuugguguucuuuuccaggaauuccugcuaacucuagauugaaucuuuuuucugaucuuuaauauuugucgcuuucucuugaauuacuuuuaucccuucauuuauuuuauuuuaaacaauuuuuucucccuuuaccuccuauuugcuuaagaaauuaucuguuguguuuuuuugcucugguaacuacuuccaguuuaacgucuucaauuuugaauuuauuuuuuguuuuauaucuauuucuuuccugaguucuguuaccucauccaugauguuugcuaaaucugauuuauauuguucucuaauaucuuuuaucacuuuuacaaugucuuuuagucuauuuugaaguaauugucuuaucaucauauucauuucugcuguaucugugguuguaucuucuuuuccauucacaauauuaucuauaugugccuuugcucuuauuauuugguaaucuugcuagaaguuuaacuacuuugauuucuuuuugaaaagaaaccaauuuugcuuugaaaauuaauucuuuuuauuguguuuuguuguuguugaauuuccacuguaauuuuuauuaccuguuuucuucuacuuucuuggauuuuuuucuguuguuccuuuuacuuucauaaguuggauauuaguucacaaauaaaauauuuaaagcuacacauuuccauugaaaugccaguuuuauggcauccacaacaguccaauaaguuuuaacuuaacauugcagugcuuucguuauaacaaacuauauaugauaccauuucuaauccaugaauuaauuuguguuucaaauuuucuaaaaugaaauuuuauuuuuuuguuauuaauuuuuaacaaaaauucacuguggucguagaaggugucuaugugauacguguucauugaaauuguugagguuuguuuuaugggcuuguaccuugcugaaaguguggucuauggaccagaagcaucaguaucacguaggagcuuuguagaagugcagaaucgcaggccccgccucaguccuacugaaccuggcaaauauacugaaccugagucuguauuuuaacaaggucaucaugcauggcagacaaagcaaaauuuuuaugccaggcagaaauaacuuauauuauugcucugaacucaagauuuugacuuguuaaucugagagccuaaauuuuuauaaacauuuaucuaguucuuuucuuuuuagauuuucagucuuuuaauuagcuauuauaucacccuaagcaacugcuagcaaggcaaaccuaauuuuacauuucugaaaggaugacucuuagguguacaaggcuagguuguugguugccacagagcuguuguaauuugaaagcccccucuuuuuuuuuuuuuugucuuaucuuggcugaaaugccuuaagaaaaacuucugauugacuuuugaaauuagcaacaguagaauaucuuaacucaagugaaaaagucaauagauucagaguaagcagagaagaagaagaaaagaaaaaagagauaaagaaguugggagccucuauauaccagcauuuaaaaaaauucuauaguuguaguuucuuaauuugguaccgagaaaaacaagccuggggacguugaaugauucuuaagaugacuauugacugaaaacugugcacaaggaagagccauguagccaggcagaauacuuggcaugcccgaauacugggggaaucccauucuauuugcucuuaaucucuccagaccaaaugaauccuauaaauccugucagggaaugacagggauuuagaccaguguuuuagauggugauuagccaccuuaguggauuuuaauuggccaucgcguggccacuauuuacaauaucuuuguucucagaagacauugaaaagcaagcaagagaaaaagagccaaauuauuuacagaugcacauaaccaaaucaaaaugaaaccaaggucagaguacuugcaaaaauuuuaacucagaugugcagagcaaacagaauauuaaaucaggugugcagaccaaacagucugauuuuguagaaaucaggaaggaggcaaggugcucccaggaaggaugcaagguccuuucuuaagauggcuuuguuucuaguucaagaggacugacuagacgcagcuagugugcgcugcucucacagagaggaaacaaaauggucuauaaauacuagcucuuuaaguggauugucugagaccucacaucaggauuuacaaaggaggcagcaggccccauggagaacagagaugagcaaagcccaggcagcuccuacugggacugguguggagccaggggaggcucccuaauguggggaaagggugaacaagugagaguuuugggggaauccacacuuacaccauggaccuuuguaauccugggcacaugagaacccaccugccccugccccaggccucuggacuaacagagaacugccuggagucuuuagagagguaccauucaagaccacauggagcuccacaggccuuggaucccugagcaaccuggugcuagcugcuguagccccaauagcggccauugccacggugcggaggaguggccagacugucccacugcuccucacuaagacucauugguuugggcuucuagugcagcaaccgcaccccugccugaacacuauggccaguguggcucugcguuccuccaggaagcacccagacugcagaucacaugaucccccaccccugccgcccuucuccgggcaaggcucauggcuugggcuccagcacaauaaccacacccucaccugaacacugugggcagucauggcucugaguuccucuggggaaaaacucccagagguaguaagguguggcacccgugcgugcccccaaaagugaaguccagcaucaguuggaugggaggaagcaggagcaugucaugcaccccacagcugugugucuucauugcuucagcugagaaauccugcccucccuggugaagggcccauagccuaaccucccugccacuaccugaacauuucagcuguggcccagagcccuucugaaaacccagcccccacuggccugggauauucccuugggcucccaccaucuaaguguucugccugccccugccugagaguuaguuuggcuggagaccugguggccagccugccccaccccaucauagacagcaccugaacuccaaccccagucuagccccuucagaacucauacauguuguccugugggucaucuagcucccugggaacuguggaaauaccuaucucacugcaaccacuuccccugaagccugagauuaggcugacucaacuagccaacaccaccguaaccaacauccacucacgugggcccaaaggugauguccccccauacaagaaguagcaguacugccacaucggagaacagacaagccauaaagcuaucuguauuggguugagucaugagauuaugcugugaaaccacucccacagagucacaaaacagacauuucccauggcuuucaaccacauuguggacugcagauagacuacaagguacaccugaacuaggagucacaaguccuagaacaggggagugauagggaaacaacucaaguuccugccuaucuaggauggggagcuggugacgccaccuuacccccuaccccuacagagaccuaagugcacuuacaggagcuucuucuagccacccuugccagggcuagugcuugugcucaccauugggguauuugugggcaagccaggggcuccagcucugcccacauuugucacccuaccucugcagaacaggaaccccagaguacugggcacucuacuguccagggcuucaccugaaaaaacagagcacuucacaguaaacacagacaggauacuuaccugccuacuuguguagcagcuggcucuuacccgcaagugucaucuacuggccuauaggccaagccaugcagcuccaaaugaaaccugcugacagaaguaccuagggcuauaggugcaaagccaaaagaccuuacccccuccagaugagaaggaaaaagcauaagaauucuggcaucaugaaaaucgaaauguugugacaacaucaaaggaucacucuagcuccugaacccaaauggaaacucagaaaugacagauaaagaauuuaaggcaucaauuguaaggaggcucgaagagauccaagacaaaguugaaaaucaacaugaagaaacuucuaagucaguccaggaaaugaaaaaagagaaacaucuugaaaagaaaucaauuagaacuacugggacugaaaaacucacuuaaggaauuucaaaauacaauuuaaagcuuuauuaauagacuggaugaagcagaagaaagaauuucagagcuucaagaaugauuuuuucaaaccuagucagacaaaaguaaagauaauuuuaaaaaaugaacaaagucuuuaagaaauauggcauuauguaaagccacuaaacauacaaaguguuggcauucuugagagagcaggagaaaaaguaaucaaucugggaaacaaauuugagggaauaauagaauaaaaccucuguaaucuugcuagagagguagacacccagauacaagaaauccagagaacaccugcuggauucuacacaaaacgaacaucacuagggcauauaggcaccagauuguuuaaggccagcacuaaagaaaaaaucuuaaaugcaacuagagaaaaaggucagaucacauacaaagggacccccaucaggcuaacaguggacuucucagcagaaaccuuacaagccagaagagauugagggucuauuuucagcauucucaaaggaaagacauuccaaccaagaauuucauauccugccaaguugagcuucauaugugaagguaaaauaaaauauuuuuucagauaagcaauugcuaagggaauuuguuaccauuagaccaaccuuacaagaaaucuuuaaggaaguucuaaauguggaaacaaaagaacaauaccuguuaccacaacaucacacuuaaguaccuagcccauagacccuauaaaggaaccgcagaauagaaacuacaaccagcuaacaacuucacaauaggaucaaaaccuccuauaucaauauaaaucuggaauguaaacagucuuaacacccccacuuaaaaggcacagugaauuaaauuaauuauugaaugaaaaagaaaaaaaaagaaaaaacaagaccaaucugucugcuaucuucaagagacccaucuuacauguaaugacaucuauaggcucaaaguaaaggguuggagaaagaucugucauaaaaauggaaaaccaaaaagagcaaaaagauauucuuauaucagguaaaacagacuuuaaaccaacaacaguuaaaaaagacaaaaaaaaggcacuacauaaugauaaagggcucaauucaauaagaagacuuauugauucuaaauauauauguacccaauacagaagcacccagguucauaaaacaaguacuucuuauuuuauuaccuacaaagagacuuagauaagcacacaaccacaaaaaaauaguuggggacuucaacaccacacugacagcauuagaucaucgagggagaaaacuaacaaagaaauucuggacuuacauucaacacuggacaaauugggcuuaaaagacaucuacagaacacuccacccaucaaccacagaauauacauucuucucaucugcacacaaaauauacugcaagauuaaccagaugcucggccauaaaucaagucucaauaaaagcaaaaaaaaaauaaaaacuuuuagguaaacaacaaaaugaaggaagaaauuaaaaaauucuuggaaauaaacaaaaacagagacauaacauaccaaaaucucugugaugcagcaaaagcaguguaaagaauaaguuuauagugcuaaaugccugcaucaagaaguuagaaagaucucaaauuaacaaucuaauaucacaccuagagaaacuagaaaaacaagaacaaacugaccccaaagcuagaaaagaaaauaaauaacuaaaauuagagcagaacugaaugaaauugagaccccaaaacccauacaaaggcucaaugaaaccaaacacugguuuuuugaaaggauaaacaggauugauagaccacuagcuagacuguaguuuugauuuguauuucucugaugauccaugauguugagcacuuuuucauaugccuguuugcaaauuguauuucuucuuuugagaaaugucuauucaggucuuuugaccauuuuaaaaucagauuaugagauuauuuuuccuauagaguuguuugagcuucuuauauauucugguuacuuaaucccuuaucagauggguaguuuggaaaaaauguauucccauucugugguuugucucuucacuuuguugauuguuuccuuuguugugcagaagcuuuuuaacuuaaugagauucuauuuguccauuuuugcuuugguugccugugguuguuggguauuacucaagaaauuuuacuugcauaaauuauuccaaugucucggagaguuuccccaauguuuucuuguaguaguuucauaguuuaaggucuuagauuuaagucuuuaacacauuuugauuugauuuuuuauguggcuagaaaucggugucuaguuucauuuuucugcuuauggauauccaguuuucccagcacuauuuauugaagagacuguccuuuccccaguguauguguuuuggcaccuuuguaaaaaauaaguuuacuguagauguuuggauuuauuugggguacucuagucuguucuacuggucuauguaucuguuucuaugccauuaccaugcuguuuugguuacuauagcucuauaguauaauuugaagucagcuaaugugauuccuccaguuuaguucuuucuacuuaggauagcuuuggcaauucuggguuugugguuccauauacauuuuaggauuguuuuuucuauuuuuguaaggaaugucuuugguauuuugauauggauugcaguaacuauguagauugcuuugaguagaauggacauuuuaacaauauugauucuucccaucuaugaacaugcaauauguuuccuuuuuugagucuucuucaauuucuuuuaucaauguuuuguaguuuucauuguagagauacuucacugcuuugguuaaguuaauuccuagguauuuaauuuuacuuguugcuauuguaaaugggauuacuuucuugauuucuuuuucaaauuuuuugcuguuggcauauaggaaugcuaaugauauuuguauauugauucuguauccugcaacuuuacugaauuuguugaucaguucuaauaguuucuuggugaagucuuuaaguuuuaacaaauauaagauaauaucaucugcagacaaggaaaauuuggcuucuuccuuuuuauuuuggaugcccuuccuuucuuuaucuugucugauugcucuagcaaggacuuccaguacuaugucgaauaacaguggugaaagugggcaucuuuguccuguucccaaucuuagaggauaggauuucaguuuuuccccauucaguaugauacuagcuacgggucugucguauaugacuuuuauuguguugacauauguuccuucuauacccguuuuuuuuuuagugcuuuuaucaugaaagggauguugaauuucaucaaaugcuuuuuuagcaucaauugaaaugaucauauggguuuuguccuucauuuuguugauaugauguaacacauuuauugauuugcauauguugaaccauccuugcaucccugggauagaucccacuuggucaugaugaaugaucuuuuugguguguuguugaauuugguuugggaguauuuuguugaggauuuuuguaucaauauucaucagugauauuggccuguaguuuucauuuuuuuaucugucucucucugguuuugguaucaggguaauacuggccuaguagaaugacuuuggacauauucccuccuccucuguuuuucagaguaguuugaguagaauugauauuaguucuuuaaauguuugguagaguuuagcagugaagccacugggucccaggcuuuucuuugcugagaaacuuuuuauuacaaguucaaauuuguuacuuguuuuuggucuguucagguuuuggauuucuucaugguucaauauucuuagauuuaugugucuaggaauuuuucuauuucuuguagauuuuccaauuuauugccauauaauugcucauaguagccacuaaugauccuuugaauuucugcaguaucaguuguaauaucucccuuuuuaucuuugauuuuauuuauuugggucuucucucuuuuuuucuuggucuggcuaaugguuugucaauuuuguuuaucuuuucaaagaaccaguuggucuuuuguauugcuuucuucauuucaauuucauuuauuucaucuccaaucuuuauuauuuauucuacuaacuuuggguuugguuugcucuugcuuuucuaguucuguauuagguuguguauuugaaguuuuucuucuguuuugaugugggcacuuauggcuauaaacuuccuucuuaguacugcuuuugcugcaucuuauagguuuuggugcauuguguuucucuuaucauuuguuucaagaaauuuuucaguuuccuucuuaauuucuugauuugggagcauaucguuuaauuucuauguaguuuauaguuuccaaaauuccucuuguuauugauuucugguuuuauuccauuaugaccagagaagaugccugauauuauuucaauuuuuaaaacuguuuaagacuuguuuugugaccuaacauauaaucuauccuugaaagugauugaugugcugaggagaagaauguauucugcagccauuguacaaaauauuucuguaaauaucuauuagggccauuuguucuauagugcagauuaaaucagauauuucuuuguugauuuucugucuggaagauuggucuaaugcugaaaaugggguguuuaagucuucagcuguuguuguauuaggguccaucguucucuguagcucuaauauuucucuguauaucuggcugcuccaguguugauuguguauauauuuauaauugucauauccucuugcuggauugaccccuuuauaauuacguaaugaccuacuuugcaucuccguauagguuuugucuugaaaucuauuuugucuggcauaaguaaagcuacuccuguuucuuuuugguuuccauugucauagaauaucuuuccaucccuuuaucuucagucuauaugugccuuuauaggcuaagugcauuucucauaggcaacagaucauugggucuuuuguuuuuaaauccauucagccacucuaugucuuuugauuggaaaguuuaguccauuuacacucaauguuauuauugauaaguaagggcuuacucuggccauuuaaaaauuuguuuucuaguuguuuuauggucuuaucuuucuucuuuccuuucuucaagucuuucuuuuagugcaggugauuuuucucuggugguaugauuuaauuuucugcuuuuuccuuuuugcauauucguuauacauauuuuuuuaaaaauuugagguugccaugaggcuugcaaauacuaucuuauaacucauuauuuuaagcugauaacaacauaauacugcuuacauaaacaaacaggcaaaaaacucuacccuuuaacuuugucucucuacuuuuuaacuuuuuguuguuucuauuuacauaauaucuuuuuuuuuuuuuuuuuuuuuuuugagacagagucucaccugcucuguugcccaggcuggagugcaguggugcgauuuuagcucacugcaaccuccacuucccagguucaagcaguucucugccucagccucccaaguagcaggaauugcaggcaccugccaccacgccuggcuaaauuuuguauuucuaguagagacaggguuucaccauguuggccaggcuggucucaaauucccaaccuugugauccacccaccucggccucucaaaguugcuaggauuacaggugugagccacuguguccggccuaaggcccaaggacucuuuagucagcuuguggugaaugcugccaggccugggacucaccuuuuagggcagugggcuccucugugucccaggucagauccagaaaugccagccaagagccaaggccuggaaucagagaccccaagagcccacuugugcucuaccccugucuccaaguuaguaccuaaggugcaagacaaaauccccuuuacuuuucucaagcagagggugucucucacuguaggcacuguagugggucucaccugaagccagcacgucucagagucucacccaaggcccaugguauacuacuuggguauugcuccugguuauucagggcccaaguacucuuuagucagcagguuauggguccugcucggacuggguccuucccuucaaggcaacagguucucuucuggcccagggugugucuuuagaaaugucaucugagagauagggccuggaaugggggccucaugacucugacuggugcccuguccuacuuuggauaagcugguauccaagaugcaagacaaagucaucuuuacucuucccccucuucuccucacgcagaaggaaagguuuucuuuuggagccaugagcugugcugccugggguuggagcagggguggcacaaacacucccuuagccuucccagcuagugucuuaguaggucaucuuuccccaaagucugcuugcucuaagcccggcucagcaccaugauucaccuaggaguugcaguccuuguugccuagacuggcuuucuaguuuauuuagggccuuagagcacuucagccuacaguggugagccucgacagaaucacuggguuccgacugcugggaugggugauuccucucuggcuggggcucaucugaaugcucccucuguaggcggauaucagcugaguucaaccugguuuugcuugcuuucccagugacugggcaacacugaauuccaugcagucucucaaucaccgugcucucccucuccuaagugcacagagguucuguccaugacacagggcugcugccagggaaugggggagggguggcaucagugauuuaagaauaucuuucuuccccuuuucagugacucuuucagugauaugaugucaaagccagguacugugagugccuacuugacuuuucagucuuaugaaggugcuuuuuuucauauaauuguuaaucuggugauccugcaggugggacaaucgauggagccuucucuuuagccaucuuagucuugcuucugagauaccaguaugccaaucuaaauaacagagagggagacucuaaaagaaaaugauauauauucaggaguagacauugcaaugggaauacauguauuugggaagguaaacaaagacaaagguuuuuaaagaaacaaugagaaggauuacauaauguuuucagauaauuauuuuugacuacaaggaucaauaacaagggcggugucaguguaaggcuggauaauccaguugcuggacagauguccuuguagaaguauuuuuuuuguguaagguuguguugaccuuugugcaugguuguggcuuuuacagguuguuucaggauaguuuuguuuucaggcauugguguaagagagcccuuccugcgugaccuuaccuggcuccauuuucaggauuuuguuuuuuaacauaaaugaccccauuuugauucugacaacuuuuaugcugcaagcucuuuccauaauucuugucccacacagaggauuccuuaaucaguccagucacucaguuguuuuucuucugacaacauggcuaggcuauuggcaauggcccaugagucugugaaaauacagcaagauauggugaguaaggcggcuggcguggccauugccacuguauguaguuuagccuauuggauagaauguccauguccagucucagucaaaaguuggcuaucuauuggccagauggugguggcagcccaauggaccccaucugcuuuuaguuuggcagaacuguuaguaaaccacgccagaccauugguaggcauauuuuugaacccauaggaggagccaaaacauccucaacagguuacuuggucacuuuugguuagcuagccauuuauacauggaaccuacuggucccuugggaucuggguggacaugaucuuaaaugugccaguuucgaugugccaguuucauuuaauaaucgagcucuguugagccugucuaauuugauugguggaguuugcaugaacccaaguaagaaugggcauuucauguuguagugucauguauggugcucuggccauaagaugcucaguguccagagacuagugccuaguagcaagcaaggaguugcuguuuaaaagcgguguaucugggggcugcuucaagcaacuuauauguccaaaaugugagaggcugguacaucccagugguaguuuuuucuugccagagacuccaaucagcgugcauggagguuuuggacaucuguaauuuuauugagcuagcaggcuuuaaggguucuaaaagcagugccuggaccacaacuuguugaauggcuuccaaggccuguugucgcaaagaaccucauuuaaaauugguggguuugcuggucaauuugacuaaggagagcaaaaggacacccagguuagguauauguggucuccaguacucaaagaggccuaccagcugcugggccucauuuuuauuagaggaugccacaagagacaacacuuuuguuuggcuguaucggggauacuucuuugguguucagcuuaaguggccuuggcauuuagccugugauaguccaugguuagucuccaugcccuggagagccuuuugcgaccagccaaacugggcuguuauauugugagagggugguuuauaauauuuauaucuguauuaaguccucaauuaacaaaauacuguccuauucuccacucaguauguauaagaguacuacuuuuguugaauaagccauuggaacuuggggagcuuagguggcaggcggaaguggauaugccccacuguuauggcuuaaauccuuagcuguguugggggaacauaccccuucagauggagguggccuucugugccccaagcagccaaaaugccaaugccuaugaugcacugacugauaggaaccauggucucuggcaccuaaaauggcccaacgggcccugcccacaaccagauaagcaucuugggucacuauguuuguccgaaaaccucccaaugucaucaguuuaauuuuuccccuaaaagaacaaggaaauauugucaugugggcuccaguauccaagaacuccacaaaagucugaauuuucuucuuuuucucuuuucucuuaacaagaguauuaggccagugcccuucgguaagcaccuagagacuuuggcaacaacccuaacugcaccguuugggucugcagugucccuuuauccaacaaacagaccaaccagguugcuugagagcuuacugcuuaugucuauguguguccuuuggaucuugagucacguucucugugaaggccugcauugugcaugcugguucccucucagaugucucaaggaccaucagaggaccucuuuuuaauucucucucagaugccuccagaugcaucugaauacccaggaaggagcaaucacauaugugcacuaagcuccccuguuuccacgcuucuuuccuccgccacaauccaugcagccaccucacccacauucucgggguguauguguggccugugucucucuuaucacugcuucuuccccauaaaacaucuagcuggucugaugucuccacugugggccagguaugagauaggguauugccccuucuacuucaccaaugagccauuguucugucagauugaauccugcuugcugugccaauuuugugaagcaggugcucucugugcacugguuaucaacuguccgaguccagugagacagaauacacucauacacaacaaguuacgugaaauggauuuguuaccaucagacaggcagcaagggauaacacaagccuuggauuuauugcugcugguccccaaggcugcggagagcugcccagggcaaacagaaucuuaucucugaguucuucacuuguaccauagcugagagaccucagaagcauccauccuggauuuuauaucgugacaacacaugacucgcugcacuaaagcauuaaaggacauccucuuucuagggaggacuggaacagagccugagcuguucuggccaaucccccucucaucuaaagauguugcauuccuagcacagucuacauauuuuggauuauauccuugacauuguuaauguuauuuugguuacacucugaguucuguuaaaauucuccgcugugggccaucuucuccaaguuuugacuccccuucccaauuugccuacuuguguuuaauuuuaagaguccucaaguaguuucuuuuuguauuuuguucaaugcaugcaguagaaucauugagagagaaaggcuguaguuggcucauucuagcuugucuguaaguucuuguuugucauguucucaaaagugaacaaaaauacuuguugaacaaauaaaugaagaaauaaacugccuauuaccaaugucuuuuuggaucuaugcuugaauuuuuuuguuucuuuuucuuuuuuuugacaguuuauuuaaugaauccuuuuagugucaacuuugaaaauguaaaugccacaaaugccaucaugaccuggaaggugcacuccauaaggaauaauuucacauauuugugucagauugaacuccauggugaaggaaaaaugaugcaaguaagaacccugcuuaauuuucuauuuucaaaaauucuuuuuuuguccugaacagagacacugaugaauaaaaucacuuuaaacucuuauuucuguguagguucaaauggugugggucaucuguuuuaaaagguccaugaaauuaaucauacacuuuuaugguuaggaaaugggccuugaagauuuuuuuccccccaaagaagaacugaucuuacuccaggucaggauuugcugugcucugguuugccuuuguaaugggaugcacucaccaauguuucugucuuguucuuuucucuuuuuucuuuucuucucuuuuuugaucaagcaguacaauguuuccaucaaggugaacggugaguacuucuuaagugaacuggaaccugccacagaguacauggcgcgaguacggugugcugaugccagccacuucuggaaauggagugaauggaguggucagaacuucaccacacuugaagcugguauguucagccccuggcauuuaacccaaagaaguaggucuuaggaguuagacugguuuccuuaagagauuuugguuguaccaaaaacuaagagaaaaauauuuaaacagaggcgggguagcauuuaaaaaauuagauuaggugccucaugagaagugaaugggaaaccauccaccucagacaguugacaguaguauuuuauuuauacugccuaucuucucucuuaccuuucauuuucccaaaaugguuucaagccaucacuuugcuggauucacaguagaucuggagcuauauaaauuaguauacaccuuuaauucaggacaguggaaguguuaaugacaaggaaagcauuggucucauccuaaacaacuugaggccauguuuggaaauguaaugacauuuggaaccuuaaugguuauuugugagucauuuguuccggugaugccacacugugugcccucuccagcaugcucuguggcaggguuuccucaguauugacugcaaacuuuuccugcuaaauaacuaugucugagaacucaaaugggccucaggagauuugauggcccaauccugcuuccaucucccuccaacucaaugucauaaaggauaacuguugcccauuuuacagaugaggcaacuugcacccauaacugaagagauuugcccugauugcaguuacugaaugguacagacaucguaauaaucuuaggagugcaguggcucacaccuguaauccuagcacuuugggaggccgaggaagguggaucacguggucaggaguucgagaccagccugaccaacauggugaaaccccaucucuacuaaaaauauaaaaauuagccaggcgugguggcacacgccuguaaucccagcuacucgggaggcugaggcaggagaccgcuugaaccugggagguggagguugcagugagcugagaucgugccacugcacuccagccugggcaacagagugagacuccaucucaaaaaaaaaaaaaaucauaggagucaacauuuacugugagccauacauagcucgaagggcccucugugcuccucucuuuucauccugacaacacgcaguaggugcucuuaugauccucauuuuaugccagaggauaucagggcacagaaagauuaaguaauuuaacugguucagccaggcacugacugagcugcgacucacguccaggcagccugacaccagagcuccacccuuaaucagagcucaauucuguguguucucucucuugguguuauuacaaccucuagaucuuguugauucaaguccuggcuauuuuagugccaaaggaaggauuauacauauguauuuuauuauucuucuuauuuguguauggcagcuggcagaacucuuucugucugauucugggaggaccauuuuaaagcagugacucuaauuuggggguagugggcaccgcuaaucagaauccacacaugaggauggucauuagucaaguucugcaggccuccccgcuucccugguggugucugccuauccucaagcccauugagacuccaguaauuuuuccuagguguacggguuccucaauaaucuuuguucuggaaggcccuguuccugagaggaauguugcauuuuccucaguguguuuuagaaaagaauuuuuauuauuuugcuuuacguuuucuguuuuuuuuuugaaaauuuauuccaacauaacuaaaauuauguaaaaagggaagauggcaaaagaauagaguuucuuuuagauuauaguaauaaucuaacaucuugaaaacgcuuaacuuugcuuuugaugaugacaagaaaaugagaugaaucuacugaaggugaaccuauaggaauuuuuuauuacuucugaucacgcuuugcuuaaugcuggaaaacucaaaucuuuauguguauuauaaccaugcuuaaguauaauuauagugagcagacauugaguuaaaugaauugaugguauaaaugauguuguuuauaaaauauagugcuaucaacuguauuguagcacuuuuuuguuauaaauaguaauuuacaagccagcugaagauuuugcauugagcuuagauauugucccugaguauuucaauaaaguuuuaaauuuaauauuggcuucuccaaugacuuauuuagcaaauugaaaucugcuuuaauagauuuaaaaauauauggccaccuuuaacuuaaaguauaaaguguugagucagcaacuaaaauaaaaaacuuaaaugucaauuauuaggcaaaaaagauuauauuuuuauaagauagagagauacauuuuaauguuauguuccaaaacaguucuucuuucaaagaaauguucugaaucagaucaaaaauuacuuguccucucacaaaccaaaaacuaaaaaaaauaggaaaguuauuuuuuaauauuugaaacaccuuaauuuuguuaaauuuuguuaauuucgugacaguugcuauuuaacacuuucacacuuagcagccaaaauuuuuuuaaaccauuuuaguaugcagaaaucauauuuaaaaaauagaaguuggagguccuagccagaggaaucaggcaagagaaacacaucccaaaaggaaaagaagucaaacucucuuugcugaugauaugauucuauaccuagaaaacccuacauuaagaguggacacagggagaaugcagaagcugggcugaagggucaggaagcugcauacccugcacagggcuaugaagcacccacacucguucuuggcccccagcaacuccuggggaagggguugaacaggcggccugccccugccguggaccuuuggaauccaggcagcaggaaaccccacaacccucauggacaauuggacuggcaggaagagcuucuuagagagguaguaggaauagagcuccauccugggcagggcccagaggguuuggugcagaaacaucugcaguggagcauggccagggacacaaaucccccaagccuugccuugcuccucuaggagacuuuggccaaagggugaccaugagaccuagacagaggagaauggucuuacccaugagauggggccaguccaaucugagugauccccugucugcuggccacuccugaggcuccagccuugccacacuagcuggaguugcagccucagaugcccaacuauggugcuuccuaggggaccauaucauagcugcuuugcuggcagauggcaccugaccauuggagauuuccagcagaacagucccuacugacaugcaucagcccaccugcagccucccccaaccacagccuacccaaugccaccuugccaguaugcacuuguccauggucaccccaccaccacuuugccagugcacacguguggguggaccuugccucuucuccuccaauggcuuaugugugcacauaucccacugcugcuguuggcauaagcacaacguguggcccugccuccccuggugcuuccauuucuggugugaaagagugcauggacaccagcagccccacccccacuccugcugacacugccaccagcgugaaugugugcauggccccacaacccccccaacaccaucacuggcacaaaugcaugcacagacaccagcaacucugccccuaccccugugcugccacuguggcugcugcaaaccagcacacagacaaccacggcccugccuucccagugccaccacaacugccaaugugaaugcaugcauggaugcuggcaacucuacccaccccugcacugccacugcugccugugcaaacucaugcacaaagacugguagccuccugccuccaccacugccaguaccagugccagcacugucacuggcacuucugccucugccugcauccccccaccagggcaacugcaugcaggaacccugcagcccuacucucagagguaccccaccccagcugaugcacauacaaaccacugcacugcccuagcugcuggcacaugugagugagcauggacccugcugccacuacccugaugaagugcuuuggccugcaccacucauuggaguuuuguggccagcagacugagaucaguucggccucuccaacacagcagguuccuagccuugaggggccagagaacaaaggugggggccugauaccaguccugcagaguuagagcaugcagaccaggagugcuaagcugagcuuuggccccuuaaaaucuuccagaugggaacccagucaacugaacccaucuuauaucaaaaucagaugucccccaaggacaucaaauaacauaaaacauaaaacaaaacaaaaacccauccaaaggacagcaacuucaaagacuaaaggaacaucagcccacacagaugagaaggaaagaaugcaagaacucaguggcaacucaaaaagccagaguaucuucuuaccuccaaagaccacacuagcauccuagcaaugguucuuaaccuguucaaaaugacagaauuagaauucagaauauggauagaaacaaagaucaucaacauccaagagaaagugaaaacccaauccgaggaaucuaaggaauacaacaaaaugacacaggagauaaaagacaaaauguccauuuaaagaaaggaucaaacugaucugauagagcugaauaauucauuucaagaauuucauaauacaaaugcaagcugaggaaagagucucagcucaaagaccaguucuucaauauaacucagucagacaaaaauaaagaaaaaaauaaaaauuauuauguaaagagaacaacucagccacucauugguguucuugaaagagaggcagagaaggcaagcaacuuggaaaacauauuugaggauauuauucacaaaaauuuccccagccucacuggagaggacaacauucaaauucaggaaaugcagagaacuccugugagguacuauacaagaugaccaucccaaagacaccaugucuccaagacauagucaucagauucuucaagguugaaaugaaagaaaaaauguuaaaggcagcuagggagacagggcgggucaccuacaaagggaaccccaucacgcuaacaguggacuuuucaucagaaaugcuacaagccaaaagagauuggggccuguacugaacauucuuaaaagaaauuccaaccaagaauuucauaucuagccaaacuaagcuucauaagugaaugagaaauaagauccuuuucagacaagcaaaugcuaacggaauucacuaccauuagaccugccuuagaggagauccuuaaggaagugccaaauaugaaaaaggaaguccauuaccaaccaccacaaaaacagacuuaaguaauagaccauugacaguauaaagcaaccacgcaaucaaaucugcauaauaaccagcuaacaagacaaugacaggaucaaauccacacauaccaguauuaaacuugaaugcgcacagguuacaugccccaauuaaaaggcacagaguggcaaguuggagaaagaagcaagauccaacuguaugcugucuacaggagaccuauaucacacgcagugacacccacaggcucaaaguaaagggaugcagaaaaaucuaccaaccaaacaaaacagaaaaaagcagggauugguauuccaauuucugucaaaauuuauuuuaaaccaauaaugaucagaaaagacaaagaagggcauuacauaaugguaaagaguucaauucaacaagaagacuuaacuauccuaaauauauaugcaccuaacacaagagcgcacagauucauaaaguaaguucuuagagacuuacaaagagacuuagauagccacauaauaauaguaggagacuucaacauuuugcugacaguauuacaugaauuaucagggcagaaaacuaacaaagauaguaaggaccucaacuugacacuugacaaaaugggcuuacagaacucuccaccccaaaacaaauauacauuauucucaucugcacauggcauauacucuaaaacugacuucacaauuagacauaaaacaauccucagcaaauuaaaagaaaacccgaaauaauaccaaacacacucucaggcaacagcacaauaaaaauagaaaugaguacgaagaaaauuacucaaaaccacccgauuacauggaaauuaaccugcuccugaaagacuuuuggguaaacaaugaaauuaaggcagaaauuaagaaauuauuugaaauuaaugagaagaaagauaacaauauaccaggaucucugagacacagcaaagccauguuaagaguaaaguuuuggcugggugcgguagcucacaccuguaaucccagcacuuugggaggccaacgugggcagaucacgaggucaggaguuugagaccagcuuggccaauauggugaaaccccaucucuacuaaaaaauacaaaaauuagccaggcgugguggcacgugccuguagucccagccagucgggaggcugaggcaggagaauugcuggaaccugggagguggagguugcggugagcugagauugcaucacuacacuccagccugggugacaaagaucucaaauuaacaacccaacaucacaccucaaagaaguagagaaacaagaacaaaccaacaccaaagcugucagaagacaagaaauaaccaaaauuagaacugaacugaaggaaauugagaugcaaaaaacuauacaaaagaucaacgaauccaggaguuauuaagaagaauaaguuucauagaucacgaccuagacuaauaaagaauaaaagaagauccaaauaaacacaaucagaaauguuagaggacauuaccacuugaccccauagaaacacaaaaacucucagagauuacugugagcaccuuuuuggacacaaacuagaaaacauacagccuggaaacauacagccucucaagauugaaccaggaagaaauugaaucccuggacagaccaauagugggaucugaaacugaaucaguaacaaaaagccuaggaaccagagaaagcccaggaccagaugcauucacagccaaauucugucagaguuauaaagagcugguaccauuccuacggaaacuauuccaaaaaaacugaguugggggacuccucccuaacucauucugugaggccagcaucauucugacacuaaaaccugucagagacacaacaaaaagagaaaacuucaggucaauauccuugaugaacauagaugcaaaaauccucaacaaaauacuagcaauccagauccagcagcacauuaaaaagcuaauccaccacaaucaaguaagcuuuaucccugggaugcaagguugugucagccuacgcaaaucacuaaaugugauucaucacauaaaccgaacuaaaaacaaaaaccacacaaucaucucaauauaugcagaaaaagcuuuugaugaaauucaauauccauucauguuaaaaacucucaacaaacuacauguugaaggagcauaccucaaaauaagagccuagaucuaugacaaauccacagccaacaucauacuaaaugggcagaagcuggaagcauuccacuugagaacuggaauaagacaaggauguccacucucaccacuccuauucaauauaauauuggaaguccuagccagagcaaucagacaagagaaagaaaaaaaaaagcauccaaauagaaaaagaggaagucagaagucaaacuaucuuuguuugcaggugauaugauuguauaccuagaaaaccccauagucucugcauaaaagcuccuagaucugauuaaaagaaaaaagucagcaaaguuucaggauacaagaucgauguacaaaaaucaguaguauuucuauacaccaauaagauucaagcugagacccaagucaagaacgcaauccuacuuucgauacucacauacacaaaaauaucuaguaauacauuuaaccaaggaggugaaagaucucuacaaggagaacuagaaaacacugcugaaagaaaucauaggugacacaaagaaauagaaaaauauuccgugcucacagauuggaagaaucaauaucauuaaaaucacugacuccccaaagcaauuuacagauucaaugcuauuucuaucaaacuaucaauguuauuuuucacagaaauagaaaaaaacuauucaaaaaauugauauggaaacaaaaaagagccuauauagacaaagcauuucuaagcaaaaaggacaaagcaauaggcagcacauuaccccaguucaaacuauacuacaagauuacaguaaccaaaacaucaugguaccaguauaaaaacagucacauagaccaaugaagcagaauagagaacccaaaaacaaaacuacacaccuacagccaucugaucuucuacaaagucaacaaaaauaagcaauggggaaaggacuccuaauauaauagauggugcugggauagcuggcuagcuauguguggaagaaugaagcuagaccuguaccuuucaccauguagaaaaaauuaacucgagaugaauuacagauuuaaauguaagaccucaaacuauaggaauccuagaagaaaaccuaggaaacaccauucuggacauuggccuugggaaauaauuuaugacuaagucuucaaaagaaauugcaacaaaaacaaaaauugacaagucagaccuaauuaaacuaaagagcuacugaaccacaaaagauacuaucaaaagaguaagcaacaaccuacagaaugugagaaacuauuuguaaacuaugcaccugacaaacaccuaauauccagcaucuauaaggaacuuaaacaauucaacaagcagaaagcaaacaaccccauuaaaaagugggcaaaagggccaggcgcgguggcucaugccuguaaucccagcacuuugggaggccgaggcaggagaaucacgaguucaggagauugagaccauccuggcuaacguggugaaaccccgucucuacuaaaaauagaaaaaaaucagccaggcguggugguggcugccuauagucccagcuacucaagaggcugagguggaagaaaggcaugaacccaggaggcggagcuugcagugagcagaggucgugccacugcacuccagccuggacgacagagugagacuccaucucaaaaaaaaaaaaaaaaaugggugaaagacaugaacagagaguucugaagacauacaagcagccaaaaaacauuaaaaaaugcucaacaucaccaaucaucagaaaaagucauaucaaaaucacaaugagacaccaucucacaccaaucagaaaggcuauuuuuaaaaaucuuugcauguuguuacuguuuuuauucuuuagcuaccccagguagcuucuguagcagucagcaccacuguccugcuagaccuucuguaaguauuaaaagccaauguucuuacaagaacguuuuugcacagaaggagguguuacacaaaaagggggaagguuaagcuacuguacgcauuuguuugcaaugugucaucucacagaacucaucccuguaaccccaucagggcaggagccuucuucacaugucuucauaauauuucuuaagggaggccauuuuccacagugcuucagaucucaaaugcaaguggagccugacauaauaaaacucugguuucauuucaaccaugaugcagggaauauauuccauguguauuaauagguuguaacaguuuucuagggcuuuaauaacacaguaccacagacugaaggacuuuaacaagagaaauuuagugucucauaauuauggaggcuagaaaucugacaucaagcuguuggcugagguuguuucucagaggccacucucuuuggcuaguagauggucaucuaugucugcucacaggguauucucuugagcgucucugugcaucuauugccuuuucuaaugaggacacaagucaaaauggcuauuacuaaaaagucaaaaagcaacagauucuggggaagcugcagggaaaagggaacacuuauacacuguuggagggaauauaaauuaguucaaccuucguaaaaagcaguuuggagauuucucaaaacagagcuacuguuccacccagcaaucccauuacuggguauauauucaaaggaaaauaaaucauucuaccaacacgcauauguucaucacagcacuauucaccauagcaaagacauggacucuaccuaggugcccaucaaugauggauuggacaaagaaaauaugguacauauacaccauggaauaaauaaugaaauaauguuccucccagcaacauggauguagcuggaggccauuauccuaagcgaauuaaugcaggaacagaaaauccaauacugcauguucucacuuuuaagugggaacugaacauuggguauucaugaaaauaaagauagaaacaauagacacuggggacuacuagaaggggaaggaagggagggggcaagcguugaaaaacuaacuguuggguucuaugcccacuguuugggugaugggaucauucauauuccaaaccucagcauugcacaauauacccauguaacaaacaugcacauguacucccugacucuaaauaaaauuauaaaaagagaguuucuaggaaguauuuuuaaaaguauuucaaaggaaaguaaaauguaauagggagggauaugauucacuaaauuugauuauuaacuacagaaugaugaaguauuugacuaugguuucacaugaaugaguuauauggaaauaugcuaaauuacuuucaagaacauaauagcaugcacaaagaagucuggagguuaaaguagcacucaggugauggacuuugaauuuauguuuucauaaccaacucuaauuuaaugaaaucauaauuucucaaaaauuugacagcacugggauauguauuuugaaauauaguaaacccuaucaaugauaguagacugguaaaauacugauuugcaccuuucaaaaaggauguuuuucucgauuaaaauaaaguuugugauuuggcaaacugagaguuggaagaaaaguuggaagaguuggaagaaaaauaauucauguaaaguuaaggaaccuacugauaaguaauuuggauuuuauaucauuacucuaaaauggaaucuggacuauuaaaccauuagauuaugaaacuaacaacucuauaucacaucuuguauuuaaauugauuuuuguuaucacaaaaguuauuuagguuuguagcagugcuacuaacucucuuaauuagauacuugaauuuaauucaguuauuuuuauuaggggcuaugcuaaaauauucaagcuaucuuuaagaauuaaagggaaguuucaaaguaaacauuaaaaauagaagucauaugagacaugcuauaguuguauuuucaaauucagaaagcugaagcagcacguucacaaaaugugauugaguagagagauaaagauguuuuuuaugucuggauuuaaaaaugagaugugcuguuaggacucaguugcagaaugacaucaauaccugugagucccuuucuuguuugucuccauggaugugcuauaauugggucaucuauaucuucaucaguuaaagccugauauuucuuguggcuuaugaauguuuuaaauucucuuuugacuacuucuuguuguacuauucuugugaaguucauaccaugacaaaauuguaucaguagaaaauuugauucuauguggaauacagaguauuacauaaauccaacaaaacaauuuacaaacgaaaagauguacucaucuuaauaggacuuucauaauauuuuuaucaaucaaugauuaaaacgugugccuuuuuaagauuuuaaaauaaauugcaaugauuucauuauuuuuccauugcugagauuuuuuuuaaaugagaauuuuguugaacuugucaugcaagcugagccuucaauugaccauccauuuucuaaagaugaauaauggaaugaccagacccuaacuaccuugaguucaaaucuuggcuucacuuuuacuuucaccugggugauuugagaaauuaacuuacucucucugggucuuaguuuccuuaucuagagaaugggguaaauaaucauaccugccccauagaauuguuaugaggauuaaaugaguuaauauaugcaaaacauuuggaacugggcuggcaucuaguaaccccucuauaaauauuagcuauuauuauguguaaaagagaucccccaaaugguuuaauacauagguacccagaguuggcuuggauuuaaagaccuuuccuuaugauaaguugauugagcaaaugcagauuuagaugcaaaaucaaucagucaauccaucuacaaagauuucugagugagggauggagacaagaaaagauugggacauugaagcagguuguuuucugaguuccuuugaaguucgguuuuuauucauucaaacgguuuguagagcuuucacgaagugccaggcccugaggcagaugcuagaguuucaaaacccuuggccccagggauccuaugguuuauugacagagagacaaggaagcacacuauucuaaagcagcauggugagagccacaauagaagaaaugcugggugcugcaggugccuuaaguguccacagcaagcaggugacccaggcgcaggcaaggugcugggaggaggagugggaugaggccugcccaguggagggagaccagcacuccagugagcgggccagccguggguaucaugaaacuugaggaagaacgcauccugccccuagcggguuccccaucacugugucucuauccaugacagauggggcaaggaaguagcaaaggucugcugccuagaaagucaaaaaaaggggaaauuuaccuaacucaucuggaauuggucuaauggacaaauuauuccaaacuucuuugguaguuguauggcuugauguuuauaaaggcuuucagaggcagcugaccuuuuuauaaagcacuguacugugugcaccuagugaggagugagcaguguggcuguggaccaguggguagaagucauagagagugaaaacgggagaggcaagccucagguuggacagguaauugucauguccuugaccguccuagaaaaagguugagcauauugcuuuacauacauauugugacucaagaacuuuucuuugguuaauuucagcucccucagaggccccugaugucuggagaauugugagcuuggagccaggaaaucauacugugaccuuauucuggaagguaagaugugcagauuccaaaagucugauuguuuccaaaagucacauuuguggaaacaaaugugucuuccucuggagaacuguggauugguucagugucccaacugggagggaucuucacauucauccaauagaauuucuuaccuaguagaggaaucccacuccacuccuuugauagcugaugcaacugacagccaguucugauugguagaaccuucucugcaacuucaacucaggccaggcuugacuuuugcagggcccagggcaaagauguaaguaaacaaccacauaugauaguuaaaaguuacacauauuuaaauagucauacuauuuauauuuaaaaauuauaaaucaagcuuaaaaauuguaauauaaaauaaauuuuauccuucuaucuugacuaauacaccuucaugacaaccuggaaggccagguuuguauucugaacucugugaugcgucaguuucacacugaaacauggugauccugggagaguuggcucuggucucaaccuaccccacuuuuuuuuucaccuuuaguuuggcacacuccgcaagaaucucugugcacagacgugugggcaugccagucugcaugucuggguucuguccacaccccaagcagauagccacuccaagcccacucucagggcuggugguacacaugccaggggaggggaggccugaggaacagaccccagaagugggcuugggacugugugggcaagaauuucucugcaaacugaggaucuuccagaggagggcucuggguauggagagcagcuaaucccuguacggcugcauagggguaacauggcuggagguggaaugaggccaguacccaggcuccuccugcagggucccaggguggugcuguuuguacucauugcuuuucugcccuugacuaccccucacauucuuuuuuccaccagguuaaagagucuauuccuugugauucugaccugagcacucuucucagggcacauaaugcucuugaggcucuuaucuccaaaugauccucuucucuacucaccuucaguuagauuugaaugucugauuucagaguugguugagagaguuauuuucucuauuaagcuguuugaauuuucuggugugugcguauauaaaggaguugagggacagaaaagaugaaaaaggaguuguacaaauuccuuucaauuaaaacccauuuaaaaauguuuaucaauauuuuuuucagccauuaucaaaacugcaugccaauggaaagauccuguucuauaauguaguuguagaaaaccuagacaaaccauccaguucagagcuccauuccauuccagcaccagccaacagcacaaaacuaauccuugacagguguuccuaccaaaucugcgucauagccaacaacagugugggugcuucuccugcuucuguaauagucaucucugcagaccccgaaaacagugaguuuguuuucauuuucuuuuguuuuuauucucuaggaaaauguugaugacguuauuaaguagugauggauaaauugagaaaacaauaacuuaggaagacaaaaugucuagucacuaaacagucauuuucuuuugggccaggugugucaacguguuucagugggacaguccccucaguguggggagaaggagacuucagccauggcucaggacauuucuguccaggggauucuucaacauacaugggaaauuaucucaaauuuauucaaguaacugcaacccuaacaaacagucaccacugagaguuggaguuacuauuuaugaucuuuguggcuugugaaauaggaauugcauuuacuauuuuguaaaaaguguugucagucuuugcaccuggaaagaguccaugaacauuuccagagaucaucagaacuggcaucaacuuucaccacagacucugccaacuuuguagaauaaaagauaauaacuggcuaaucucuugccuaugaaagagcaaacaagguggaaugcccuuacaugccaaaucaauagugauauuaauuuccuucuuagccauaaaaagagucaaccccacaguuacaugcuaugagaugauacauacaugggcauacauaauguaguuggcaaguggcauccugggaucauucaugaaccuugcaauaauauuacccuucaguuccugcuauuaaaauuuccagacccuuguagguucuauaauauguguuuauucaaguucagcuuaaauuuggguugaguuggauuagaggauguuguuguuuuguuuuauuuuuauguuuuuaaaagaacuacccaguauauaucacaugaggaaaagaaacuauauugugccauagaagaaaaaccaaccuaaguugguuuaggaguuguuuaguguaaccucugcuuucugaagaacuauauuagagaaagaaguuauauucugacuucauuaggauccgaacaggaaaagggggcauuucauucagccucggggagcugguacuggccucuucugaggaagggagagaccaguucaaagcaacacugcugagagcaauuauguauuuuggggucuccuaccacacccuccauccccgugcccugccuucagaugccuagaccuucuggugagaggcuccagcuagcuauccuuaaguguuucuuguuucuacaucaccagcauguauaaagucacucauguacuaugagaaaaccaguaagguuaagccaguucacacuaggguguaaaugacugacaaaaagauuccccuacucuuugaucuaccuccaucucucaaaacauauuuucaauuuaaagaaacagcuuucuaagaguuucaacccuggguuuggaguuaaauuuuacuaaguaucaauaagucaagugaaaaaugucggccuuaauaugugaggggcauuugucugcuugauggaggaaggcagggaagccauguggaugggaucuauaaagcccucaugggcuuuuagcuuauaccuagggcuacacauuccuuugggugccccuagcuggaugauauuuugaugcccuauaaaaaugaaucagugguuuucacaccaguauucaguuguaauuaggauugccagguaaaauacaggaugcccaguuaaaugugaauuacagacaaacaauaaaccaguucuuaguguaagucuguggaaagaggagaaauucucaugccucaagguuaagguauaucccuguuggaacucaguagaacugguaguccccugaggccauguuauccuuuuuccaauugucagacaucaggaaaccuacuuuaacauauaaaauauauugacauggcaguauuagucauaaacugugugcauaucuuuauauaacccaacuuuuuauauaccugaauauuuucuucuuuuuugucuucuacucaauuccuaccuguaacacaucucagaagcaguauuuaguucaggagcaacugauguuaccgugggagaauuagccugcauuaguuauucauucaacagguauuuuuugaagcagauccaguacccaauaccagauucuagauuaaggaucaaaaaauuuugugguaaaggggcagauagcaaacauuuuugcaggucauauagucuccauuacauauuuuauuauaugccuucuuuguugguuuauuuuuauuuuuacaacccuuaaaaugucuuagaaccauucuuagcucaagggucauaugaaaacaacccucagaggcuggaaucauccuccuggugguaguuugcugaccccuguccuaggugcugaagucugguugggcuucagaaggucaacaugaugggcaucugaagggcaggugugaauauucgcugggaaguaagagacaagaacucacccaugaaaacaucccccacccaagcaccuguaacuauugaaguggaggucuguuaccuacuagauacagugcauguauguauuuacuuucuaccuuacacacuuaaaacaauuuacaguuaauuaaaucuggagcauugcucuauuuguuuauauacagaagagguugaggaagaaagaauugcaggcacagaggguggauucucucugucuuggaaaccccaaccuggagauguuauaggcuauguuguggacuggugugaccauacccaggaugugcucggugauuuccaguggaagaauguaggucccaauaccacaagcacagucauuagcacagguaagaagaagcuuccauaucaucgcauugcuauauucaccuugaagaaaguucaagugggauuucuggacuacuucacagacuuugacugugcuaagcuaguaauuuugaaacgacaaauccagcauggguguuaggaguucagauguuacaagaauauguucuaaaacuugaccuuuaaaucuacuuuugcagagaauaucugcacaugaggugggaacugauuuucauaaacuuguuucuuuaaauuagugcauagucucgaauggcagaaggacauuauuauaacaguuguccagagagcuuuuacaaaagcagagacuugcauccauuuggaagauguuuaggacauauaguugaugagaaucgaucaucaacuucaguuucaauagaacauguagaacuuguucucuuaccucccacauuggauuuguaaugugaagauugcuaguuuagcagucagaggagugcugguuuguguggcuugagcuggagggguggguggcgccaucuacugggcucagggaaaggugugggaaaugucccuguucagagggugaucaagguucugccaauuucagugguaugguggguuguggaaggagauugcagagguacagguguaauggggaaaugaggaaguggaagcaaagcuuucaagacuauuggcuuuaaugggaagagggaagauaaauaacuggagggggauuuggagccaaagaagggcuugguuuucuaugucuggucugauucugcacccaguuguaugcacauggauacaggcauaguugagaacucuugcuucaaagaacacugcagaggccagucccugcaggcuuugcuggagacaagacaguggggccagguguuugcaacauggaggacuccaaggcuucauggaaggagggaauaucguggggaugaaauacaaaauuccugaaagccaauuauuaggggagcacaaauuuauuuuucauucuuuuuuggggggugugguggggaacagacuguugcuguguuacccaggcuggagugcaguggcuugaucucagcucauugcaaccucugccucuuggguucaagugagucuccuuccucagccuccccgguagcugggguuacaggugcccgccauuaaaucuggcuaauuuuucuguuuuuaguagagagaggauuucaccauguuggccaggcuggucuccaacuccuggccucaagugauccgccugccucggccucccaaagugcugggauuucaggcgugagccaacgugucaugccuuuucauucuuuuucuuuucagaauuaggaaacaucauucuguuauuaaaaaucuguugacuuuuuuucccuagaugcuuuuaggccaggaguucgauaugacuucagaauuuauggguuaucuacaaaaaggauugcuuguuuauuagagaaaaaaacaggauacucucaggaacuugguaaguuuaaagcauguaaugugccccaugugcagacuuguucagaacaauucauagauuccuagcuuuggguuuaggaagcugucagcaccauacccaacuuuugguaucccauuuauucuagcaauuggguuuuuaaaauuauuuuuuaaucauacaaacaaaacauuuucauuaauucucauugcuaagucucucucuuucuuccuuuuuucagucucuuauacccuaugugaauaaucaucauuuuagcugaaucuuuguccaaauccauaauaaugguuuguaaaugaagucuuaaagauaggaugcuggaaucaaaggguuucagcuuuuaaaauuuuuuuuucauuccuuucauaauuuuuaagacuuuccacacauguugugaaaucacccccuagaaauguuaccacuguccccccagcaguggaggggauuuuugauccuuccaugggguugcuuauuccccuucuuuagcugggugcuugauuguucacacagaucagaccaguucucagggguucuuccuuuagcaggaguggauccacaguuuacaguuggcucagagcaggcaggaggugugugaccuugugugcacgguccaagugugcauaagcgugugugggaaaacagccucagcaaagccuucaaaguaaacauuccuggauuguuuuucagugacacuuggauaagugugcacugccacaaccugggaacuagaguucaucaaauccccccacuugccucuuugaacauaauucuuccacuuccuuccuucuuccucacuuuaguagguucucugguugagucuuuccucaaacacuguuuugaauucaagaacagaauuaagucuccuuuuuuuuagaguuuaguuuguuuuauuuuuauuuuuuggcuaugugagcuugugcaaguuauuuagucucuggguguccauucuucaucuguaaaaggcaagacuugaacaagauugcucaacuccuucacagcucucauaaacuaugucaaggcacaaauccucuagagaaacagauaaaacuccuuaacuuggcauaagcuguuacaaccuccagagcuggcuaugguucuucuauuaguugacaugaauauucugagacuguuuccaaaucaugacuuuucucuuaucccaacuucuuuuccuagcuccuucagacaacccucacgugcugguggauacauugacaucccacuccuucacucugaguuggaaagauuacucuacugaaucucaaccugguuuuauacaaggguaccaugucuaucugaaauccaaggcgaggcagugccacccacgauuugaaaaggcaguucuuucaggugacaucuauuuuuaauuuguuuauuuauucuuucaagaucucauuauuugaaaucauuuaaaauaauggcugccaucucagacuguggccaggcugaauucccuucuugcauggcuuuauacuggaaagguguucuuaagcaaauuaguagggugagcaagauggugggggcagggcagcauuuuaacuuacuuaaaaaacaauaugacuugguauuuuuagaagcaucugaaacaccaccagcuccuuaagaaagccuggccuuuaugaaacuuuccucuuuuuuuuuucacuuuauugagcauuguuccaauuuauuuuuaagccccuugcaagcucuuacuguuucuugcagauuuguaugcuuuggcuggaucacuaguaccccuuguucaguggauuuuuugcuuuuugugccaucuccugaccauuuuaccuggugugcccauggugaugaaauuaugauuugauuuuuguuugguauaaacauguugguggugcugaguuaacaagagcauuaguguccagcucucucacaagauguuuacaacacuuuuaauaaaaucuuuuuuuuccuugaaaaaaaaaccauuuaaaaaaucacagaugguucagaauguugcaaauacaaaauugacaacccggaagaaaaggcauugauuguggacaaccuaaagccagaauccuucuaugaguuuuucaucacuccauucacuagugcuggugaaggccccagugcuacguucacgaaggucacgacuccggaugaacacugugaguuuucccaaaucaaaguucuucccuuaggaguuucugggaaacuaacaaauuacagaaguguugacuuaggcuuugucuagaucaggaauuuucaaaccuuucuucuccccuucucaccucccucuuucucuugaugaaacccuuuuugucacaaaaaaaggguugcacagacucucacuauauaaaacagauacaaauagagguaaucugucugauuaaggccuaaaaucuuccuucugccucccucaguggcccuugagacaauucucuggaacucagucucacaauccuguauguaguuugaaaacacagauagcauauuuuaguguugacaucagaagagccacaaggcuucugucuagagaagaguggugcugguuuucucagcagaauuguucucugcagcuagcuuuccucuggcucauuucccucagcagcaaacgaauugguucuugacucuguuagggccuccaggggcaauuagagaugggugcaguggggugggaauugagcaggggaauggaauacuugcucacaaacucccuguuugcauauuugguugggaaauggugagguggagagauagaucuuuucaaaaaugcauuuggcuugaaagaugaaguaagaaggaagggagaaaaacaguaagaacugguugauggaaaaauuuauucucauggcaaacccugacaaccaauaaacaggaauguggugagagaaaauagauacugauggaagaaagaggagaaaagaauaucuucagugaggggaucauagaagauccuggaaggcacccaugaaaagcaaauagauucaaaaggcuugccugaaguuaccaacuuuccuuaauguauggugcccucacugaagcugcagcuguagagaugggcacauccuguuggacugcugacccuggagugcccugacuggugauucagauacacguggcugcaguggcaguguauuaguccguucucacacuacuauaaagaacugccugagaggggguaauuuauaaaggaaagagguuuaauugacucacaguuccacauggcuggggaggccuuaggaaauuuacaaucauggcagaagggaaagcaaacacauccuucuuaacauggcggaaggagagagaagugaagugcugagcaaaggggaaaagccacuuauaaaaccaucagaucuugugagaacucaccuacuaucaugagaacagcauggggguaacugccaccaugauucaauuacaucccacggggucccucccaggacacauggggaauauaggagcugaaauauaagaugagauuuggguggggauacugccaaaccauaucauuccacuccuggccccuuccaaaucucaugcccucauauuucaaaacacaauuaugccuuuccaacagucccccaaggucuuagcucauuccagcuuuaacccaaaaguccaaguccaaagucuaaucugagacaaggcaaaucccuuccgccuaugagccuguaaaauuuaaagcaaguuaguuguuuccuagauacaaugggaguacaggcauuggguacauacacccauucuaaaugggagaaaucggccaaaacaaaggagcugcaggccccaugcaaguucgaaauccaauagggcagucauuaaaccuuaaaguuccaaaaugaucuccuuugacuccaugucucacauucaggugaugcugaugcaagagauaggcuccuguggucuuggacaguuccaccccuguggcuuugcaggguacagacuccuucuggcugcuuucaugggcuggcauugagugucuuggcuuuucuaggcacauggugcaagcuguugguggauauaccauucuggggucuagaggaugguggcccucuucucacagcuccacuaggcaguggggauucucugugggggcuccagccccauauuucccuuccacacugcccuagcagagguucuccaugagggcucugccccugcagcaaacuucugcuuggacaugcaggcauuuccauauguccucugaaaucuaggcggagguucccaaaccucaauucuugacuucugugcacccacaggcucaacaucacauggaagcugccaaggcuuggggcuugcacccucugaagcaaugaccucuuuuagccacagcuggagcugaagcagcugggauguagggcaccauguccugaggcggcacagagcagggcagcccugggcucagcccaggaaaccauuuuucccuacuaggugucugugccugugaugggagggguggccaugaagaccucugacauggccuggagacauuuucuccauugccuuaaugauuaacauuuggcacauuuuucagauacacguggcuguaaauaugcauuauuuaugcauauuucugcagcuggcuugaauuucucuucaaacaauggguuuuucuuuaguauugcaugaucagguugcaaauuuucuaaacuuuuuugcucugcuuccucuugaaugcuuuucucuguagaaauuucuucugccagauacccuaaaucaucugucucaaguucaacguuccacagaucucuagggcaggggcaaaaugccaccagucucuuugcuaaagcauaacaagagucaccuuugcuccaguucccaacaaguuccucaucuccaucugagccuggacuuccaccucagccuggacuucauuguucauaucacuaucagcauuuuggucauauccauucaacaagccucuaggaaguuccaaacuuuccaacaucuuccugucuucugagcccuccaagucucuaagaaguuccaaacuuucccacaucuuccucucuucuucugagcccuccaaacuguuccagccucugccugauacccaguuccaaagucgcuuccacauuuucggguauccuuauaagcagcaccccacucccucaguaccaauuuacuguaucagcccauucuccacugcuauaaagaacugcccgauacuggguaauuuauaaaggaaacagguuuaaguggcucacgguucugcauggcugaggaggccucacgaaacuuauaauuauggcaggaggagaagcaaacacaugcuucuucacauggcggcaggagagagaagugccgagcaaagggggaaaagccccuuauaaaaccaucagaucuugugggaacucacuaucacaagaacagcagcauggggguagccacccccaugauucaauugccucccaccaggucccucccaugacacguagggauuaugggagcuacaauuugagaugaaauuuggguggggacacagccaaaccauaucagacagguuguggugcugacugcauguugacuacuacacugaaacaugucccuagguuuccaaaccaaaauccagaaccccuuaucugauuaagaugugucagugauuuacauuauuugagcacucuuggcauguuggaguuaauuuuaaauuuauuuucagguuaguuuuauucgaccuuuggaauuuacuugguauacacacacacacaugugcacacacacacuuaucuuuaaauauguauuuucuaagucucauucaucucccuuauguuaaacuucauuagcccuggcuuggcuugugacuauugauuauauuauuauuugaaagaaaauauuugaaauauuugcaacuuuccugagauuuuacuuuuuuuaaaaaaaauagguauacuauuaugugacuagcauccaauuaacuguaccucagauauuguuagaugggaguaaaaaauaccuguaugugcuacaaugaggcuaggaugauuaaacaguaaaaacaaacaagcaaaaaacagaaaugcaaaaaauugauguaauguugacauugcaaaauagugaauaaauguuuauucuguugguauuuuucaaaauaauccuuucucuuuguaaauugguuuguuaacuuuuucucggauuaggagacagagaggguaaacaguuuguuuaaacauaugggguauccagaccaacuguaauuuguguuuuuauauuuggacauuuggcacuacauuuccuucugaauuuaauaggcauuacugaaucacuuuucaauccugaguauggaaguagauuauguuccaaaaguuuguguuuaaaauuagccugaaaauagcugaaaugaaaaagaugaaaaauaccaaguguugaugaggauguagaaaaacuggaacucccauaccuugcuggugggaguaaauugguacaagcaauuuuggaaaacuccuugguaguaucuucuaaaaugagcauauauauaccuuagaugugagagccuucauuccuagguauauaugcccccaaaaugccuacauaaacccuaaagaaauaccuaaagauguguacuaauacagugauugugaaaggaaaauaaaauucacuaugcaaaggaaaaaaauaagcugaaagcugguucaugcaagaagcugcaauucauuuugcuucuaagcagauagguacaguaaaaguuaaauaucuccacagguagcuacucuauauuuaccuuaucuuagccucuccugggagaugaauacaugauuaacuauucuccugucuccucguuuucucuugugacauguggauaaucauacucucccuuacagcccacuuuuccuccagcccuuucuccuccagcccacuuuuccccuuuaacauuaucuuuggagaaaggcacagaccacauaauguuucuaugauucuguuuauuucuuccagucauauccuucacguuggcaaaagaaaauucuaaauugguggagaccugucucagauacuuuuugguuuacaucaucaaaaguacuguucuugagagcaagguuuuccauaguaagauucauaaagagaguuucuuuccccuuuuccagggucaggguuaauuuuaggccaguuuuggcccucucuuaccuucguggguccuuuucccuagaacccuguguugccucauagcacgggcuugugcaucuacccagggccacuuuucuuuacaaaacuccaacauuaucugccacaccacuguccccaaaucaagccccauuucuuccaggacagccagaugugagguggagcauggggagggcaggggaggcaaauggauugaacagaaucauauguagaugugaauaacuuaacccccuaaacccucccugagcaauuuacauuugugaaaagggauguuuaccaacccagcugaauuauuauuugguggaaauugcaagcaaugggaacaggaagauagugucagucuaauaacagagagauacucucugaaagaaaagauguuuauuugggacugagcauuguaauggaaauacuuaugccaaaauaaacuauaguaaacuaugugcauauucagggagguaaaggaagacaaagguuuuuaaaggaaaaaaaaugaggaggauuauauaauuguuuugaaauaauuauucuugacuacaaagauuaauaauaagggugaugccaguucaagguuuaaugggaagaugcccuugcagaagcauuuuguguguguguguguguguguguguguguguguguguguguguguaagguugugauggccuuugugcaagguugugguuuucguaguguuuuuuguuaucugcguggccuucccagcucuauuugucaggguuuccuaccauuagugauuacauuuugguucuaacagauuucacaauggucauuugaaauaaaugaagcaccaguugacauauuggagaaauaaacguaaucauuuucccagauuaagacauauuuauguaaucugaggcuaacuagaaggagugcacuagucaauuuuugauguguaacaaacacccucaaaagcuccguggcauacaagaacaaaucuaucuuuuuaugcucauggguuuacaggucagccgagacuuggcugaucuagacugggguaagcuggacuccaagcuucagucagguucagauuuguuucacgcaucuucauucuagggcuaaggcugaagucgcagcagcuaccuggggcacacacuucucaugcugaggaacacaagagggcaagccgauguaugcaugcacauuuaaagcacuuacguuacaauuaccaacagcccauuggccaagccaaugcacauggcugagccccaagucaaggggcaggauaguauucucaccuaccaugaaguuuuggcagggguggaaaagcauaauuuuaauacagcaagucaugauccaaucuaucagaagagauagauaguaacaaauuugagacacacgguguugauggcaaauggcuuccuguguugguuggcuaguugguugguuggcuuuuccccugaagucaggcagaauucauauuacaacuugcauacauaauuugagaaauaauaaacauguaaaauuacuuucaaucauaaacuuguauuuauuccuuugaggaagggaaaaguacuuauuaaaaaugucccuuucuuuuuccucguucagccucgaugcugauucauauccuacugcccaugguuuucugcgucuugcucaucauggucaugugcuacuugaaaagucagugguaagugugugaggaagguuuuauccaagaagagaguaagagaaaagucuggaaagagauuuaguaagauagaaaugacauugaauaauaugaaacaacguauaaaaaaggaaaagaacaaaggaggcuggggugagaguauguaauuuauuucacaauuuuguuuuccaaguggcuauaugaggaaacuaaucaccauuuaaaauagaccacaaaauuuuuucaacagcaauagcuaauauuuauaucucucuuacuguauguuuggcaauguucuaagugcuuuaucaauuaauucauuuaauccucauggggacacuauaaguaccauaauuaucuccauuuagccauaagaaauuaaagcauggaagaauuaaguaacuugcuuaauaaguuacaacgcaaggauuagaagccaggaaucugacuccagaguucuugcucuuaacucguccacuguacugugaaauucagucucauuuucgcuuuuuuuucuaggaucaaggagaccuguuauccugacaucccugacccuuacaagagcagcauccugucauuaauaaaauucaagguaaauguuggcaaauuguauguauaccauauaccuauuaaggacuaacccagagugggggcugucagaauccuacuuuccuagagcuccucaggaaaauauagcacaguaaaagccaucuuugcacccacagccaugaaauaggugauuggagcuuugauuucuucugucaggggaaaucuuuugguuuucaacaucaccuccagguuacuugugaccaggaagaaacaugaagaacauugaagcucuaaguguauuucacaugcuuaauauacuuugaugcaugcaugcacacacacaaaugucuauauuuacauauuuuuguuuccuuucuaggagaacccucaccuaauaauaaugaaugucagugacuguaucccagaugcuauugaaguuguaagcaagccagaagggacaaagauacaguuccuaggcacuaggaagucacucacagaaaccgaguugacuaagccuaacuaccuuuaucuccuuccaacagaaaagaaucacucuggcccuggccccugcaucuguuuugagaacuugaccuauaaccaggcagcuucugacucuggcucuuguggccauguuccaguauccccaaaagccccaaguaugcugggacuaaugaccucaccugaaaauguacuaaaggcacuagaaaaaaacuacaugaacucccugggagaaaucccagcuggagaaacaaguuugaauuaugugucccaguuggcuucacccauguuuggagacaaggacagucucccaacaaacccaguagaggcaccacacuguucagaguauaaaaugcaaauggcagucucccugcgucuugccuugccucccccgaccgagaauagcagccucuccucaauuacccuuuuagauccaggugaacacuacugcuaaccagcaugccgauuucauaccuuaugcuacacagacauuaagaagagcagagcuggcacccugucaucaccaguggccuugguccuuaaucccaguacgauuugcaggucugguuuauauaagaccacuacagucuggcuagguuaaaggccagaggcuauggaacuuaacacuccccauuggagcaagcuugcccuagagacggcaggaucaugggagcaugcuuaccuucugcuguuuguuccaggcucaccuuuagaacaggagacuugagcuugaccuaaggauaugcauuaaccacucuacagacucccacucaguacuguacaggguggcugugguccuagaaguucaguuuuuacugaggaaauauuuccauuaacagcaauuauuauauugaaggcuuuaauaaaggccacaggagacauuacuauagcauagauugucaaauguaaauuuacugagcguguuuuauaaaaaacucacagguguuugaggccaaaacagauuuuagacuuaccuugaacggauaagaaucuauaguucacugacacaguaaaauuaacucugugggugggggcggggggcauagcucuaaucuaauauauaaaaugugugaugaaucaacaagauuuccacaauucuucugucaagcuuacuacagugaaagaaugggauuggcaaguaacuucugacuuacugucaguuguacuucugcuccauagacaucaguauucugccaucauuuuugaugacuaccucagaacauaaaaaggaacguauaucacauaauuccagucacaguuuuugguuccucuuuucuuucaagaacuauauauaaaugaccuguuuucacuuagcauccuuuggacucugcaguagguugucugggucaagauaacucucagucacauuuauauucauauuaugcuaaaauaguaaaaugaaaccucauuguuggacauaauuuagauauaacuaaaaaguucuaugaagugggaaauuccguguuggcucuggagcagcuuugucuccucugaaccaauauaucccaaaccaauauaugcaaagcaccugguacacaacugguauuuuaguacauguugguucuuuuggugcaaucucagcucacugcagcuuccgccuccuagauucaaacaaacaguucuccugccccagccuccagagcaccuaggacuccaggugcaugcuaccacaccugacuaguuuuuauauuuuuaguagagauuggguuuuaccauauuggccaggcuggucucaaacuccugaccgcaggugauccaccugccucagcuuccccaagggcugggauuacaggugugagccaccaugcccagccuauuugucacauuauuugucacauuuauuuuacuuuuauuuauuuuuugagaugaaauuucgcucuuguugcccaggcuggagugcaauggugcagccuuggcucacugcaaccuccgccucccagggucaagcaauucuccugccucagccuccugaguagcugggauuacaggcaugcaccaccacacccagguaauuuuguaucuuuaguagagaugggguuucaccauguuggucaggcuguucucgaacuccugaccucaggugaucugccugccuuggccucccaaagugcugggauuacaggcgugagccacugcgccuagccgucacauuucuaaacaagcaugaaagggguucauuuuugucuucuucuugccugccgucagcaugguggaaauggcucugccuaugcucaugcuucuggugcccaaugccuugcacugugccauucaacacuaugaagagaaacaaguagccacaccucaaaauaauguggcugucaacaacuggccuaaauaaaccuacacaaaccaguacuugccuuuugcuggaaacauugauuaugugcuccucacguaguagaaagcgguauccugauuagucuaacaguuguguuagacuuuagggccaguauugucagcauuuauuuauuuauguaccuuuguuaugaugggauauuuuucauuugaaacuuguucauaaaaaugucaaugacauugaugacugauuuguacauauuuuucauauaguuuuguuuaaaaaauaauucacgcaaaaucuugaagucauuuuugcuauugaaauaaaccuuaauuaaaauauuu

SEQ ID NO: 17726 - RNA, 114410 nt, Homo sapiens
ccuaacccucucucccagaacgugucucugcugcaaggcaccgggcccuuucgcucugcagaacugcacuugcaagaccauuaucaacuccuaaucccagcucagaaagggagccucugcgacucauucaucgcccuccagguacagcacugcugggguuugcuuccuuccuuccuggcuuugugucccauguccccuuagaccuguccccccuuuagauuucuuuucacucugcuuuaauaccaguugugagggucucucagggcucugaccuuaccucuuuguccuacaaaaguguauuucuugugugguuuccugugaccuguacuuacccagacuuucuccagucaauccuuggcauccuacagagauggucuuccucagucuucagucucuguaacgauaccagcccuuguuuagagacccagaguagaaauggucacuguauacaguuguacaguuucugcaccgcacagacaccugaggaagagagcaagugguuaggaaaauccagcuugcacacugcucaccaagaugaaugccugaagcugcucuguggaaaccuagaggaagguacauuguuucgcuuuuuuuccaugucagauauugauagaaucacauauaacuacauuagauuaucagcuaaaaccagauuaguguguuuuauugucaugucauuguguaugugaacaugaagacuuuuagagugccugaaaauauuuuaugagaaauaguuaaauagcuucccuuuuuauuuuucauuacuagaccuuauuucuuagagcaguuuuagguuuauaaaaagccagagcacaaaguacagagagcuucauauaccccugcccacccuguccaccccacucccagucuccccuguuaguaacaucuuauguuagugugguacauuuguugcaauugaugaaucaauauuaauagauuaguaugaaccaaaguucaugguauacauuacuauguauacuauguauacucuucguguugugcauucuauggguuuugacaaacgugugaugacauauaugcaccguuauaguaucuuacaauagcuucauugcuauugcuaaaacucugcugugcuccaucuguucauccuucuuuucuucccugccuucuccaggcccugacaaccacugaucuuuuaaccaucuccaucguuuugaggaaaguacacuuuuuucuuugcacaaagaacugucuacuagccaaaaccacaggaugcuucugcccagaggaacaccauuuaaaaaaacaugcgcaaagguuuuaucgcagccagccaaugccuugaauccaagcucuaacccaauucaagaccuuucccuggaucacguccguguguccugucucucuuguuuccccuuauccaucuagcauauacuuuuccugguaaacguuucuauuuuuuucuguuuaggcugcuguaacaaaaauacgauagucuggguagcuuaaacaaaaaucauuuauuucucacagaucuguaggcugguaauucccagaucaaggcaccaggcagaaucagagccuggugagcacccacuuccucguucuuagaggaccguuuucuuaucaugucuucacauagcaaaagggacaagggagcugucuggggucccuuuuauaagggcacuaaucucacucaugaggccucuacccucacaaucuaaucacuuccccaaggccccaccugcuaaugccaucacauuaaggguuaggauuuuaacauaugaauuugggggagacauaaacauucauucuguugcaauuaccuuaugugccccucucaucuacccacccgucuaucccccuccucuucucugaugcaucuucuaugucagcccugucugaaagcauuuucugcaaugaugagaauauucuacaccugugugguccaauauaauagccacuagcugcauguggcuauugagcacuugaaaugugucucaugugacagaacugaauuuuuaaguuacauuucauuugaauaauuuaaacuuaacuccauguggcaagcaacaauuguauuagacagcauagguuuaaguuuuuaccuaugccagauuccccauucuaacagaauucauuaacaucccccccaguuucauacuggacaucuuccccuccccugccuuuuuuauguuuuuuguuuguuuguuuuguuuuguuuuguuuuuugguuuugagacagagucuagcucugucacccaggcuggagugcaguggcucgaccucggcucaccgcaaccuccgccuccuggguucaagggauucucccgccucagccuccugaguagcugggauuacaggcgugcaccaccaugccuggcuaauuuuuguaauuuuaguagagacaggguuugaccauguuggucaggcuggucuugaacuccuggccucgugaucuauccgccucggucucccaaagugcugggauuacaggcgugagccaccacgcccagcugcuccuucuccuugauucuuuccuggcuaaucaggaaagauacaauuguuccugaccccauugcugaaauagucagcuacuauguccgucacauuuauuaccauuaaauuugcaaauauauguacaaccauuauauauccauacaaacuaaaaauaguuuuaaaaguauuaguuuaauuuaauuaaacuauuaguuuuuucuaaaaaaauagaaaaaaugugcacauauggugccgucucacguaacuuuuuuuuuuuuuuuuuuugagacggagucucgcucugucgcccaggcuggagcgcaguggcgcaaucucagcucgcugcaaucuccaccucccagguucaagcauuucuugugccucagccuccugaguagcugagauuacaggcaugugccaccacaccuggcuaauuuuuuguuuuuaguagagacaggguuuugucauguuggccaggcuggucucaaacuccuggccucagcugaucugcccaccucaggcucccaaagugcuaggauuacaggcgugagccacugugcccagccuuacauaauguacuuaaaauuucuuuaauuuaugaagcuaguugauguugcuugucuauaccuuuuaauucuuuccucuuuuuuuuucuuaaagaaauuuccaauuucuuuaaaauuuucuguuuaaaacucuauacucccagaaaacagaguagaguuacauaacuaaugcuuuauuuggcaaaaacuacaaggccauaguuagugggcuaauauaugucaguucagaugauuguggcaccaccuuuaaggcaugaaaaggagagaagggaagaaauaauaacaccaaaagaaauuaagaguuuaaguccaagagucagcauggaguggaguuaaggaacuauggauugugguucuugggaggcuggaguuagugguaagcaugucugugccaccaaccaguccagggcauuggugauaucacugaaucucucagagacucagcucucugcuucacagcaugcagguuuucacuagacccuccaauuuaaggugucuucuagaucaaaaugcucuuuaggucaaacacagucuuaggaauaacuaggaaaguugaaacaaacuuucgucacacagacuguuucacauuaucccaccuccugucacccccuucucccaccuagcaauguuugugacgaauacaccaacuuuccugaggacaagagcaaaacaauauuuuaagaaacaacaaaacucaguuuagagugagucacugggccugaccaugguggcuaaacugaccacaaaaguuugugaauagucuauaugguguccuucaaacaucugcacaaaccuuuuauuuccagugcuuugaacagaaauaaacauagucauuaagccaaauucuacauucuacaaaacagaugaaaaguuaaagcauaacguuaaguccaaaacauuaguguggaguccucagcugaauaccucuugccugcaugcccaugugagcagucaguuaaaugccuggugucuguuauaugagcagugggaaaucuuugcauacaaaaaagugugaguuguacuaaaguaaaaucaguauucuggaucccuuaaugugcacauaauuaccacuuaggcuucuaagcgaaaugauuugcuaauggcaacuaaaaugugacauggcccagagugaaaaaauugauucauaacuugggaagguuugacuagauugcccuuaggcaagugccuagagggcuuuccugucucucccuaaaccuugcuucugcaguuccaauguacaaaauagggauaggguuguugugaagauuaaaugaaacuagggcaggucuucuggacagauacuauuacagugcugcaagcccuuccuucagaauccuuggcaccauuacaguucuacauuuauuuauaucaucauuugacuacugucccucagcugacuguacauuccauaaggacaggauuuaugucaacuuuuucucaacauugcuucaccaccuccucauagaaccuggcauauaaaagggagucaacaacaaucuuuugaaugaaauguguaagucauuugcagucacuggugucagauccccggguuugaaugcugugugcuuggacaaguaauguuucugccuuugucuuaguuccugcuuucuauaaaggggagauaauaaugguaucuacuugacugaauaguuguacaaauuuagugggauaauacuugcaaagagcuuggaacagugucugguacauagugaggacucaauacaugcuaaugaauuuugaugaugaugaugguggcgguggacaugcaauaagcucuucauaaauaauagcucuucuucuaauuguuauucacggucaucauugaaacaguauuugccucuugauuaucagucauaggugguccuuaguuaccuaaaauaucacaggaccacugcuuuaccuuuccauguuaugccaggcacagacaacagaggcagugucaaaggagauacccaaaugauguuuacaaugguacacgggucucuaggguccaaggaaaaguuaccaaguauuuucccaccucccuacuuucaucucccucuuacuucccagucccuuccccccaugcuuguauggucuucuggcuuuuugaccaguccucccuggggauuuucaaguacccagcuugcaaaucagccuccccagaggaucugucucuacucaucauagucaaaggauguaaucuguucucauguggaaauaauuuguucagagaauguaaaugaucaaagccuauauuucuguauucaggagaggaagagaaaauaauagaaaagacuugaggcuaacucuagguccugcauuuacuaagucaccucugauaaauuacuugguaaauuaugucuuagaaaaaccauugguuugguaggaauaaucaaaaugggauccgugucccggguuuguaagaauuaaaugaguuaacuacauagaugguuugguuccaauuagauaagagaguuucuaaacagugaaaaguagaaauuuugccacacccugcccucacaauucuagcauuuccagguuuccaaaucugggaaauguagcuaagggcuuuuccuuucucuagggacucccuuuacaagugguggagcuacuuucugcucgaggacaaagaaggagggaggacacacacacacacacacacacacacacacacauuuucuucucugccuucugacccuuugcuauugcaacucuaauuugggaauuaaauuuuaauaauucuaaaaucccauuuccguacuuuccauauacuauuauuuaauggaauaagguuaucaaaucuuauccuuaacccuuuucccauuuuuuuaaauuugaugguacuagauuugaauuuuauagcauuuucaagaaucacuugggauuaauuugggauucaauuucacuugagaacuagcuguuguaaaguugaauuauuuuuaauaagcaaaauuacuuucauccauuuuauuuuuuuaauaguuaaggaacauucacuuugauauucauaguccucuaaaguauaacauaagcauuacuauuucuuguuuaaacaugaucaguagcuaaguuguaaaaaaacauggggaaaggaguuagcccuacacuuaaaggaggcaguaucccaaagaauaugauuuuuaaaaugagaucaguaacauagagcucuucauccuggcuaacacagugaaacaccaucucuacuaaaaauacaaaaaaaaaauaaaaauuagcugggcgugguggcaggagccuguagucccagcuaguugggaggcugaggcaggagaauggcaugaacccaggaggccaagcuagcagugagccaagaucgcgccacugcacuucagccucggcaacagagugagacuccaucucaaaaaaaaaaaaaaaagaaauaacauagagcucuucaaaguagaaguacaauaaauaccaauaaacauaugcauaauuggaucuacuuuauuuuuauggguaaaauguauaaaugcauugcuaaccuauagauagaugauuuggggaaauaaugaaaagcucagaguguuucauacacuuucuagaguaauuccaguucuaaagaaaaauuuccaggcaaauucucaaguucagaucguaaugugccuuuuauccuauuaggggucauuucuuuccugagcauuguaaggacaauaucugagaugugcuugauuaauccauagggauuuaaggccuuuugaaaaagacauucaaagaccuaagcaaauauaccuucugauuuuuauaaauauuuuauucuuuacuuauuugucugagcaaaauugcauaacuuacuagcaacuccaaccacauguaacauuuaacuuaaaaaacaaguagggaagaaaaaugagguuuaguuaaaauugaaaauuaauuucuuuucucuguaauacugacuucugugaggauuuuuaacaaugaggucaauaaaaguauuuaaagccacggggaaugauuagacagucucaucauccugcauacaguguccuucauauuaaaauucuuccucaagcccuuucuucuccccuuccuuccuuuucagacugagcaccugaucagagaaaaccugcuugacuguguagcccugagaguuugguuucccagaggacaguucuaggccucucaaccuagaacuuuccaccugugugaccuugggcuaguggcuuaaccuucagaaccucagucuacucaucugcaacuggguauccaugucacauguuaauguuggcauuauauugaauauuggggauuuugcuaaugagagaaugguuucccucacaaccuccaauugcagcuaacuuaugcuuugauauaauguugcucuaggucaaaaauaaaacaggccuugugauauguauuaauggauagagucagaaauacagauuccaaauucuacaguagcaacugagaaggaacagaaggcagggcauaucuccaggccagggccuuugaaucccuacaccuaauguaggcccaggcacaugguaagcacuagauacaugugcuuuugaagggucuuuugauggauuuugauaaguugccccgacuagaaugaagcugguaaaacuagaaggcaauagagauucauggguuaggagcaaaaggugggaaucuagcccgcuggguucaaacuccagcuuuaaagugacuuugggcaauguuauuucucagauucuggguuuaaaucugaucauucuucucccuauuugucccccaucccguacacucuuuuaaaacaguaacaaccaccaccaccaccaucuuuaauagcuuuucacugccuuuaggauaaaguuccaaauguggcccacagcaucuggucccugccuaucucaccagucuucucuugcuaguucuguuagcucaagcaauaguggccuuuuuuuuuuuuucaguccuucggaagugcuaccugacucuuucuugcuccugggccgucuuguccaacagcaucuugucucaucugccuggagugauuuucaccuccagcaccaguaacgccucccuguuugccggaauaacuuuuaauguccaggcuuaaacaucuuuuuuauccgugagguuuuucuucccaucccugucuagguuaggaccccugguauaugcuccucaguuucccucuuucuugacacucacugcauugggaugucuguuccccauuagacuccaugggauguuuguguguuuguagagggcugggguggggagggguaaggggcaggaggucuacuuuuuucaguacuguauucccaggguguaguccuguggcuguucauaaaacucuccaaauggaugagugaaggauuuaauaucgagagaccaacaucagucuaccuuauagacuggugaaggguaauguagaucagcacaauucuuggcacacagugucucagucaaugguggcuauuauuaauaacacaaaugcuuaauugauggauuucuuucauuucuaaauucuuugguggacacuuuuccaaaaaggagaguuaaaggaagauaugcaagcugccauuuugcacccauucaucugaaaacuauuugagaguuuuaaagcagaacgaguugaaacaaugugccagaccuaaaauuggaagcaacacagaaaauggcuuugaugugauggaucuaguauaauuguguguuugcaagggccucgggucuggcuacacuccagguguaagcaucccuaacccagucuaucaaucagauguuaccaguuugaacguuucuguuguuuuuuaaacagaaauaugaguggugccuauaggaaucuacauguuagcacuuggaaaaugacuacagugaguaucacauaaaaacaaaauuugcaaaagauaauuauggaauccacaugaaagucuuacaucugaggcuucuacaugaauaaugaaaggugaacacucuaacuacaguuagaauucugagguaggauuuucauaaugaggaccauguuauguacagcuugguguaacagacuuguaucuucuuuuauuuaaacauuauaagugugagacuucuuuuauuuccaacugaccaggucucuuaaguuauaaacuuugcugaaaauuuaacauagguaggacaguuugucauaauucuuagcacuggaagaaacugugaguuaaaggaacgaggccauaauguugcuaugucaugggucagagccgauguuuuaaaaugggggcuuuucauugacacccgggugacaagagugaaacucugucucaacaaaaagaaagaaaagaaaaaaggaaaccaaaagcuuuuaccagaaccccaggcaaauaucuacuuaugucucaguggcuggggaaguggggaaaaggggaagcggauaccggauaaguaaccaaaagugaugcuacacucggcuuaguugcuuccuauuagcccaguugcagaugggaaacagaaggggauugacugcucugggucaucaaucaugcucucuugguggggaguggaugaagaagagaagaugugacaggucauuucuggcaacuuccaagucuauaauagccuagcuagcaagggaacuuacggacaauauuuugccauugacuuauauuuuuuaaaauuauuauguuauuuagaguaaaguagauagccauaugagcugaccuagaugcuuuccuccaugaaaaaaaaaaugagcaacuagguuaccauuuacaaugguucauaugugacucugaaugacugugugucccucuauuuuagaaauaucugggccuuccugauguccagguugacacacauccuguuuugccaaguuggaaagaguucugaaaaucccauuccauuuuauuugaagaaacuaccacagcauuucuucuucuaacccuaaugggaagcacauggagaucauugaacguugggagcccuuuuaugcccaaauuauguuuuuuaagcaaagagcuauguuaaagcgaccuccaaacaugacccuggcaaaagucaguagccuugcuuguucuggccagguuccugauguaacccaagguucugggaagauucacuuuaauuacaaccccuuuugaucuguuccucauggucucuuacauaacauguauuacaguuacuaaaacugaaauuuucaucuuugagcuaauuaaauggauguaauuuguacuugacuucuuuucuuuuagaagagcugguuaagucaguauguuguacuguuuuucuaaagcacgcaacuuaaauucucuuuauuucuuuaauuuuugauuuaaguaaaacuuuagcuuuuguauucuauuacaaagauaauaaaaacacuuauggcaucaucuaauuuuucuuuagccaucauacaauauccuaugaagaauauuucuuuggaaagcauuuucuucuuuuuuaaaaaguaaauuuuacuguguauauuugaggcuuacaacaugaugugaugagaugcauguauuaauagauaguaaaacgguugcuauaaugaagcaaauucacgcaucuauccucucacauagucacuuuugugugugugugugacaaaagcugcugaacucuacuuauuuaacaaaaaucccuaaugcaauacaauuuuacuaccuauaguccccauuuuuuacaugagaucucuagguguguucauccuacuuaucugcuacuuuuuauccuuugaccuacaucucccuauuuucuccccacugacccauaaccacuguuucauucuccuugucuauuugauuuucuguuuuaagauuccacauauaaguuaggucuugcacuauuuuuuuuuucugugucuggcuuacucacggagcauaguguacagguccauuuauguuguggcaagcauuaggaucucuuucuuuuuuaaggcuaaauaauauuccaguguguguguuuguguauguguguauaugcauauauaccacauuuucuuuauccauucauuuguugacacuuagguuguuuccaugucuuggcuauggaacaguaccacaaugaacaugagagugcagguaucuuuaugagugggugauuucaucuuuguguguauacccagaagagggauugcugggucauaugguaguuccauuuuuaaauuucuuuaggagccuccauacuguuuucccucauggcuguaucaaucuaaauucccaccaacauuguacaagcauucucuuuucucuaccaucucaccaauauuuguuauuucuugacuuuucaauaauaguccuauuaucaaaagggugugaaaugguaucuaaugaguaugagauggugucucacaguggcuuuaauuugcaucuccaugguuguauuaauccauuuucaugcugcugauaaagacauacccgagacuggguaauuaauuaaaaaaaaaagagagagauuuaauggacucacaguuccacauggcuggggaggccucacauggugaaaggcaaaaguuacaucuuacauggcagcaggcaagacagaaugagagccaauggaaaagggaaaccccuuauaaagccaucagaugucaugagacuuauucacuaccaugagaacaauaugggggaaaccaaccccaugauucaauuaucucccacuggaucccucccacaacacauaggaauuaugggagucacaauucaagaugagauuuggguggggacacagucaaaccauaucaaugguguuuagugauguugaguacccuuuucauauaccuguugaucauuuuaugucuucucuggagaaaugucuguuuagcuucuuuaccccuuuuuaaaucagguuauuuauuuuucugcuauugaguuauaaauguucuuuauaaauuuuggguauuaaccccuuaucagauacguguuuugcaaguacuuuuucccagucuguagguugccuuuucuuuuuguugacuguuuccuuugcagugcagaagcuuuauaguuuguuguagucucauuuauuuauuuuugcuuuuuuagccugaacuuuuggugucaguguuuucuuaauacacuaauaaguucucaugagaauugguucguuuccaaaaagccuugcauggugcuuauauaugaaagugaaaaucuacauuacuuaacauaaagcauaugauuaauacuagaaacacuccauucuccauguaucaugaaaauauuagcauauguuagaaugcaagaucaaaaaaguguuauaaguuguaccauauuacugaucaugaaauuuauaacucauaauuuuggccuucaguucaacagcagcucuacguaacaagcaagcaucaauugaacacguuacguaugugcaaggcacucugcucugaguauagggaggaauuagcauacugcagugccuguucucaaacgacucuuauuccaucaagaggaaacagacaaauaaacaaauaauuacaaugcaaugcgaucaaacacaaugauaaaaaguuacacagagaccggauuuaacucuguuggaggacggugaagauagggcgucagagagguuucagaaggaaggcaaugccugaugaauagcuucuugauugaagggugcugaggaaguggcagcagggaauucccugggcagaaggaaaccaaguaagcauugugauaaaagugcagauuaacagugaugagaaccgaaacuaagacagugccagugaaaugcuggcaggggaugaaucugcaguacuuuggagguaacacugaaaaccuagcaauuugauuuaguauuguccaaaaagguuacuaaagaugaagcuuacuggugguucauggagauaauuuugcuggccuugucuuuuuaauagaucacuugaugugaagcaaaguuuuaacaaacacuauaugugcauaauuuauuuuaauuugaauauuauauauauauaaaugcccaaggcuguuugcauaaauagcauaucucuaagguauuuguucuugcauagcaacagacugagggcaaaauaagaaaacgauguaaguauuuagugaacauggagaaaaaaccaaacugagucucacugauccuuccaacuccuuucugccugauugaaggauuuacuuggucaccuaccucugcauauuaguucccaauccugucuaauaaauugccaagcaacaaacugccugauuuauucauucugucaguauguucugagaugcuuggaacuggagacagagaaaucaagaaaaggcuguagccaggcauggugucacgugcuacuugggaggcugaggagcagggaucacuugagcccaggaguucgaggcugcagugaucuaugaucaugagacugcacuucagccugggcaacagagaggacaccaucucuaaaaaaagaaaaaaaaaaaaggaaaaaaaaagaaguggucauuuguccaguguaauaagcacauucuuagaagugaggcuugcaagaaugcggagaagugagcuaacucuaccugguggcaaaagaaacgcuucacaaaggaagugauaaugcagcuuugaagguuugaagaauggggaaaaggaggaaugugugguggcauuucaaauauaggauacugugcgagaucacauuauuguuuccaauuacuuguuccaucucccugugacagguuuauauuucccugccccauuuaaggucaauuuuggccaugugacuugcucagcucaauaaaaugugaacagaagugauuugugucacuuaugagcaaaauucaucgugacauuccaguauuacucuucucccucugacaugugagaaaaccauuuccagaaaggaccugcucauuucacuucagucccagaaaaaagaagacucuuggaauaaagcugaggccaaccugcagccaauguguaauauacaagcaagaaauagaccuugcuguugaaaaccuccaagacaugggaugcugguuacagcagcguaccuuaggaaagcugauuaacacaaaaauagucacugaaaaggcacaggacuaugaaagggcauggagugguugcggaauggugagaaguucagauuggcugagaguguagacuccgcguuuagagaaagacagccagaaauacuccagaaagguagccugggaacagauuuucaaagggucuuaaacguccugcuaggaaaguugaguuuuagucuuuaaauaguagaaagccagcagaagcuaaggagugaccugauaaguuuuuuuuuuucuuagaaagaugauucuaauaggaggggaaugaugcuaguaccagggaaaucagcuaaagcguuuuuauaauccuaaccaccacuauuuauugugcacauaccaugugugaggcauuuugcaccuauuuaccaaaguaauacaaccacccccugggguagacauuguaaugauccuuuuuuuauagaugaggaaacugaggcacagagagguugaauaacuuggcuaagucacuccaaagacauuguagcauuagaguuccaucccaagcagucugggugccagaauccauaucccacucucagaagccuagaaagugguaauaagcaucugaagcacacggagauagagaagaacaucucgagucucauauuuauggggcugcagaggcugaaggugggcaugaggugaagcuuaggggugacagagauggaggagccacagauaaugccucauucuuuacugaagaggcucaauuggugcugaagcaaugaauuggaacgagggaaaaaaagagcagguuuaggaaaggaaaaugacgaguuuugcuugggauacauuaauuuugaggcagaugugagguuagguggagaugaccuacuggcaguuagaauacgggaccgaagcuaggagcaaugugggguggagacagaucuagguggggcagaaggccagguagcagauuaauucacccuggcagauguagaaagugacuugaaaagagugucaagggaagaauuuggaggaaccccaugauuuaaggaguagaucuaggaggaagagccagagaaacuuugacugggaggcagugauaagggaaaggaagguggcagggagagaagagaggauggguuuucaaaaugaugaucaccacaaugacuuaaaacuggaggaauuaggaggcaaccacagccaccucuguuuguggcacacuccagccauagugacuuugagaaacaagaaccuccacuuccacagcagcauaaaucacauugcaccuuaugaguaucccaguggaggagguacaaggaugcauuuggguggagguggagaaaaaguagaaaaugagcuucccugaugaugacucucauagaauuaaguacuuuuauacuaauuuauaacugcagaacuuauuuaugaacuucuaaaaugacagauucccauaaauggggaaaaaagugcauugcuucaauuuacaggaauugccuaauuccaaacauaguaaugagaaggauuuaaaauuaaaauccuuuugggaacacucuucuaccuggaagagcuagcuuauuagagucaccucuuauguguucuccauuaacacuauuaaauuucaacagccuguaacuguugaauauuaagauauuugcauagaauuccccagguuuuuggaugaccuaguagaauaucacauuuuuaaaaacacacgaauagcucaaagcuacacagaguuuauuaugcaacauucuauuaggaauagcucaaaugaaugcuuuauaguagaagaaaguguugcaguauuuugucuauaacauaauugacuuucuuggugaguauaccucaaauuauugagguauguugagaugguguuuggaaaauguuccauggaaacaaagcuuggaaacuugggguuaaacaaucuugauuuuauuuuucuauugcaggacuucugagagccuucggugugcugguuuacauugcauagcucuagagauggguauuauguaggaguuccuaaacuuaacugaccauacauagacuccccucuuuuuuuuuuccaaaaauauuugaccuacuuuaugaaauguccuauauagcagauuauauuucuguucaaaauguuggcugcuccucccugugguaucccuuuucuguagaaauauuauccuucucuacuucacuggccccaaguguggccacgugaccuguuuuggccaauguaacauggcuguggguaagguguguuucuucuaucagacacucgaagagccagguguaguucaucuauucuuuguauccuuugcuacaagaccagcuaugucccaaaguuuguucugacaucuuagaguucuggagaguccuagaauggaaauguaaaugcauaaaacauaagucuuugaaauuguaagccauuaauauuuugcaucauuuguuaccacagccaacugagccuaaggugacuaaugccuucuacuucuaaguauuucuaaauuaucugaaccuuuaccacuuuucacagguguacucauucuguauugauugucuaaaugaggaaguguucuuggaauuauucuuuagguuaggacaguacacuugaaggugaacuaaaaaaaauauauaugaaacgugucuuaaagaaauggugucuaggcugcgcgugguggcucacgccuguaaucccagcacuuugggaggcugaggcaggcagaucaucagaggucaggaguuugagaccagccuauccaacauggugaaacccugucucuacuaaaaauauuuuuaaaaaguuagcuggguguggugguggacaccuguaaucucagcuacucaggaggcugagacaugagaaucacuugaacccgggaggcagaguuugcagugagccaggaucgcaccacuacacuacacacuacagccugggcgacagagugagacugucuaaaaaaaaaagaaauagugucuaguaguuaccuggaauuuuaucaaaaaugaguagucuugguugggcguggugucucaugccuauaaucugagcacuucgggaggccaaggcaggcgggucaccugaaguugggaguucgagaccagccugaccaacauggagaaaccccgucucuacuaaaaauacaaaauuagcuggguguggugguccaugccuguaauaccagcuacucaggaggcugaggcaggggaaucacuugaaaccgggaggcagacguugcggugagccgagaucacaccauugcacuccagccugggcaacaagagcaaaacucugucucaaaaaaaaaaaaaaaagaaaaagaaaaagaaaagaaaagaaaaaggaaaauaaaagaauauucucaggcucaauucucagagauucugauuuaaugggccuuggauggguccuaggaaucugaauuuuaaacuagauguuaccaaugcagcuugucuguuaaccacaccuuggaaaaaugccacucuaaagccacuguuugauuaacagucaugugauaacaugcauuuaaauaaaugucauuucaauuuaagaaggcaccauggaggguccuccuuggaauuccuggaagcauguaugaaaucaguuuuaucacauuugaguuuauauucauuacauuuuagugcaaaauauuuuaugcacaaaugauacuuucaugcuuaaaugccuauguuguucaaaaagccugauucuaagugacccuuagcucuuucaaaaaaauaaaaccaaaaccaaucugcuuuaaaaagauuaaguucuguuaccaaugaagaucaagggcuauuucaguugcaagugacagaaacuuaauucaaacuguguuaagcaaaacaaacauugguuacagagcuaaaacguccaugguuuuugagaggaugaaguucuugguugacagggcaggacaugucaaaacuggagagaagcacucugggaaggugucugggagguggggaugcuaucagucagugggcaggaagaggagggugugcagguucuugugggaggaagacuaggcaggcaaggcacuaucuggacagugugggaaaaggugaaggggcagucuaggcagaugacuggcaccggggagauuugcccaggugugguaaauggaaguccugagagcuggguagggaauaaucagaaaggaaggaguagguggguaggcagagcgagaggugucagucagcugaaaucagggcuccauuuacaauuagaucuagauacucaaaacguagcuucaaauaucugcuucuuuccaucaaucagcacuacauccuccuccauuguuagcuucauacucagacauuaagucaggaugagaagaaaggagagggaggagaaugaguuggcugaauaccaugaccagauguuuagaaaccaaaucauaaaaaucuuuuuaacuggugucuuugaaugucuuaagcuuuucaagaaauucuuauaaccuucaauaucuguuugugucaucagugucaguucaaaucgauuccacugacagcuugauaaaugauuuccaauuuuaucucagacaaaugcaguaugguucaaucaaugguuuugcuuaugugagcacuuuaggauuguguccgauccauuucuacuuaaaaauuuaguuucaguguugcuugacuaauuuucacaacucugugcuuugaaugugucugaauauugccccgaaucccucccuauaacaggcaugaagaaaaucugagauagaaauaauacguacuugauuacuugauccuuuaucacaggcaacuaacuacuguaaccagaugauucccugcugacacuauugugauaccugccaaagaaacugucuaaugucacguuaacacauuaaaaaugacaaccagccaagccucuaagccuucuuucacucuuggcauuuguaguuguuugcuuaucggauggugucacguuucuaugagucccagcgcuggcucgcauuauagucaaguggaaccaagaaaaugcuggcaagucugucauggaaagcuaggccuauaaugcacaggacaacccucuuuaaccaaaaauuaucuggcucuggaugucaagagugccaagguugagcaagguuaugccuguuuuagauaaucauaggaacucuggcucuuaccuguaagaaauugaaaggcaugaucagguuuuaagcaaaaggaagaaucauccaaguuacauuuuuaaacaggauuguucuggauaugauguugaccacagauggcaguggagcaagcaggaagcagagaggacuguuagcagauuauugcaauaacagacaagagaugauagugacuuagaccagcaaggugguuuuugagguucacaacuuuaaauuugguucuuuuaucccuaccauagagaugaggaaacagaggcucagggaggaauauaaccaggccacguggcugauuaaaccacggcauuaguaugugggcccagcagucugauuucaaagccauggucuuuccacagcauuaugaugcccuucccccaucaccuuccucuguaucucuuucucaaacaaaaugcaaaaccagugacacaggaauaaauccuagaaagagcaaucuucacaagguuccuuuccaggccuaccauuccaaguaucugagcuaaaccgacuugagcccgggucaccucaguuacccaaaucugucucuuuaaauuucccccuaaggacaagauuggucccagaacccagagcagggaugagccuauagguggggggccucuggguccuacagaggauggagaagagauaugagaggugggaaaccaguccagcacauuuucuggaucagcggacuguguaauguguguuuguuaauuugugccccaaaccacagcugcccauggacucagcacagccauuaguggauuucugacagucuauggcaggcagcccuguguucuucacaauugucacaauuuagacuuuaaacaauucagaguggucucuuuucauguauaggaagcucucucugggcaaacgguggguaaccagcacaucagacaacggcaucagauugcaaacuugucuccguaaauugaaguaaucagaaacaaacagauacaaaguuguuuuauaaaaccucuuaaaguauaauauacauaaauauaagugcauauaucauaaauguauauauuggugaauuuuuauaagcuaaacacuaagaacauuaucaguacccuggggcccccaccauccccuuccaaucacuacucuuccaagaguagcugccauuccugacuuuuaauacuguaaauuaguuuugccaguuuuugaacuuuuucuaaguggaaucaaauagaauguucuugacuuauuuccuccaacaucacauuugugagauucaucuguguuguuaaguuuagaccauuuauuuuugcuguuauauaauaugacauaugaauacaaaacaguugaucuguucugcuuggaugggcauguggauaguuuccaguuuggaguuauuaugaauaguaugcugugacaauuucagugcaugccuuuuggugaaaacaugcacaaguuccuguugaguauauacguagguguggaauugcaggguugcaggggaacaaaagaugucuugauaggaugaaauauaacauauucuagcuauagagguaaaacaauguguauagauauuacagggaagguuuggauaggcucaagaaugaaagcaaaaguccagagcuuaggaaaagacugugaccgucagcaugcaaaguagaguauagucuaagcuaaggaaaaugaugguguguguagauaguuagguaacuugcagaaaccaaguggcagcagugcuggguaguaaagggcuuucguugaaagaccugaguucgaacuugcucucaguuugacuguguaacugaggugugucacuugacagcucaaagccuugacuuucccuuacagaaaauuguugagaagauuaaauucauucauucaacaaugauugauugacuaccuacccaugugcugaagacuggagauccagcaggaaacaaaaaaguguccuuguccucauugauuuuacugggaaggaauacccaugguaaacaauggccauguaaugacaauuaugaaaauugcaaucacggaaucuaaccaguccggggggucugggaggagugucugaggcaaguagacaugagccaggccaagaauuggggugacaaauuucaggcagaugaaauagcaugagggaagucuauagagggaaggagccuggcauguguaaggaaaagagacagugaguguggcugacaggaguaagcagaggggagagugaagaccagaugcaguggcaggccgggcuuuuaagugguuggcuuaccuugauugcuuuuuuuuuguuuuguuguguuuuuuugagauggagucucacucuguugcccaggcuggaaagcaguggugccaucucggcucacugcaaccucugccucccagguucaagcaauucuccugccucagccucccaaguaauuugggacuacaggcauaugccaccaugcucgacuaauuuuuguauuuuuaguagagacgggguuucaccauguuggccaggcuggucugccucagccucaagugaucuauaccccucaggcucccaaaaugcugagauuacaggugugagccaccgcacccagccccuugauugcuuuuuaagccuuuuaaacugaaggcaaaaagaggacugggaaauagggugggaguggugacaaaaucaggaaagugcaaaaauauaugcugauuuguaaauuuacauuucaguauucauccagucauucauuuauauuuaugcgaugagggacuaccaagugcaucugaucaugucugaaauuauuugggugucaauaacuacugaaugggaugaaugcauaaacaguaacuuacaaggucaacacgcuggcaaaagaaauucuguuuaaaauuauuuaauuucauuugcucugauauuaaguuaguucuuucaguagauuuucauucuaggaacagucgcuaauauuuguugaaugcuuacuaugcaucaacuucuguucuaaguaauaugguaauauguaacagguauguuuucucauucacuccuaaccacaacaacgcagacagguaggauucauuauuauccccugcuuuacugauggugaaguagacaucgaaaggcacacugacccacuggccugagaucaccuaguuaguaagcagagagucaagauuugcacucaggcagucugauuccagcucaaaagcuccuaauggcuacuucuagcuuccagaaagaagucacagacaagcaacacaaauaucugguugguuuaauuguugcauuucucauuuuaaauuaguaaauugguauugugcauuacacauuaagcucuugugagcugauuagugugacuugacucucuaggguuuugcucccuucuagugaacuaauaaggcugaauuuccaaaccugcaauccagcuguggaucaaugguuagaacacaggagagugacagaaacaaagauggggaaaguugcagcggccacaucuugcagguuauauagaccaugcacacaguuugaacuguuucguaguguguagggaaggaguaugauugguuaggaugugaucacaacaguuugggugagagaugauggugacuuagaugacuaugaugguaguuaaaauggagaugaaauaacagauucuaaguaaaaggcugcacaaagugcuuggcauguaguaggugugcuauuaagggguagcuauuguuaacaaccauggcaaauucauuucaauccagcagguuacauuucauggauuggaaaugacugccugaagcauagcguuggaaagauauucugaccccccuucaggcccgcacagaaggagcacuaggauagacuggagaugucugucauaagcucuggauaaacaggugguagcacaaauguugaggggugcuuuauaaggauuuucaaaucaauaguuuggaucugugcccccacccaaaccucauguugaauuauaaucccuaauguugcaguggggccuggugggauaugaaugaaucaugggaguagguuucucaugaaugauuuaacacucuccccuuggugcuguucucaugacagugagugaguucuugcaagaucugguuguuuaaaaaguguguagcaccuuccccucacucuauauaucuuguuccugcuccugccauguaagacaccugcuccuucuuugccuucugcauguuuggaagcuuccuaaggucaccccaaaagcagaagcugcuaugcuuccuguauagccugcagaauugugagccaauuaagccucuuuucuuuauaaauuacccagucucagguauuucuuuauaguaaugugagaacagacuaauauacaaguaaagacaagauucuuauacagacgauuuugaaucguuuuucuccauaauaauauucaaagauaaagugggcuuaagcuauaguaaaaacaauccuauuuauuagaaaaaagcaauaccuaauggaugaugaaccacagaaacuuacaaaauugaccuucgguuugaaaguacucauggguaaugcccucccugcaaacaaaagauuccacaggcaaguuaguuugacuuaggucaaauguuuuaggccucucuuagagguucaugaugcauauuagcaugcuaaaaguucagaaagggaagcacacuaaaagacacauuuuuaagguuguuuaaccagaaguuuccaaauucauugaccaugggauauuuuuucacuuuaugcuuaacaucucauagaaacauaaugccugcauuaauauugcauuaugauaacaagacauugugcuacaaaauugguaaugucaugucaucuuuuuucuucuggcuuuuguacagcucaaucaguaggagcaaaggagaggaggagaaggaggcuagugcuuuuuuuuuuuuuuuuuuuuuugagcuggaaugcaguggcacaaucuuggcucacugcaaccucugcuucccggauucaggugacucuccugccccagccucuuaaguagcugggacuacagacacccaccacgacccccaacuaauuguuuuuguauuuuuaguagagacaggguuucaccauauuggccaggcuggucucgaacuccugacuucaagugauccgcccgccucagccucccaaagugcugggcuuacaggcaugagccacugugcccagccgacuagugcauacuauuuguucguuucuagugaaagaugcucacuuaaugauaacugguuguauauagcagcaccuuggcucugaaucugaucacugacguuguggcuaacaauauuuaaccuuuggcugaugaagaucaaguugcagccuacacccacauuuugaaguugcuuaaauuuggacuacucaggagacacacagauucuacagaugugagccagucacagaacacuagggcuuauucauuuucaaaguuuccaauuuuuaguucagugcuucguacauaaaagaggcucacaaauggcuuuugaguaaugaaugaauacacaaacgaaugaauaauuaugguaacuauuuuugcucaugagaaaagguaauuaauuauaagaagaguaaguauugugccaaaucuaggauaaauuuuaaauaacacaauagccuuaaaauuaaacaagaguucuuuuuuuguucuguggagauuuagcaaguuagaucuacuuuugucugaauuauacaugcugaaaaaauggcaucuucagacacaaauuggcuaacguuauuaaguaacuuuguccuuuaauuaggcaagucacugaaucucuuuguuuucuugucuccugcgauaggugaacucuaaguucuaaaguguccaugaaucuauucacuuauaaauaugaugcuuuguacuuuuuuuuucuugcaacaccgggaaagugcauaauguucauucuaaaacccagucuaaguccagaccgaaaaagccucaggaaagcacagaauuccaacauguuuugcaagaaaauccucacucauuaaagguaugcucauaagaggaaaacaagaacucuauuauauuuuccuacagaagaacuguaugaaguccucuccacagaaucucagcaagaacaacacucucuucugggacaaucuugaugaacaugggcuaccuugggaacuggugacuugggcagguccccuaauaaucuuuagguaccauuauaagccaacacuuacauguacuuauuaaauagcagccacuguucuaaaugcucuacuuagacaaauucauuuaauccuaaccauagcccuaagaacugggugggauuauuaucuucauuuuacagacgggcaaguuaagguauagcaugcuuaauuaucuaacuguuauggaccuauuaaauggugaggaaucaagauaguauggguccagaaucucugcugguaaccccucugcuauacugccacucaggauaucaucuagcuauugacgaaggcugaaacaaacuaagucaacuaacacuuaucgggaguccaccauauuaaaugcuguaaagaacuaagggggaauaaaaugaugagggccucauuacugcacuuacccagcuaacaaauaagcaacauacucuaggcagaaugaaaugaauauuagaauaaagauucuucggaaagaggagguagaauuugauauagccuugaagaauaggauuuuaauagauagaguggaaagacaacauuucagauucaagcaacagugcgauuuuagggugugccaauuaggcuugucugcccagauuguaagacacacaguagggcagcgguccccaaacuuucuggcaccagggaccaguuuccaugggagaaaaugucuccacggacugggguuguggagaugaugguuucaggaugaaacuguuccaccucagaucacaucgggcauuagauucucauaaggaguaugcaaccuagaucccuuacaugugcaguucauaauaggguucacacugcuaugauaaucuaaugcugcugcugaucugacaggagguggagcucaggugguaaugcucgcuugccugcuucucaccuccugcugagcagccuccugcuucucaccuccugcugagcaggguuccuaacaggccacaguccagugaacccugcaguaggggaugacaucuggcucuugaagagucucaaugcugugcugagucuaaaugucauuguguaggcaauaaagacuaauuugacuuuuacuuuggaguauaacucgagauagaauggugggcuauaaucugagcaagaagaaugagaaauuaaaucaaggcaguuucaguaacaaguguaaaaaugggugaugugguaccaggguguugcgauauggugcccagaccuccccuucaguaauaaugaucagauuauccaagucacugggaaugcugccaaaagagggccuucggccaaggucaugaccucuuccugggaugguggcaucaaugacugaucaucacuggggauauaaaggccccuaccucucaccacagcucaggacagcucugaagggccaucucagccucagaacucaccacauuguaguugaacuucuuucucugcccaguugugcuuucuuuccuucucuuugacaaacuacugucucaagagcacucccaauaaaccucucccacacuaaucucuguccuagagucuguauccugggacgcucaaccugcuucugauggcuguaaggugcauuauaaaaacaaaacccccaguugggcauguaugcacgaauguagcaaaugaaggagaagaaaaagucauagaugaugcccaaccagcauagcuaggaggguggucuuagccagcauggucacucccuacucagccccucagugcagugucucuucuugaccccuauaaucuacuccucacacauguggcagagggauucaugcuccaaaucuugccaucaugugcagaagaaauucaagaguccuuuauccugccuacaacaucccaccuaauuggccccccagauaccucuccaaccuccccaugcuucuggacuccagccacacugaccuccuugcaguucuggaacaugccaaccaugugccuguuggucccccagaaacucccauaggcccuugucucauuucauuuagcccucucugcucaaaaauuccuucucaagaaggccuccuccaacuacuccauuuagcauagaaaccccugucauucucuauccguuuaaacccacuuaauuuuuuuccaaagcacuuauuucaaguugccauugguacauuauuuaccuauguguuuaugcauggucucuuucucucucuagaaugagagcuccaugaaggcaagaacuuuaucaucuucacuguuauaucccuggucaggcacauaauuuguacauaaguuaaugaaaaugagagucauaggagaaguguguuuucagcagaaaauaucaguucaauuuugaauagguugaaucugaacagccuuuacaacaaagcagucagaucagauguuuagaagacaguuacucauaguacccagucucugugagguguagggagagaaugagcuagaauggcaguuccuaaguugcucugggggaauauuaaccucauggcaggcucuuugaaauacagaaugguugggccaggugguggcucaugccuauaaucccagcacuuugggagguugaggugggcagaucaccuguggucaggaguucgagaccagccuggccaacauggcaaaaccucggcucuacuaaaaauacaaaaauuagcugggcaugguggcaugccccuguagucccagcuauuugggaggcugagguaggagaauugcuugaacccaagaggcggagguuccagugagccagaucaugccacugcacuccagccugggcaacagagugagacucagucuucaaaauaaauaaauaaauaaauaaauaaauaaauaaauaaauaaauaaauacagaauggucauauuccuucaaugaaauaaaaaccaaacagcuuuaauaaaagaaaaauuaauaaacaaauaauggauaagagggagaugaagagaaacagaaugagagacagagaaacgaaggggauuuauuggcucauguaacagcaauguccagagguucaggcuggacaagauccaaggacuccaacagugaucccagaauuuggucugucuccaucucucagcucugcuagucacuucucugagggucugcauucucagccaggcucuuuccaaacagaccacauggaaaguagaucaccagaauugguuccaauuccuuccuuucaacgaacgcagugaaagauggugccucuuccacaacaguucuuuaaaaaaaucaaaggaauuggaccuaaggagcuggucuggcuugaguccuaggcccagagggauaaauggucugauucacuuagacugggucaucucugacacugugcgcugcagguucccaggagcugaugaugugccucucuucccaacuccauguuuagugauuucaccuugguagcuuaaaguuggccaugguaaaaguauuuacaccauggaaaaugucaaaugcuacaaaucaaggauuuucuucuuuuuuuuuagaauugguuuuuaacacuuaccaaugaaucacuugucauaugaacauuucuaaagccaggaaugggggacagauucaccagaacucagggacuaagaaugaggaauagguucccuaaaggacaaucaagauauuguuaccaggaaaagggaugacuguugggaagcguccucccauauauuauauuauuacauuacauuauguuauaauugaggauccacaaugaacuaaggguucuaaaaaggccugugacuuauaaagcuguuuaacucaguguuauccaaccuucugugauuagaaagucuccuuuuucauaaacuucugauuaacuucucaaugccuuuggaaaauagugaacaagaguauagagauauuaauacaaaagaagggaacuaacaauuuauauguagaucuauugcuguguuaguggcugggggaaaaaagauucuuaauguuuuccucucccuugaauggcaaauagaaaaugccuaaaaugaagaaaauauugauuuuaaaccaacugauacgucugcaaacuuuauuuuaacuuugagccacugaaagggauuuaaaaucaaaggaacaauauauuuccuauaucuuuuaggcugaauauuauauguuaauucuaauauuuuuaugagcuguaauuaaccuucggucauugagaaaucaaauacucaggcuuuuaagcuuauaucuaaaacuucaucuagugcuaugauaggaagaaaaaaugaaagacagaaagcaauaaaaauuaauuuuaaaauaguuucuuuuuuucuuuucuuuuuuggcaacucaggcuaaucaaggacauucugaccauguuuugagagucuuaauacguaagcuucaucagagucuucauaagacaaagggcuuugucucacucacuguuguuuccuuagcaugcauauguauuaaguacucaauaaauauuuguugaacacuaaguuuuaaaaaucaacaauggggcugggagcaguggcucacgccuguaaucccagcacuuugggaugccgaggugugggggaucaccugaggucuggaguucgagaccagccuaacauggagaaacccugucucuacuaaaaauacaaaauuagccaggcauggcagugcaugccugaagucccagcuacuugggaggcugaggcaggagaaucacuugaacccgggaggugggggcugcagugagccgagacugcgccauuguacuccagccugggcaacaagagcgaaacuccgucuaaaaaaaaaaaaaaaaaaaucaacaaucaugacagagguauauuuuauccacuugaugcuuucucauauacaucaucucauuucauauguuuuguggacauaugaaggcacugucugcccuucccaccuuccuucauguaggaauuuaccuucccccaauagcuaugucaccauccgggacuuuauauucuuuuacguggccuuucucccuucccuuuuugccuaaauuaguuaggcaauagcuaugcugccauuugggacuuaauauucuuuuucaugauauuucccccuuccuuguuugccuaaauuagugagggcuguauuucuaccacuugcaggaaaggaaucuucauugaacaauuuucacuguuauaucuguuauacugaaaacuauauuaauggaauacugauaugcuuuguucuucaacugaaaauuuuuauuuucuaaagauaaaguauuaaacauccaaggcucaauacugaauauaagucuaguauaauuucaacaaauuccuuacuaaacugcugugcaaaauaaagaugaaagcucacaccuguaaucccagcacuuugggaggccaagguggauggauugcuugaggccaggaguuugagaucaguuggccaauguggcgaaacccugucucuacuaaaaauacaaaaaauuagccaggcaugguggcaggcgccuguaaucccagcuacucggcaggcugaggcaggagaaucacuugaaccuagaagguguagguugcagugagccgagauugcaccacugcacuccagccugggugacaagugagacucugacucaaaaaaaaaauauauguguguguguguguguguguguguguguguguguguguguguaguguguguguauauauauauuguguguauauauauacauaugcauauguauaacacucucuaaauccaauggagacaaaaauaacacucucuaaagccaauggaagugucuagggaugcucccggcuguuggugguuuugaauauaacaucacuuucagguugaagaaaggaguaacccaccagagaugaauagcaguaugagaauccagucaugggggacugggugugguggcucacaccuguaaucccaacacuuugggaggcugagaugggaggauccuuugagcccaggaguuugagacaagccuggcaacauaaugagacccugucucuacaaaaaauaaaauuagccaggcaugguggugugucuguagucccagcuacuugggaggcugaggugggaggaucaccugaacccaggaggucaaggcugcagugagcugugauggugccacugcacucuagccugggcaguagucuaaaaaaaaaaaaauccaaucauggggucucaaagcagaagaguaguguggggaagggggaugggcugauccuacagagacacaauucugcacucaaacaacacccgaaggaaagagcaagucucuaucucaacuagcaauacaaucugaaacaggaaugcaggagagaaagaguuagauucaacccuacagagacaaaggacaggagccauuuggacuaaagagagacagaauucagagcauguccuuuggguugagaagagccuuugacagcacucagucaaaacccaacuuugucaaagccucacucacagcggcacuacgguguaggugagauccuagugaagcuccugaaacuagaaguggcaggagaagguucaguggccagcacugaaguggaacauagcguucaggaaugaggagugugggcuuuggagccagacugccaugguuugaaucacacuguugucaguaaccguguggccuuuggcaaguuagugaaccucuuugccugauuuguaaauggagaugacagcccucccuguaacuugcaggauuguagggaggaugggcugaguugguacacaguaccuggcaugccguaagugcuuaauaaauguucaauguuuucuagugauuaugaauucugagccccacuuuuagccaacaucuucuaaaucauuauaaauuaugaugacuuuggaauuaaacagacuggugcauucauaucuuuguuauuuuacuccuuugagcuuuggucucuucaccuguaaagugagacuaauaucuacauauauaaaacacagagaaagugccuagcauggggacucuuuauguuaauaaccaauuaauauuaaucucccaaccugagagucaccugcacagcuauguuucucuuuucuagaguuaagaaaaaacccaguaagguuagacuaauugguauaguccaggucaagacuacuuggguagguagaauggaauucuaugugaacucacauuugagugggauacuacauugauuaggguaguggaaagguuucugucagcccuucaaguccaagacccugggaacaaaauagccugaaacacaagauuucuugggcgugucacagaaaaaaaauuccaagcugcagacuuucccuuugagaguggcguccucaguuaccuuaaauuccaguagaaacaccauccacagaaaugucccuguuugccagagcugccauagugauggccacuuuuguuuucccaauaugagacccaggcaguguuccagauuagguacccgaagaaaacccuggggauauuacuguuauuuaaauuaauuauuuaacugacuaguuauuuuucagcuacccaguguuucagagaccuugaauuaugccuauuggcaaauguguaaccacugaaaauucuucacagucagaaacuggaaagaaaaauucaccccugcaguuuuagguuuuuugguuuuguacauaauauugaaggugguggauuaagugcaauauuuagaauaauauauucaaggauuuaaggaauuugaguucaauuuugaaccacuccaccaccccuggcuggaccucagcucaaucccuuaaucuuuuggcuucuuucuccaucugcacaagaugccucuggcaacgcacugagugcaguagcauaggaauacauucaauaaugggcuuaauaucaccacucaaaagggaguaaauugcuuuuuugugggauccauuagcuuaauugagaauauuagcucaguauucuggauguacgaugggcuauaagaaagaagguagcaucaauuuaaauguuuugcuuugccucccuaaaugacucuggucaacagcuaagaauaagaauauaagaauaaggggacagaaagaaaagcagggacagaggagaaugcucaggaagucaaaaggaagagguaaagggauggaggcucaauggcuaagaagugagguauacgugaagacggaggcggaaaagaagaugggagaggcaagaagggaaacaauaagauuccuuaaggagaggaagaguaagaaucugaaacgaagauuccaaucagauggaaguuaauugggaccaaccauauggagaggggcagagcagaggggauggacagaguucacucgggaaagagaggguuugguagggcugucucccucccuccugucacuggcugucuucacauuugcggugcucccacgauccccaacacuaggcuuuuggcucagggaguuggcuuuaacagcugugccauuuagccucccaagaguauaagaggucuccaagacccagggaguuaagcaaauguuaguguaucgggggaaaguguucuuacuucauguucuucaaauuaaacaaugaagugaagucauagaggacaggaggugaugguaaacaauacaauggaaccaaagggaaaaugacugcuuuauggguaucucagugauaccaauuuacuccucauaauucucuaagcuuuacuuugcaaggacaauuggaggcuagaacugccucaccaucacuccuacucccaaagcuuugauagacuuaggagugguaguagaaauuauaauaacgauaacauucacagcaaauauuuauugcuuacuuugugucaggcacauacacaugcauccuuccaaaagggauuucagauggucuacaauaagacaacuucuaagaggggaggaaaaaauagauauauauaccuuggcugaggaaagcuacaguaaauuugauauagcaauaagugguuugauaggaauuaacucauuuugucaucucuacaacccuacgagguagguacuuuuaauaagcccuuuuuauagagaaggaaacuaggaaaaccaagacuugauuuuacaucauuggcuucacuucaaaggcuagggaaaacaaaaacaaaaacgaaacaaccacaguaagagucucacuacuuacuuucaacaauagcaauguucaaguuaaucaccagaaaaaaaauuagcucuguaugccaccaaaagauagccaaaauuguuguguagugucccucuuaacuuggauaugugaguaucgcucagguaaguacccuuaagacaaauucuucccagagacugggucaggaaaggcuuucuccugaugaaacuguaggacuccuuccacuugacaaugagagcuaugcaaaccuucauuuccccuauuucacugcuaugaggaagcuugggcucaguuuuaugcucaaauacuauuguuugucucagccagaauuucaacuuuucuuuuuuaaaaaauauuugucuuucauuguaaauaaaccaccuuaagucccuuuuggaagaaggcacgguauaaauaaacaaaagacaggcugggcgugguggcucaugcauguaaucccaacacuuugggaggccgagguggguggauuaugaggucaggaguucaagaccagccuggccaagauggugaaacccugucucuacuaaaaauacaaaaaaauuagccagacgugguggcggacaccuguaaucccagcuacucaggaggcugaggcagauaauugcuugcaccugggaggcggagguugcagugagccgagauugcaccacugcacuccagccuggacgacagagcaagacucugccuaaaaaaaaaaaaacaaaaaacaaaacaaaacaaaacaaaacaaaaugcaauccuguuggggccaagcuagagauauaauuuaucaaauuacuugacauagcacccugaaaucauugcaucuaaaagagaauauccuaaacagaauuuugagcagauacuauuuuugauggucuuugucauauuuuucaugucucucaaauagcauuccaaaccacuuuggguaaagaacauaaaaucuagagaaaauuaucugauuacucucaaaugucuucauguuacagggauauaauuaaaguuuugaaucuuguccaacacugugcucaaaaauaaaccaauuuaagucuacauuuaucagucaggcuuaaaaugaaaaaaaguuucacucauuucaauuauucaccgguuaauaaacuaugcuuaauuuguagaauguuuuuuuuuuugcuuccaaaauuuauuccaggaacacagccauaucuucuccugcugacugauaaacacuauauauauuagaucacacauagagaagccuguuuaagggucaagauguaggugauuuaaugaaaaaaccaccaucaacucaagguugcuguuucugugaguaauugaucuguucaaaaaacaaagcguuucauuuccagaacuuucauuacaggugugacuaugauuuuuguuucauuuaaacauuauuauauaaugaugcauuucaaaugcaauagcauuuacaaaaaagaaaauaaauuaucaaaacaaaaacagaaagaagagccaguagcugggaagaagaucacagacguuuagcacaaaauaauuaacuaagaagucaauucugcuuauccagcaaguacuuacagcucaacauuuugcuacuucagucccauucaauuuuagcuugugacaaaaccuacacuuuuacuucaguuuugugacuuacucuguuucauuauuuuauuuauucaacaaacacuuauggagauaaggcucguuguauuaugcaauauaagcaucaaacaaaguacguucuuguucugauacuuauuuugcaacacuucaugaaauugcaaaaaguaaauauuauauaaauuagaauuuacaacacagacuggucuaugacaaaguaaguaaaaauagucucaauccaugagacuugaaauugagcugaaauuccuucaggaguccauauggauuaauucagauuuuuauacaacagauaagaaaaauuuauucuugacagcacagacagcagucaggugccccaagcuggguuauggccuggucaaauauugcuaacauauuuuuaaagcucuugcuuuguuacagaaacuccguuuuuccucacgaaacagugcguauaccgcaacucuucaaauuguaccucaguaugguguaaggaaugugguguuccuuagaagcuguggcaaaucccuaaauuucuuaccuguaaaauggguauacauggaaggcaggucuucugugaagcucacacagcauaaacuuucgggcaucuucucuaggccuccaucccaggccuuggcaggagccuuggcgauacauucaccuggucauauguuuauguacaauuugcaaaagcaauauauugucaccacaauuagcugagacugaggucucuuuccacuaggacuuucccucugccauuuucccuucuauuggguggugcuagggcagccuggacaugcugugggauagggucaggcuuuguguuccuacccaaaccucaucuugaauuguaauccucacuuguuagggagagaaaugacuugauuauggggacaguuuucccguguuguucucgugauaguaacugaauucucacgcgaucugacgguuuuguguuuggcaaguuccuccgcucacaauucuuuccgcuuccuugugaagaagguacuugcuucuccuuccaccacgauuguuaaguuuccugaggucuccccagccauguggaacugugagucaauuaaaccucuuuccuuuauaaauuacccagucucgcgcaguucuuuauagcagugugagaacggacuaauacacaguauuugcuuuuucuuuaagaggaccacccaaauugcauaaauugcaggccccacaaaaccugcauuacccccuaagugugagaauaguaccuauuucacaggugugcugugaggauuaagagguaauggacacaugguguguaucagguggauguuagccauuaucacuacucugaaucuccaucuuucuauuauagcaaggccacagaaaugagcauuuuauguaauauucuuaaaacuaaauucuucucauggaaugggauuuuucaaccccaggcaacagggccacaucauguuuuucuugggcucuaggccuuuuugccuucguugagccccuuacuccauuaaaauauauauacauauacacacacacauauauacauacauuuuaagauuguauuagcacaaaaacaaauauauuaauauauauuaaaauacuuucuuaaaccuaaauuuuuuuuccuucugauuugaaaagaaauuaaaauauuuuuugugggccucuaaaaauauuguggaccuuaggcacugugccuaauggaaaagacagugacaggauugugcaauaugaauaaugauaaauuucccaaaccaucaaggacucaagaauaaggguaaacaucuuaaaugggguugguuucgaguacuuauaauagaaaaauguuauccaaacaaggucuuagggguaacaggaggcguuuuuaguguucaaaauacgcacauggauggaguuggccauuaggacgcuaauagcgaccguaucuagcugugaaauacauauuuuuguuuugggagucuacuuuucaguaaauguccuuucagguguuuuguugcccauuuaauuacaugaucaacaaggaagaguuauuuuacaaaacaagcuucauuuugccaauuuauaaauugcuuuggaguuucaucgaaaggucuuuaaaaaacacguuggccuuggugcuggugcaucacauaaaucacagaugaaacaaacaagccuguuuccuacucaaggugugucuguagaguccugacugcgugccaggggcucugucuggcacauuucugaacuuugcaaaauuaauugugccgaagagaacaccaucaaacgcguccggcauacagcguaaacaucuucagaccgugauucugcgccaucaaacgcucuccagcuaauuucauuuggugauuacucugcuagaaaaccgaggccaagugaaacugcggaaaugggaacaauguacggaggaaaaaucucaccccauuaagagauccguuucuucuccgcacaaauaagcccaccccgccuccgaggcaagacuagauggcuccaggauacucucggcgcgcccgcuggccaucucgggcaggggagccccacacccggcaggaggaccaggacgcgagcggcggcgccucggcccugggcuguuuagguaauucgcaaagucccaacaaucaucccccucucccagaagcugguuuucuugugugcagugguuacagaggcggcgaaaacacgguuccccgcuuuccucuccucaaggcacuguuugcagcggcagcagcggccgcauucggggaggcgcgguccuccccgcagagccgucgcgcacucggccuuucucgaggauuugccugggcucggccgccucgcucuccccugcgcuuccaugaccuucugagagcggccucaccaccggaggcucggaggaagcaccacccucggcguccggggcccgucgcgcggccgcguuccuccgacuccuuggagcacccgcgcgcgcgggcgcgcggccggggaucggcgggggcgcgcggguuggggcggggccggggccgggggcaggggcgggucaggggcggggccgggcccgcugcgcccccagccgagcggcgugcaggcgccgcccccgcgcgccgcagucccggcuggagcgacucggccguggcgguggccguuaccguugccucugggaggcucuggcggcggcggcggcccgcgggguucgcggagcgcagcgggccgcccuucgcccguggccgccucaagcagccucgcgccgacacaggggaggcgagacggcggcugcggaggcggcggcgcauugugcccggcccccuccuuggcggcuccugcccccgggcggcugugggaucugggcagccccggggcggcggccgaggcuacagagccggcggcaggggauggcaagauagcggcgcgggagcguaccgugaguccugggggcgggugggcgcggcgcggagcaggggagccgcggagccccgagcgggguccccaggggcggcccgggcgggguggggcagcgcucccagcucugcggagcguccuaggggagugaccccggagagcgccgcuccgggucccgccgcucuccgcgcgcccuugggucacccucguguccugggggacgcggacuccagcgcccagaacuucugccccacgcagggcagugaguucugaggccagagguuaccugggggaugggagggagcuugaaauguuuuuccuucggagaggugaccugccaggugauuucgugccccucugcuucaacuccccuuuaaaccuguuccucguccuuucuguauccguagugcauuugacuuaccuguauuuuuaugugcuaacuuccgaaggugguguacugguuaaacccaaaguuaaaguguuggaggucaaaguuaggcuuugugaaagaugccauuucuguuauguuguguaaaagcacaaagcuggauucaggaguucugagcgacacaaaacugcacaucacguguucugaauuuacaugauuaaucugaauuaaugugauuuuugccccccaccccccacauuccgcuaccaaaaauauaugaggucuuuuauuugcaguuggguaucuuuguguuccuuuuugaauguuuaaugcagucaaauauuguuauaaccuguauuguuauugaguggcauuuauauggaaaucgguucuuugcauuucuuuuuaugugucuuuaaaagauacauucuuucaacagaaaaguuucaguuuaaaguuugucuuccgauuccuguucaguuucagauuaguuuuuaauuuuaaaaaguauuugcuugaaguaagauuaaugugauauaguaguaucguuuaggcagggguccagaaaugguacagaaauuaaauuuaaggcaaaccuuuccuuuucacaaguggaaaaaccaaggaguuuuuucagcgcgaaugcuacuugcccuuccccuuacaugauuauuuugucacagaucugaaauuacauuucacuguuaccagagaguuucuugucuaagccuggcagagaaaaggaagccuaaguauaauguguuuuuuaaaaacacgagaccauucuuuuaguugucuucuacguugacuuuaugcuuuauagucgggggcaacuguucauuuggaaacuucauuagggaguuaguugcaagcucaauuuaaauauaugauguguucccaaggugaucggagcagcuauuuccucuucaagaauugaauugagacuucuuugcuuuguaauaggugagugagaucacuagcaagccucuugauuaguggagacuuguauucucuucuggggaaugagaaucagggacucugcuguugaaggagcaaaacuuuugugauuuuugaaaaauuugcuucugaauggucauccuugacaaauauguugguaauagugugcauuuuucuuacauuaauugugcagcagguaaucuauucacacuggagaagauucaauagauauaaaagauacggaguauaccucucucccaucauguuccacagcuacuggcuccuuguguaugucuuuccagacauagccuaugcucauguaaacauucuguacguguucuuuuuguuuguauuccuaaagaugaggacccauuguauacugugcaccagcucccccugccccgcuucccuccccagaguacuaaaucauggcagucuccauugguaucuaagagaaucugccucauucucuaacagcugcugaguacuccauuagggauggaccauaauuuauuuaaucucuucauugugauauauguagguuguuucuaauaauuugcuaugaaauuguaaagcauuaguuuuugagguuuuuaaguggauuugguuauucccaaaggccuaaaggcaguagucauuuguuucuuuauaucaccuuccaggaaauaagugugccuucuccccagcauacacuguuugcuucuauauaacuucacaguaauccauaagagucuuuggcaucuuugcugugaagugggagccaugauggucaguaacuaaagucauuauuccuuggguaacaacuuggcucuuuguuuuaacaaaagaaaagaaggaacagauacacauuuuaaagaauaaucugaggaaaaauucuuaaguguuuaaauauuuuugaacguagagaggcagcuuguaccuuugauuaaauugaagaugaggguaguuuauguuucauaaaauucgguugccauuaggcacucaaaucccugccuucuguagauuaucaccaguaucuuauauuuuaauguuaguauaauaugguuacagauuuuacaguuuaugaugggguuaauaacuuuuaaggggauggaugcuuuuaaaacauacuuagcucuugcuuuucuuuaaaacaaaaaaauuggggucucgucagcaugcucuugaaaaagaauaaauuguaaaaguaaugcuaaugcuagaaauugagccuaauacauuauaaagcuugaacauuagccaauguugagcuucaguauuuucauuaugcuuauuuuugagggcuuuuaggacuaguguaagcuaucauaaucuuuuaaaauauauacauacauauaauauauauauauauauauauauauauauauauauauauauauauauauauaguuuaaaugguccaaacuccucuuagaauuuaaggcauucucuugccuuuuauuugguacuguugugauacaaaacugcuaacguugucuguauuuuuucugaaauagguguuuauugggcaucuguuaauauuccagacaacuuucuagggacuaaauuauggcacugcacaggacagacagacccugcuauaaucucagcgaaggagauggauaagaagcaaagauacaauaagugauggugacuagauagugcuaagugcugugaaagaaagcaaucaggguugcauggcagaaugggacaggaugugggcugcuguuuuacaucaaguggccugagaagccucucugggguggaggggucugagcugagaguugaaugagggggaagaagccuaugauuuuggagaucugaaagaagaguggcuuaggcagagggaagggcaagugcaaaggcccuggagcaggacugagccuugcauaccugagggacagaggaccaccucuguggcuggaguuggugaaaggaaaggagagagcugcaggcagaagaagagugggcugggguuggugcccauauguguugcaugucaagaaauguuuacagacgugggaaagaugugagugguggaguuccucuauaggcuggaagcuccagggggcuagcaacacaucugcuuguuacccauugcauuugcagcaccaggaaccaccuucaucacauagugggcuaugaauaguuauugaguaaaugaauaauuagagaauuuacgaaauaaucuuaccugcuuuuggucaaaauacuuagauucgggagucuuuuaguuuuccagcuuggcucuggccuuugacaucagccaaucgguuauacuguuaucacuuuucuuucaaauuaucacuuuugucaaacuguugcuuuaagucaauuacacuugacugcucuuccaugaaauucaaguguaaaaccuuaaaaacaaaccuuuucaguaaauuauagugauuuaugagagauuuucagaaaggugagcauuuuuaucuuuuauuuccguggaauagccauuuguauaaguguaagaguucaaagaugccuuuuguguguggguguguguauugaauguuuuaauucuuugggccagaugacagacuaaugaguagauaaaauauauguagguacuuuuauucucacaggaggaaugugugccugcccuauagggaauaucaauaauuuguggcauuuccuuuucccaacuucuaaucugucauucuaaauauuaauugaaaacuugggaaaugaguuuuaugccaagcaauuguuauagaugucuaauaagaaucuacaucuuucuccugugacuuuuggacuccuguuccauauuagaaguguugugaucuuccagaaugaugguuuuuaacuuuuuuauuuccuaucuuaaucaauuaauaacuuagcauaauaagcaguuucuacuuaagacaauuuuauuuccaacuguuucucuuaaguucugugcaaauuauauguaaaggaggguucuuuagguccucagucuucaguaaagaagccuguguccuuuuguccugauauaguaaaagcucuucaguaaaagaguagaaacaccuaccaguugggguaaauuuagaggcuuagaugcccgaguuaaaguacuuuuaccaauuccuuuaccuuuccuuuugugaaauaugggaauugcaaauuugucuuacguugucuaaaaugacaacacaugcauucuuauaggauguugcugcugguacugcucaggugagcaaagauauguguuugggagauacuauucuaugcuuucauguuggaaguugaggaaaaacuucugguagguggauuuuuucuauacuuuugcacagaggugaaaaucuuggcuuccaaucauucuucugguuuguaaggcagauacagagaaagaauuggaaucauuguuuauaugcuauauuacuaagcggcaguauccuuagaggccacaaggcggugauaucacuaccuaaaguguauguguggugcucuuccagagaaugccuuggaauacugaggccucuugcaauaccuucuuuuaacuucuccccaaagugggcuucuccaaagacaccuugaauccgaggacuguugaauuguggaacaucugguggaaaauagcaagaggugacagaaaugcuaauggggcagugagauguagacuucaggcagaauuguuguaccugucgaguuggagguaaggugagugggagagagaugagaaucgccaccaggacuuuaggcugcagccccugaggacacccgagugccacaguaagcacuaaggcgccugcugcauggggacaggaugccaacuguuuccaugcaacgggccuggagacccauagcccugccaugcuucaugccuuaguguuuauaaugcaguacaaaggugaaggaggcaagaccauugcaaaaacaucuccauagaaacaguuaaaguuaggagcauacauuuucuucuugcuggaacuucaucaugacuacauuuauuccuugaaguugccuggaucaccacaauuuuacuguaaauguaaaauuguucuuuugggagagucugauuuuguggaaaaacuauuuagagcuuaaaaugcauagcucuuaugaauaauagaaaauuaagcacuuaaacaaaaaucaaguaaaguagauaacuugauugaaagcuggaaggcccuucagauccaucuggucagcuucuuaagauaaagaaacuuagacccagaggugguguuauaauuugccgaagaauccaggaguccugauuggcaguguaaccaugaucuucggacucuuuaagugcaggguucucaacuccucucuagaaccaacagcuccucaagggcaggaacuuuugcgagauuuaccaccgugucccuagcauuagaacagugccuagucuauaguagacguucacauauuuguugaauaagugauuaucuaaaggaauuuuaagaacuucagauugccauguuagcuauaagacaguacuuauacaaucugaaagaauauacaguuuuaugaguuucuuguuagaaaaauagagcauguugcuauuaaaacccaaacucuuaagccagacaggcaaacgaaggugcaguguuuuacaucuuagcuugguaccuuucaaagucuguuaucacuggauuuucuaaagccauucuguuaaguucagccuacugguaucugguaucauuaaguuuuauauuuuguauuugaaaacagaugcuuuaaaaucuagcauuuauuguuugaauuuuucccuguuuuuuuuucaguugugcuuuaucaauagcucagcuauuuuaaaaauuuauggccauauggggauaugauuguuuaaaaccaaaucuaaucaacuggaggauuuuggaaauugucacuuucaaaugcuguugguggguguuucaauuguuauaacuuuacaggagggcaauuuuguauuacucaucagaagccucaaaaaugugccccgucccuuagucaggcauguucaccgcuagcaauguaaacaaaggagaaacgauaaaguauguguacagugaccagucuuuagcagugguuauagugcauuugugcaccauacuccugucgauaccuuucuccucgcagugauucuuaagaagccuacuuacugggauguaccaaaaucuggagggagguccucugaaauuuggaaaaaacucacuuccagauucuagugaccaccacaaaaaaaauacauuuaaaaaaacccuccucuaauuugcaaaaauaauuuuuguaaguuuuuuuuuguguguggaaacggagucucgcuguguugcccuggcuggcgugcaguggcgcagucucagcucacugcaagcuccgccuccuggguucacaccauucuccugccucagccucccaaguagcugggauuaugggcacccgcuaccacgcccggcuaauuuuuuguauuuuuaguagagaugcguuucaccguguuagccaggauggucucgaucuccugaccucgugauccgccugccucggccucccaaagugcugggauuacaggcguuagccacuguaaccagccuguaaguuuguuuauaauaguuauaaacuagaaacaccuuaaaugcucaauaauagggggacucauuaaaugaauuguggugcauacaugugauagaauacccuuucuuuaacagugauguaggggaauauuuauagauguggaaagauacucaauauuuguaaacugaaaaagcagauuguaaaacauauggguacguugauccuuguuuuugcuuauggaguguguguguguguguguguguguguguguguguguacaauuuucuacauauuauguaguaaaaugccaggaagacuauaggccgaauguuaggugauacugucuuucauguguggaaauuacaauugacuguuauucuuuuuacuuuccuggauuucccacacauaaagcaugccguguggugaagagucuuggaucagaucccauuucccauuugcuacuacugguugugugaacuugggcaaguuuuguauuuccuuaucugugaaauggggauaauaauauccagcucacggugcccacauguaguauuuaauaaacguuaccuugaucucacugaucugauauggugauuaaagccaguauucuauucuuaauacagaauuuccaagcagaauaauuguguuauguaaguuuuaucaaacuguuacggaaagcauuucagggcauucugacaaacuauuuuguugcuucuggucacugggaaauacuuugucgaguuuuauuuacuuuaaaacugaaaugccuuccauugccaauacauuuuauuuugaauugaaggcauuuuucuucuuuuucuguuguugucuugaauaguccuguauaaauuuuugaaggucagggucugaucuuucuuuccuuuuauagagguguuagagugggaugugagucauucaagucacuguugagugccuuuucuuuaacaggcacuagguaggcaucagauuugcagcaguguccuggacccacaugucucugcccugugaaugacauauggaagugaccaaugugguucaaagccaggaggcccacucaauaaauagauaguuacugcaguuaaguaucaaguaguucucauuuucucuccucugauuuuaaaaggaauuuuguugugauguuacaucuuacugaacacaaacauugccuccugcuuauucaacaaacuacuguauaugaggaacauacuagguuauuucacuucguugacauucaugaaugauuuagugaugacuuacauuacacaagugugagaauauccuagguuaauaggcuuaaaauugcuacuauauaucuucugugaaggauaaucuuucauuaucuuaaguaugaccucaugccuuuuugagauuaucuuuuguaaaauuauugaaaaugagcuccuccuagcaaaucuaggaugcauggaauuuauggcuaucccacuugagaaauucuagcacaugaucuuacugagagagaguggcaauaaagcauuuauagucguguaccauagaaagauguuuaggucaguaacagaccauauauaugaugguggucucauuagauuaugauacuauauuuuuacuguaccuuuuuuauguuuagauacccaaauacuuccguucuguuacaguugccuucaguauucaguacaguaacggugcacagauuuauagccuuaggagcaauaggcuauuauaccauauagccuaggugucuaguagacuauaccauguagguuuguguaaguacacucuaugauguucacacaacaacaaaauugccuagcacgucucucagaacuguauccuugucauuaagcacacgugacuauauuuaaaaauaaugucuccauuugacaguguguaaaacuacauuaguuuuguaauuaguuuuauguagggacuuuuuuuuuaaaguuggcaacuguucuaaauauuuugauaacauguagacccucaguagucgugaaagauacgucuuggaaucuaugacaaauacugagcuugcauuuuauuuuccucauacggccaaauaaaaaaaagaaaauuucuugagucauguuuucauguuccuguguagaauucaugguaggauaaguuacaucacagguuguguaaccaacagcaaagucaccauuuuacuucuuuuuuugcuuuaauaaauuagccauauuuugagaggguguaaguuaggggaagaacaaauuuaggagaguuaugaaucaagaaucauuuuuggacacaguuuaagauacgugugagacuugcaggugacaaguugugcauauagauauguauucuaucuaucucgucacacuggaggugacaagacuugcaggugacaaauuguacauauagauacauauuacuucuaucucacauuguucuaccccauaccauugccuuacauggacuuuacuccccuugcccccacuggaacuggcaguuagcuuucuuuuggggguguuggggauuuacuuuucacaaagaaacacuguaugagcugcacugaguauguaauggugacuggagagcaaccaagcuguguugacauguagacauugggucgcuggcuagacuuaggacuuugccaacucacccuuuccugaaggccagcuucaauaaaauuacagaugacuguuuugaaacuuuuucagcucacaaauagucaaagcugugagugcugaacucaguacauuccacaggcugcauugcugggaucaaaaacucaaaugcuuacagggacaguggacguuacauaaauggcagaagugggccuguccugccuuuugucuuuaugcuuuugauauagagacaaucagaaauauaucacuuucucuuuaacucuacugcaagauagacaacauugacaaucuagaugguaaauggcaacuggaacuugucucaguuuugaagaccaguaaggaaaggugagaacuaugaaaaacuccagaacacauguucuuaggaaggaguaacugcucuuaccuggaguugauuguuauccugugagauguggaaugaguauuuccagagcuucuuaauuuugauuuuuaaacacuccauuuugcaauauugacaaauaauucaaggguuuuuaaauuuuguuuuuuuuauguauaugguucaaacaaaacacaucuaaaggcaaagccugccaguuuuaaacuaugguagguaacauuucuuugcccaucuuuuccuucacuuuuuucauauaguucaggucauacuggauauucaguuuuguuccuuaucuuuucauguaauggcguauauauguuucuucauguugcuaaaaauucuuuaguauguauugaugacuguguaacauuuuauucucuggaugaaccauaacuugagcauuuacauuguuuuaaauuuuuccaguucguaauuaaaguuacaguaaauauauuuaagcauaaagcuggauuuuuccccuucuccaauaaauuucacauucuucccuuaaaauugguuuauugagucaaaacaacuaaauaucuuuaagacuuuugauacaguugaauuuucuccacauuuauuugaauacuaggaaauaaaauauuuguucauuuuauuagcugguuuuauuuugugauuuauccauuauuugauuuuacauuggauuuuuucuuuuuuuuuuuuuuuucuuuuuuuuugagauggagucucgcucugucacccaggcuagagugcaguggcgugaucucggcucacugcaagguccaccucccggguucacgccauucuccugccucagccucccacauagcugggacuacaggcgcccgccaccaugccccgcgaauuuuuugaauuuuuaguagacacaggguuucacuguguuagccaggauggucuugauuuccugaccucgugauccgcccaccucggccucccaaagugcugggauuacaggcgugagccaccgugcccugcccuggauuguuauuuuuuuaaacauaaguagcuuuuuaaaaauuauaaaaguaaaaaugcucauuuuauaaaaauuaaggaagcucagggaauauaaguaaaaauacaaaaaaaaauuuuaguuucaccauucagagauaaccccaggcaacauuguuacauauccuucuagauuaauuucugugcauauauauauguguauacacacacacacauacacacacacacacauauauuuaugucuacaucuccaaauauguuaaaccguauguacauucugucuuguaacaugauuuaauuuuuuuuuuuuuugagacggagucuuggucugucacccaggcuggagugcaauggcgugaucuuggcucacugcaagcuccgccucccggguucaagugagucuccugucucagccuccugaguggcugagacuacaggcguccgccaccacgcccggcuaauuuguguguuuuuaguagagaugggauuucaccauauuggccaggcuggccuugaacuccugaccucaggugauccacaggcuucagccucccaaagugcugggauuauaggcaugagccacugugccuggccaugauuuaaguuuuuuaacuuauauuaauaaucuuccauggugcauaacugcacacuagauucaguuuauucauccauuauucaguuuacuuaacaaauauuuacugcacacuuuuugugugccaggcaguuuuucuagcucuugggggcuauagcgcugaagaggagugcugaacaggagccugcucucugucucuuccuccccaccuaugcugaacucucaggucaugcuggauauucaguacuggauacucauagagcucagcaucuagguggggagggagggacaauaagucaggaauuauguaugcauagauaccucuagguauugauguguacgcugaaggauauaaaauaggauaccacaaggaagagugagcagugugugguuguggugcgggauuugggggagggaggcaagcagggaauugucccccuuucuaggugaugaguagaggccuuccugaggaagugaguguuaauuugaaugaugagaagagucaggggaaggugauuccccaugauaggaaugacaagugccagggcccuugguggaucaagcuuggugcaugugaggaauggaagaaggcccuggaggagacuggaagccggugaccaaaggagagacguguaugugaagaguguggaaggggaugcaggacagagaguggggugugcuuauaaggagaauccacuagacgguuuuaaacuggggagugacaugaucugauggcuguuuuugaaagguucugcuuugugcggaguggauugguggggagcaagacuggaaacaagaggaccacuucagaggcucuuauagcaguucaggcaaaagagguuggugcgcuuaauuuggggguggcaaugaggaugauggguguuuuuuccuucggcaugcauuugaagguguagcagcugguaguacauggggaguggguagaggccgauagggaaggaaaggaaugacucaagggugacugcuagguuuuuuugcuugaauaaauuagcuauauuuugagaggguguagguuaggggaagaacaaauuuaggaggguuaugaaucaaucaguuuuggacauaguucaagacaccuaugagacuuccaggugacaaguuguacguauaucuggagaaaagucagguagaaaguggcauauaaaucugggaggaaggaaggguaagauaaauuuuuaaauuaccacauauagauuuuaauuaacaugauugagaaauuauuaagaguacagaaagagagaagugggcuggaaugcaugcagagaugucaucuucuuuacucaaucccaaauugaugaacauucagguuauuucauuuaaauuauaagugcauuuagugaacacaccuuugaaaucuugucugauaucuccugaggagaauuuccuagaaguagaucauaaguugcaugugaagugcuugaauggagccuaccacauagugagcucuugauaaauauuuguagccuugguuuaucuucaucauucuuacuguuauugagugaaaggcuuucaauuggaaagacaacauaauggcucacaauucagacucuagagucauaauugcaagucuagguucaaauucuggcuuugcuccuuacgagccacaauacuuuggauaagucacuuaaucuauuuccucaugcaugccaugugaaaaauaccaaaccucuuuggaggguugagagaguacagguuaagugcuugggccucccuggagcauguggccuguggcuuuacacaacuacagguuggguuccaauuucuccacauuguccaggguaguaucuaguaucauucuuauuaaccuuuuccaaucaguagaaauaugguuucacgucauuuucauguuuauugccuauuuauauuucuuaguaugugaguugcauauuuuuauuucuauugaagguauucaucuugcuuuagcaucuuuuuuagccauuuguauauccuaaguauagugacacuugucauauuuguugcacauauuuuuucccagggaaaaaaucuucauugugcucaguuuggugagaaagaugguuuuauaaaucauugcuauauaauauuauauguaguaauguaagcauaugcauuacgaccugagaacacuggggaagguuggauuuggaacagugugcacugaaauuugaaggacgaguugauauuuguuaaagggacaaggaagaguggagugggaaggacauuccagguagaugaucugucugugcgggaacacugaggcaccacagagccugacauguuuacacauuugguggaacuuaagcacggggccacugugaggaggugcacagagauggcacuggggacuuaggcuggcaugaaaaagcuagagccucaugcccuguucaacuugggaccuuucccuguaggccagggagagccauggaggauucuaggcauacaaaacugaauuugugcuaugggaggaucagaaguccugagaccgguuagaagcauugccuuugugcaggcugagggaaagaggccccaacuaggcccgacucuggagguuuguccuuauuuaccugguaaaguugagggaguggcacaagugguagucauaacuagaggcaucaugcugccucuaccgucuucuaucauguccuuuuuauaaagcuucugauuaaacuuacauaauaaaaaaggauuuguuauuuaaagcucucaaacacagauuuauugaugccuuacccucaaguugcuaaacguucaaguguccccacauguggguacuucuucuaugaaauagguaguagcuggcacuuauggugagaugggauuuacuagaguaagauuuacauugagcaagaauuuaugaugacuugggcaguaauaaaaccaacaaucauaauuuauguuucauguuaauacuuugauauuagauuaucuacuuauuuuucaaacuaaaaugaauccuccaauuuuaauaccacuggaggacacgauuuuagacauuaugugucugauaaagugagaagacaaaaaaguaguccuucuuaauauuuuuauggccaucuuacaauauuggcccagcuuauuaaccuuuuuuugugguuuucccguguguugcugcuaaaucauaucuccucccaucuguauuuguucauuuucuguguguuauuguuaucaacauuaucauuucauuuuggacccugacauccaugcugaauuuauuuuauuggauuuauuuauuagaauccuauuauuacacccuguauauuugcuauuuugcccauuuuuuuccauccacagauaaguuggauaugauuccuauaucuucaugcaacucauuaaugaagauaccaagaaaaacagaaguuuuugauaucugucuauaucacuuuuguccagguugacaucauccuaugaauuagcacucugaguaagguugaucaugugauaaaagcagccucuucacucuguuuacacagcuugaauuucuuuaccuugcuaauacucaucuuucauguauuagaaaagauuuuguucaaacagagauacauuuuguuguuucugauccuugcuuuucccaguacaacagcuuaucaagucgaggcuaaggaugggcugacgugcaugggucugagguuuucuaggauuccuuucuuaguacuguugaucaucuuauccaggaucaguuaucaagcucacaggccucugugucuguaggauuuuauuucuuaacaagaaugccccuuucugaaauagcuuugccaaauaucaguuauuuuaggugcuguuauguuuuucauaugcuguuccacucuuacauagaagauguuucaccugcuuagauguuguagaccguggucugaagccagagcuaaaggcuuuauuuuaguuguuguuuugagaagcauaaucuaagaugaugcuuaagauuuugauaucugggguuaaauaaugucauaaagaaaaaaauuuugaauuauuuuggaguggaaagcuucagauucugacccuaaagaauguuaagaaagcauucaggcacauuuuggucaacaucugugcauugaaaucuaggucuuaaaacaguuuauauuuuaagauuauuucagcagcaagacaagaauuuuuuaaugccaguacauuuugugacagguuaacuggcucccuaagaacuauauuuggcuugcaaauguauuuuguuuggcccacauaguguuuuuuuuuuaauuggaauuaauugccagcauuuaaaaauaaggauauuucauaauaauaauaauaaaaaaaacuaaaaaagcaacaaccuggauuuccugcccuuuuggaaaaacuggaagaucuguggcuguacuggccgcucguccucugugguguaauacagacacaaggagcuggcgaggggcugcccgccagccugugucaugugaauggcuccagucauuucaucuggcuggcucuuggaguauguuugaguuugcaccugcugaguugagagcuuaaccaauuaaaaguguacuuagaguuggaaggagaacaguaagauggcaguuauuuuccauuuguucucugaacauagacugucugaucuuuguuauaaugugauuaguggaagugcuugguagagcaggugguguuucccccagcaacaguauucaccggacaggucgggggagagcugaauuucuaaucacauuguacaucuaccaguuuguuccugcaggugacaaacaagguuuucugaaaacaaaacaaccguaaguuucuuaugauacuuaaaguagggaaagcaggugcugggucuuaguuguguaauuugagagcuaagaccugagauguuaggugauuuaucugcgagccccuaccugucaccuauucagugguagaauagggacuggaguccaggacuccugacuccagcuuaguugcucauuuuacaguuuaguauaauggccuggagcugagauuugcagucagaguuggcuacagaucccacuuugcuccuuacuagcuguaugaccuuucugugccucaguuuucuuauuauaaaaagagggaaauaauaugaauaauaccgaccuuauaggauugauaugaaaauuaaauccaauuuuucauugaaagaacuuagaaaaguggcugcuccuuaauaaacaguauuuaaauaaugcauaauaucugaaauauauguauaaauuauauuuuacaugguagaguuagcuaaaaccagcuuguuaccuagauagaauuauuguguaauuaguauuuuucccccuccuagaauuuagaaaggccuuuagggauaguuuuacucuauguauuaccccccccaaaaaaccaaaaaaacuucaauuugagccaguauucuuuuuauuaaugaauuuuuguauagcaaacagguucauugaaaagcauaaaguuugucagcuuacucuucagaauguagacaaauaacugaaugguaugaaaauauuuuaaguccucaccgaggacucuauuugaauggauuugcuucagucaccaaauaaaucuuguacgugugguggauauaaagcacuccuagacuauggauuuuacaaagauaaggcucugaucuuagcuuauaguggaaaagaggguggaaggaagggagagaaugauuuccauaauaccugguaugauaagaacaaugccuaaaggggaaauugauguccagugggagcauaaacagagcacugugucugguuggacauaguggucagcaugagaaccaagaggaaggccgggcgcgguggcucacaccuguaaucccagcacuuugggaggccgaggcaggcggaucacuaggucaggagaucgagaccacggugaaaccccgucucuccuaaaaaauacaaaaaauuagccaggcacaguggcaggcgccuguagucccagcuacucgggaggcugaggcaggagaauggcgugaacacgggaggcagagcuugcagugagccgagaucgcgccacugcacuccagccugggugacagagcgagacuccgucucaaaaaaaaaagagagaaccaagaggaagagaugccccuaggaaaggaguagaggagguggaagaagauugcggaauagacgugugaauuuuaguguggacgguugucugagcuguuggugggccagccuucugauauuuggccuggagcuucaaagaaugauaggguuagugauauagaugcuauuuaaagcuuugcaacucacuauggaagauggauugugugaggcccuugccagaggguuguaaauuacguaugccagagagugaggagggccucagccuccagagcaguagaaauggacuggagggagaggauggggaaagagucaaggcauguuuuagguaaaaguggcaagucaggugggaggugugaggaagaaggaagagucaggguuacucagaagacacuggugccaugggcuaagacggggcuacaagagagcagguuuggaggggaaagugagcuuaauucaguacaucuggaguuuuugaggaaucugaaauauccaaguggauaugaagcaucagaauauuuugucaugccugaaggaaccuuacuugaguggauuugucuaaguaagcaagaaauugucuagugaaugguuaaucuguaacugggaagaggccaauccugggaacacggauuuggaaguaauuagcauacaagugauguuauagccacaagcacagauaauacuguucagucaggaagugaaggauagaaggagcaguaggcuaaggagucccaccaaggaagcuaaguaggaauagaaucugaauggcaucucaagucagugagagaaggaauggauuaccuaauaagugguguugggauaagugguaaccacuuagagggaaacagaaaagguggguccuugacucaacuguacacugaaauuaauuuuauauggcaugaagcuuaaaaugugaaacaccuuaaauguacuugaaggcaacaucaggacaauuugcauagucccggcaugagaaaaaccuuuaugguuagaaaccacaaaggacaaaauagagaaaucugaucuaguaagaguuaaacaaaagacucacuggaaaguaaaagcgauuggggaaucuauuugcuauguauguaacagaguuaauaugcauauuaagauuuuuuuucuuagcaaucauuaaggaaaugauuaaugcccaauuagaaaaaggagcaaaagagaauaaacagcuuauaaauaaagcauugcaaauuaucaauaaacauaugaaaggauauuuuaauuacgcaauaaaaagaaaugccauuuauggcccaacagaauaauuuuuuuuuuuaaagacaauccuugguauuagugagaaguacugggaaauggagauguuccuguuucuuuuuagagauaaguuuucgucauguuuuccugcauguuaaagauuuauuggaggaauguucuucagguuguuuaauaauagagcacuucaucguuaaaagggaagaaacaaguucauucguuugguagacuuuuauauuuauugaagacuguuacauaccagucacucuuauagcguaguugaagugggauaugaguagucagauguuacucuaaaguaugauagcgugagucccgaaagauggaagaaugggaaauauaggagacauugcagggggcacuccauuggaggcagugguuuugggagaggccuugagaccaaagggaauguggaguguuuggggagcugcugcgguauggagaggaagggguucauggccgucucgaagggcugugcccacaguauggaacuggaacuguguguugaaacaguggagagccuuuggaggauuuuaagcauggaagugauguauucaaacuuguuuugacaugcugagguucauaauggacuggcucuugaauuaacagggaaguccacacugcaauggagauuacuaaaacugacauggaggauccugaaaaagaaaaacuuuggaagacagucuauuuuuaaaaguucccaggaaaugcaaaggaauuaagaaaaaaaaauugacaagauuauucuauuugaauaauagaccaaaaaguuauuuuggggaaugaauauccugcauuaugcacagugauagauuugucuuuauaauguagcaaauguuaaauuucaauauuauuuuccuacaugcagaacgcauauugaaguaugauacaguggaaucccuaagcagccaagcuauccucuaacucagguccccagacugucauaguucacagugcccgucguguuuuguuaauguuuuuuaugaugcuuguagucaaaagaauuaccuaacaguucucuuuaugaaauagcuggguccaaacaauuuaaugaguauuuaugaucaagcacuuuaguagcaguuugaagaaauaacguguauccacuuaaaaggaaaaauauaauugucccucuaucucugugggggcacguuccaagaccuucacagaugugaaaaucuuuggaugccaagucccuaauauaaaauggugugguauuuguauauaaccugugcuuauccucucauaugauuuaaaucaucucuagauuacuuuaaaucaucccuaauacaguguuaaugcuauguaagcaguuguuaaacgguacuuuuuuuuuuacuguuuuuuuauuguuguacuguugucuuuuauugguuuuguuuucugaauauuuucaauccaagguugguugaaucugugguugcagaacccugggauaugaagggucuaugguaguauuuuuauuucauucuuaaaaaaccuuaauuacugaugagaugugugaagcuauugaguacugcauagcuucccaaaucuuggaaaccagcacccucauuuccauuucuacauugauuuguuuggguaguacuuguguuuuaucccagcaauuacuagucccucccucucuucaccaaagauaaagauacgaugucacacaaaaaaauguagcaugagcaaauauugaaacuguggacuaccuugaacuaacgguuuucagaguguuggacagaugucacuuuauuuccuucaaaaacuuagauauucugugauagcucugucaguuugcuuuggugucuuggggugccucagugcaguuugggagccagagcuuuaacuuggguuccuaguguuggcaguaccuggguuagcaugcagccuaacaaugaaaguauacugugugggcauauaauaauuugugccuugguauucauucagccagcuggcuuagaguuuuuggugucugcuuugugccagguacugcuuggacacugaggguuacagugaacucggauguguuugcucucaaggaucugacggucuguagggagaauuauaagauuaggaagugaagcaguagagcagaagucagcaaacucuuucuguaaagggccaggcaguaaauauuuuaggcuuuguggaccauucaaucucuauccuagccacucagcucuaacauugucaugggaaaguagucauagguuauacuuaaacuagugggcguggcuguguucuaggaagauuuacaaaaucaagaggcggguaagauuuggccuauggaacaugaauugugcaaccccaugacauaaauauaauuaaaguguuguggaagcagcagcagauggcaucuaaccuguggacucucagaggcaaugacaaacauaccuccugcuaggagcaucacugcugacuugaggagggugcagaugaaauuagcaagaagggaaaaagggugcuggccuaaggaguccugaagggucuggcagcuguggaauggcagccauuuuaguguggcccggacacacagcagaggcagugugcaaggccucuuucuagguucugacuccaguuguauggauuguauauuuucucucuuguucuuuuuuguuuuguaccucauuuuggucagucauguccugcaguagcuuccagagaauggguacacggaaggugauacaucuuuugacauuuugcaugucuuuguaaaauauauguuauccacucaacaguuugaguauagaauucaagugugaaaauaauuuucacuuguauuuuggaagguguucuuuuuagcuuuuauugcuaaaaagucugguguguuccuccccuucucaagaauauuuaugggucacacacccagugucucauguacacccguaaccugcucuggagguggugcugucaccaucccuguguuacaauggggguuuguccacacucacaccgcaagucacagaggccugacuugacuaauuuauucugauguuguucuuauuccugagcccuuguguauggccuccacucccuggaaacuuguaacaucuuugauacagauauuuugauauucucagugaugcaucuugguaucagucuuuucagauuccuugugcuggguuaugugggcucuuugaggacuagauuuuugcuaggacuagaccuauauacugauaaauuuugcauacaucuuuguuacugcagcuauguccuaguuaaucuccuugaaacaucacuuuguuccagcuucccucuuucugaaaagcuauucaugccuuccugugcagucuagucuucccagauagaacuucucagucuggccaaguguauguuuuucguaaguauuucuuucuuuuaacuugaagagccccuacacuucacuucaauaacacaauggagucuaccaaacugcagaguuuaugauccugaaaagccuucuucacugggagcuaaugcuggaggaauuuaagaucuugugggagggaaaugggauaaggaaaauaguugcuggucaaaguuuuuaaacaauguugauguuuccuccuaggaaacaguaaagaaagggacacuaggaagaauacaaaugagcagugcggguacuguuuacugccugugugauugcacuuguuuugcucaacucccagcaucuccacuccuguggaugggugacccacucguaggcuuauuuaccuuuacaguaguucagagucuuuucucccucgaguguuccagcuuaguauuuaauuucuuuugagaauuaaugacaagggagucaucuuauuguauggcaaaaagauagauucuugagauaaaagaugcuuugggcugucuugauuccuuucacccugacugugcagguguugccugaggccuccuucugcacacaaggcuggaggccucagugccaccaggcuagguucgugccagcaggacaugcuaacucacucucugucacguuuccugaucugucucuaccuaccuguccccaccaccgccaccauauuuauguauauagagagggguugggggacaggggaacagagacaaaauaagcaacaaaauguguugggacuaguuucugguauuuagcuuuacuuuucucaacucuuuuuuucuaauuuucuucggcagaaaagcccuaaaccucauguacacuggaaccagaauucucaagguugagaaaaauacaagucaaaguacaugugugaacacucaucuucacaaacaaggccuuuaaaagcucaggggcccguguugacaggacugaacuuugccauguggggccccaggcucaaguucugccugugcuuuaugauggucuaagauugaagucagcauauguguaaagaaauagaaccagauauuuuucuuuccauucaacagucuuacagauuuauucugcaugauuacuuuucuuuagcagaaggguuuauugacuuuuuaaguccuuuaaaauaauuaguauaggaaacaaacuggucacccuugggcaggaaggauacugcccaugagcauauuuugucuggccuuuagaauguguaaaacauaugcauuauuuucucacauuuacaaacuuugguguuucauuuaaaaugccagauuucuaccucaucuggaaaaaucagcauauuuggcaaaaugaggcugguggcugccacuuuuaugcuaggcagaggggcugcaguuugcaccugcugugaacacguuuguuacuugcuuugccccugcauauuugcauuugcacccuguugcugcauccuaauuuugaaaguuagcuccugaaaucguauaaaaauuugugcuccucuaaggaauaaggcauugacaggggaaaaaagugaauucugacaauguuucuaucaggagugagcagagaaaagcuucacaagcaucacuuuuuuucugaaaguacuucggaaggcucuguucauguauuguucuggcccacaguaaguccauuugaaaguuuugcuugguggggaagucugauguguuauaagcacaauauuguauugcccaaauagacuugcccagaauucucuguguaaauguaucacaccagaaagucuucuuuauuauccugcuuaaguuaagcaggcuucagugacacugccguugauccuucugucccugggcaucgccuuccuccugcuuacugaccuccucagcagagucuuugauccguggcuguugcuggcauaggcuuugugcgagcucgcuacugucugcgugccuguucccugccagcaggaauggaauauuacagcuucgcuuugggaagucucuuauguggauccugaauagagagcaugccucucugcuccaaugguugaggcugaagcagggagggauuaagugauuuacccucagccauaccacuaauuaguaauggagccaagauuagcaucuaaaucuggaagcaccugguccagagcucuuucucagcugccucccuccgccccuucuugcacuucuuccuggcauggcuguagggccugugucucuuuuuagaauaaucgaaacuuguagugagggacuguuucauuucaagauaauguuuagccagucagugaauaugguuuaugauuauuuuagucagaguuugaguuuuagggucauguuuggcuccauuacucaguuauucuuguacaguuguauaauucuauaaauucagcaacuggcauuuuagauauuuugugaauacauuuucauucuacuaaguaaacucaaugacccuggaauugacuaggaaguuauucauucauccagaaaauaauagaacacuuuugaaaugugugcucacgccuuuugcauguuaugguuauaauuaagcuauuugggauucauuuccuggguuuuugacaguacuugacaguagccgagaagagaucuugccaucugcuuucacuaagaaaaauauuuuuucgaauucucucaaugggcuccaguuauuuagguguuggaucuccuuuccuuuaucaagucuucauuucuuaucucuuuucccacauuuucaauuuuuuuuuguauuuuguucugaaagauuacucaaucuuuuucuuauuuuaauuuuaauaucagacaauauguuuaacuucuaagagcuauuuuuauuuccuguuauuccuuuuucauugcauccucuaguuuuuuauaguuaugccauguuugcucagaggacacuauuuagaguuuuuuagguucuuuuuuuuucuuuuaaguuuucuuguuuccuauaucauccccauuuucucuggaaguacuuuuuauuuuccuuuugguuauccuaaauuucucuuuaauauuuuagccuuugcuuauauguuuugugaucuuuggugcccugugccaauguuguaauaaaugaggcaauuuuaggucugacacaagaguuuucaguguaucauaaggaucuuguuggcugguggugucccucuaggaagaaaggaugaaggguggaugggaauuucauuacucugggggaucccuaaauguccaaugugcaacaucuccauacuguuacccuaguuuuuucuuuuuaaauuauuaaauuuguaugaaauagaaacuuuccaacaccauguaaaugggagacaaaacuaauauaacuugucauaaaugacuaaacacaaguuaacguacuaauaaaauacauaaaaauaucaauccagguaucacuuaaaauugucaaaaauucagucucaugcacugcuuuucuacauuuuaguagaguuggaguagaguugauagccaugugcuuauaauuuuguuguaauuuuauaauuauaguuaugaucuuuaacuugaagcccaucauuugaaaauuggccucguaguagauaccuaaagcaacagcuguguccaauuauugaugucuccacaagccagggaagcuugaguuugaguaucuccaaagucucuaaauguacaguguuucagaaucugucagaaucuauuugaguguuugugugcacaguauaaggugagccuucagaacaaucugaacaccaucuggaauuccucuccuaaccuaggacugacugcauugcacagaugauggauauuuacguauguuugaaacgaccauccuggaugguggacaauaaaagaaugaggacugcuucaaauuuccaguggcuguuaucaacauuuauucuucuauaucuaaugaaucaaguaaauagccagaaaaaggguaagugcaucagccuuccagagaaugaacagauugcaguuuuauuuccauuuugaugacgaagcaauuuuguugcuuuauugaccccuuuaggauuuuguugguuaaaauucauuuuuuuugucaucuuuuuucuauguacuuuuaguuucuuuuaaaaagauccuuaaugauagaucaaaauauuauuuuaccaugaaaaauuaaaauauaauuuacauacaauaaaauuugccuuuuuaagauucaguucugugaguuuugacaaugaauguaguuauguaaccaccagcacaaucaagauagggaacagccccggcacugcaaaagcuuccuggcuccucuguagucagcccucccaggcccauccccugccagcacugccuugucuccauagacacuguuuucugucucuauaauguuaccuuuuuagaaugucauaucaaugaaauccaaauauuuuuaaauguauuauguuacaucuuaaauauauuaagaauguuuauguagauauuuuauagcuuauuuauauaaagaaauuaucauccuccugcccguugguuuaguuuuuauauuauuuccauauuuaaauagaucucuuuucuccaaggucauucauuaaauuacuuuauuauuaugauuagugcugcuuuauaaugugaguacuuuuaauguaauauuuguuuuucugucauauaaauagccguauaauuuauugcuacagugaauaucguaccaaccauguacaaaaacaaaaacauuuuucauaaacauuuauagaaucugagauggacuaccuuuuuuauucuauaguugccuuuuccccuuguuucccuccuuucuucccucuuucccucucucuuauaccccccuucuuuuuacucauuuucuuuucggggugacuuuuuucauugcauagugcuuacauauuccaugguguaauguuauuuuauagaugugaguaaguacuaguaggauuguaaucuucugaauuguuacuuucaauuguuuaggcccacaccaaaaauauauuucucaaaugaacucaugaguuuauuacuguuuaaauuuaauauacuucauaauaaccuaaagauuaguuaugggaguucuaccaagggggcagucugguagcaagcaaugaggugggggugacuaggaguuucaaaguuuuguuuaaaaacuuggaaggcacaucauuuuuacuuaagacuucuuuguuuuuguuuuuuguuuuuuccuuaaguggggcuauugaagauucaagaggugcuagaauccccucaagcccucucuuggucccauuauugaaucuacaugacuagccacucacucccuuaauuugucuuaguugcuuggaaguggaauuuuugauagcagccuaaccccaaaauggucuaguagcuggcccacuuucaucaguuuacccuuuaguuguuuuuuuuuaaccaaagcugcaaaaagaaauagaaaaccaguccacucccaugacuugcaggaucaucucuuugaaaaaaaaaaaaacaugggcucucugcagacacacaugcuugugcuuacaacugaaaaugguugacuuuuuagagugcaguugacuuauucagcauauucuguguuuaugugugucugugugugugugugugugugugugugugucuccuccaggggcuccucaugauuugaaguguguaacuaacaauuugcaaguguggaacuguucuuggaaagcacccucuggaacaggccgugguacugauuaugaaguuugcauugaaaacagguaauuuuaauuuacuuuaauucacaaugagcuagguugaauugcagaaacgacccucaguucuuaccuuauugcuugugaaacuaaaggguuauuuccugcuuguguucuguguccagcagagucugccgugaccucugccucauuuuucuccuguagggcaccaagcauuaugaggugugauggcaaggugagaagaggggacagagucugcaguggcuuucagugcagaucugguagauaagacugucacucagauuucugccaccaaauaaagccacauggccauaccuugcuucagagaggcagggaaggacggucuuagugugaguccagaagggggagccugaaaaguuugcugaagagcacacaugcccaccacaggccaaacagagaggaaguuaguucuggcccccugcuccccugggaggucacaauaaacaaauaguagcaaggcugugguuuuugugcaagggaguggacacuaggaguaugaaugucuagaaaggcugucagaggagguguaauucuggaguaggcacagucaguuuucucagcagaaaaggaauaggaggacauucuacccugaaagaauauugaguacaauggcuugaauguaugagauggcgugauuuggagaauucagguguuuuugcauugcugaugccuaaagaagccucaccaugugagagguuuagaaggagaugagcuggacccauucaaguccagaguccuaagcacccagcccuaaggcuggggcuggguaguuggugggggcaggaaugcaagaggcauggaaaguccuuucaguaaaguaaacauuuguauaagaaguuugaaacauauaugaacaacaguauaaggaauauaagcaugcucuggagagauaucaagggcuguggaacaagagaggaaaauaucauuuugccuaagagauaccaggggaacuggaagcauuuugaaaacagaacugaagaggaaguucuguuaagaagaaaccaugagccaaggcagaggagcaggggaguugccaguuucauuuccuucaucagcauccguugaacaucauccuagcaugaggagcgcugugaugcacuggucccucagugaagggguggagugugaguaguggaagucagccuacaaagggaagguugaggugggauuuugaaaggcaugcaaaaacuccagcuguuuggagucaucuaugcuuauucuacuuuugguacaaugagguuguuuuuccuacccccacauugguaaaguuacuaucaaucuguuuuuucagucuuaaaaugcgguacaaccuaucauguuuuugcaacaaagagggcauaaaguauuuuccauuguauuuuguguuaaccaaauuuuuaugaaaauuauacuauuaauuuuauuugcuaauuaaaauucaauuucuuauuacaggucccguucuuguuaucaguuggagaaaaccaguauuaaaauuccagcucuuucacauggugauuaugaaauaacaauaaauucucuacaugauuuuggaaguucuacaaguaaauucacacuaaaugaacaaaacguuuguaaguauuugaaaacaaacucaauuuuaaaguaagucaagugucacuuguuaguauuguggugcuuucuaguuuuuugaauuucauguguuaugcuauuacuuuuaauucacucagcaaccucccuaugaauuguagaugguagccaagaucagaaggaagcaaacuuuucuucuggccagucaaaauagcccagaauucaggcuccuucccucaguuccauacucuuucuuuagcccccuugacuccugcguaccuuccagaauuucucagaugccccuugcucuaggguguagucuuaucugggaagcuacugaaaaaugacaguauuagaaucagaaaggcaaaucaagacagacuguaggagacucagucgauuaauaguucauuguguuuuacauaucauguaauguauugguagcauuauaaauaauaaugguccugaucaugauuagaauaacaguauugggauaagaaaauugaaaagcaaauuaggugaguguaaggaacggaggagauggauacaucagcaaaucuuugagcaccuacugugugcaagagaagcucugcaaugcauguauagcuguccuuuagaggaucuggaucucuugacaauuugcuacuaaauaaaaguaugaaaauuaagugucuguggaucuaaagaugcuuucuaaauuauauaaagcaaacaagauuuuauauauauauauauacacacacacacacacacacacacacaguaaaguuuguacuuaccauguguaagcaugaaaaauucuucauaagauuuuuaauuucugcauuucuuaaaaucaccugaaaauuugggucauucugaagcagaauguggguccuguaaaaaaaagcugggaauacucuuaucuucuuauguccuaaggaagcaggagcacguagauuauggguaaagcugaauuagcauuagaagaaaauaaaaaagauuuucauuaaauuucuucccuaucugaguuucuagaaagcaaguuaacauuguccucacaugucuguuuagcacaaagaaaugcagauggcaguuaaugggagcuuaggggaaacuucccuauaugcuauaaagaaaagaaagggagcaguggcuuuuuaaaauccuuguacuuguaauuauggccauuacugucuuuagcuugaaauguuggauauuacuuguauuuuuaagaguagcccacugcuauuuaaauaaaauguaaauuauguggacuuuucagggagggaagcauuuuaaagaugagcguugucuuaguaaaauacucccguguuucauaaauuguaaguuacuacaucaugugacauccugaaucauuugaaagaauagcuguguucuuggaagccucuugcucuuuucuggucacacuggcacccugagcuuucccuguccuggcacuaaaucaacuucuugccucucguuugucugcauuuuuccuuuuccacaaggagcugcccacuuaaaacuucuuuuuaaagcauccuccacuguccuuauacagcuguguaacuguugacuuugcucuguaguuuagacuguaaauccacauguucuguguccuguacagcccuaaacacuuuacauaaauccaguguugaacacuguauuggccaaauuuuaguuaaaccuauuuuuaauaacuauuuuuaaguuccgagauuaauguguauugguuuguucugcccuuuuuguuauuuagcauauucagcuacccuagcccugcacuguccugcaguuuugggcuuaccaugacuauauguaauugguccuugagcuucuaggauagaaaugaggcaagaaagggugagucuauggauuucuucuaacucaccuuuacuuuacuguuauuugaggaggaaacauggaagaaaguccaagucucucugauucucaaaccagaaagucuacauuucauagaauggaacaugcucauaccuucuuuguuuuccauugguccaaaauuuuccaugauuuauccgcccuuagggagaguuaaugauuuucaaggauacauuacucuuccugcuaccuuuuuuaguguccuggauucucccuaggagaugcccaaaccuuugagcauggauuuuuuucucuuuuaccuuuuguaaugcagcuucagagcccacuguucuccuaaacuucuuucucagauauuaacaguagccucgccagugguuuuuccacagucuuccucuauaaacuguuuuauuuggcacagguaacaacuauuuguuuuuauuucgaugauccuggauuuucucugguuuccuucugcuucuaggauucccucucuggauucauguugguguuuuuggcuccuugaagauguaauugucuauuggcagccccuaaaaggagcuuuggcugguuuaugucuuuguguucaugcucuuuucuaccacuacacucaaucaguuccuuuuaagucugcauccacguucugacuccauggugucuucuuccccugacccuuacucauccauagccaggcuucugugucucuucacagugauucccgauuccuuuugcuccucuugcugcuuucugagcuagaaacuugagagaauauugguuguuucccuuuuucauuagaaccaaccguuuauuucuuugauguagucauuucuuugaaauauccaugacaucuuuuccauagauggcaucuuaguuuauauccuugucacucuagccaggauugcuccaguggucuccuaauuggucaccuuauccccugucucaaucccccgcagucuguguugcauacuacugauaaaggaaccuuucugacacacuucuuauauccugcuacuucugcacaguaaccacuggcuucuuaacucaaugccuuagucacugagacaauccugcuacuguuuaaugguauugaaaaucaguaaugcccauagcauuucucaagugggugacaucccccagcacgagagacucuugacaccaggagaugccugagacagcugcagagaaaacagagagaagccuuuaccaaaggaagcuuucuauauuuuguuauuuucuuagggcugcccuacagccauacagaggaaacucguuuucuucucucugauguugccuaccuguagguuccugacuaaaugacacuagaguacuguggaaaccuaguugcuguuuguauuagaaaaugugcuguggauuugaaacagccagcuaauaaauaauuuucuuaaauuuggcugaugaagcauugggagcugccucuacaaauaaauaauauauauguuccccuuuuucagaaauuugagagaauauuagucguuucccuuucucauuagaaccaacccuucauuucuuugauccagucauuucuuugaaauauccaugacauuuuaucuuuuccauauauggcaucucaguccauguccuuauuacuggguucuagaguuuccuuuuaaaucuugauuauugauuuuuugaucaagaaggaauagaguuuauaaguaguugauuaguggaguuacaguaugaaaaaucauuacuuauuuuacuaaguuuucucuuuuguuuccucuuuuuaaagccuuaauuccagauacuccagagaucuugaauuugucugcugauuucucaaccucuacauuauaccuaaaguggaacgacagggguucaguuuuuccacaccgcucaaauguuaucugggaaauuaaaguucuacguaaagagaguauggagcucguaaaauuaguaaguuugaacauagauuuucuuccuaugacauuaaagaaacugaauaauuuuuuuuaagaagccuuaaggugguaucagugaacuuuuggauuauuuaggaaguaaaucagauaccuuucaggguucauuaaaaacaucaugcaugauuuaaaaaucacuuguuaauuauuaaaugauguguaaccauuacagauagcauaggaaauuaggggagaaauaagccgugauucuaccacuugaaaauaguaaguacuguuuuuguguauuccugucuggacuuguuuauaugcauguuuuuauguaaaugaaagugcacauuuaauuuaguguauuauuuuaccuuugucuaauguuuugaagcauguuuagccagaacuuagccauagagaauuuuuuuuuauaaaucuauaagcuugaauuuaucaguacaugcuuuuucccucucucguuuuuucauuccuguuuaugaauggccucuaaggaguaaugaacaacauuuaugaaaaguuugacagcuguuaccuggaaaugcucccuuucagccuuuuacucuuuuucuugauagauuuggaguuugcuuaguuacagguuuaagaauuagaagaccaucucaugauuuuacaguuuauuuguucaaguugcucaaguacauagauaaaauaguaaagauaauaaaaaagauuauucuauauuucauacuuucuuauuguuucucuuugacaacccauguauuucauuccuaaaauaacaauagucagcuagcaccuagccuauaugggacaauagccuauugcuucuaggccacauacaaaccugcauggcauguuacuguacugaauaauggaggcaauuguaauauauugguaaguauuucuguaucuaaauauagaaaagauauguaaaaauaugguauagaagacuuuaaauggaggagggacuucaagauggcugacuagaggcaccucguacucaacuucucuacaaagaagaaccaagauagggaauaguagaucuucacacuucaaauagaucauccuagagagagcaucgggauucaagagaagugacaggaagcaccuaaagcagggaaggaagaggaaagugaggcagccagcagaacaccagcaguggcuccacugcuaaagugcauuccaugugcccagaguccccugccugcaacugcugaagcacaaguggggcgugaugugccaccacuaaggcugaagcgugagugaagcgcagacuacagcuacugagacuagaaugcaaauugugcguuccccacuugcaugccuauggcuaccauugaaagcaaucucuuccuccucaguagcagggccgcagcacagccacugcugcuguccaccugagcauucuggagggagcauggggaacaccgcaugccugccuaccacagcuagugucuacauguacuacgagagggccugaggacaagcccacccagcuuuguucccuugcccuggugccagaacuuacagccuauggaccuaggaaucaccuagccuagucuaccaccaucagcaccugagcaccucuucuaggggccugagauuaggcccacacacccugcugcuaccaccacagcuggcaccuacugcacaugcuaccugcgggccugaagacuggcccacucagcacauuguaucuacugucagcaccagagugcacugcucaagacccagaggguuauccuaccacugcuacugccaucacccacaccacaccugcuggccaggggccugagaacguacccagcccaccacucucaauaccagcauccaagcaagccaccuggacgcucaagaauuggcccccuuggacccacuaacaauggggccagugaaugccauccugggguccaaagacaggcauacucggcuuaccacuuccacugccgggacccaaagacuggaccacuuacgccacucuuauucaacaauaguacuggaaguccuagccagagcagucgggcaagagagaaaauaaaagggauccaaauugggaaagagagagucaaauugucccucuuugcuggugauauaaucuuguaucuagaaaaguguaaagacucccccaaaaaacuuagaucuguaaauaaaguuaguaaaguugcaggagguaaaaucaauauagaaaaaugagaaguguuucuauaugcuaauaaugaacuggcugaaaaaucaagaaagccaucccauuuacaauagcuacagaaaaauaaaguaccuaggaauaaauuuaaccaaguaguuggaagaucucuauaaggaaaacuacaaaacugaugaaagaaauugaagaggacacaaagacauuccaugcuuacagauuggaagaauuaauaucauuaacaggaccaaacugcccaaagcaaucugcacauuuagauucaaugcauucccuacaaaaaugccaaugucauuuuccacagaaauagaaaaaacaauccuaaaauuuguaugaagucaaaagaaacccaaauagcugaagcaguccugaguaaaagaacaaacuuggagacaucacacuacucaacuucaaaauauauuaaaagguuaucuauaguaaucaaaacagcauguuacuuguauaaaaacagauacauagaccaguggaacagaguagagaauccagaaauaacuauguuuuuauagcaaacuuaucuuugacaaagguaccaagaacauacauaguuggggaaaggauaucaucuucaauaaaugguacugggaaaauuggauauucauaugcagaagaaugaaacuggaucucugucucucauauacaaaaaucaacucaagauagaugaaagacuuaaacauaagacugaaacuauaaaacauggggaaaauacuauaggacauugguccagguaaagauuuuauggcuaaaacugcaaaagcacagacagcagaagcaaaaauagauuauauuaaacuaaaaagcuucugcacaacaguggaaacaguggagugaagagacgguugaaugggagaaaacauuuccaaacuauucauccaacaaaggacgaauauccagaaccuaccgugaacuaaaacaacucaacaauuaaaaaauuaauacucccauuguaaugugggcaaaggacaugaauagacauuucucaaaagaagacauauggacaacagguguaugaaaaaaugcucaauaucacuacuuaccagggaaauacaaauuaaaaccacaaucaaaucagcucaccucuauuagaauggcuauuauuaaaaagacaaaaaaaacuuauauauuggugaggauguggagcaugggaagcucuuauacaaugcgacugggaauguaaauuaguacaacuacuauggaaaucgguauggagauuucucaaaaaacuaaaaagagaacuccuauaggauccagcagucccacuucuggguaucuguccaaaggaaaauaaaucaguguauuaaaggguuaccugaauucacauguuuaucaugccacuauucacaauagaaaauauguggaaucaaccuaaguguccaguagaugaguggauaaagaaaaugugauauauacacacaauggaauucuguuuggccauaaaaaagaaugaaaucaugucaucuucagcaaccaggauggaacuggaggccacuacgcuaagcgaaauaagccaggcacagaaagauaaauauaguauguucucacucacucauggagacuaaaaaagcugaucucauggagguaaagauauuauuaguaacagaaugauagauacuagagacugagaaggguguguuggugggacggggcaggaagagagguuggugaauggguacaaauguacaguuagauagaagauauaaguucuguguuagauagucaaguagggugacuguaguuagcauccauguauuauauauuucaagguagcuagaagacuugaaauguucccaacacagaaaugauaauacucaugagauaauggauaccccaaauacccugacuugaucauuacacauucugugcauguaaccaauacucacauguaucccauaaauacuauguaucaauaaaauguuuaaagagauaaaaaaugguacaccuguauaaggcacuuaccgugaauggagcuugcaggacuaaaaguuucucugggugagucagugagugaauugagggccuaggacaugacuauucaccacuguagucuacaugguacaauuagaccacacuaaacuuauaaaacuuuuuaucuuucuuugguaauaaauuaaccuuagcuuacuguaacuuuuuuacuucagaacuuuuaauuuuuaaaaaauauuuugacucuuuuguauuaacacuuagcuuaaaacaaacacauaguacagcuguacaaaaauauuuuuauauccuuacucuacaagcuuuuuuguauuuuuaaaaauuauuuuucuuuaacuuuguaaacuuuuuuguuaaaaacaaggacaaaaacacacacguuagccuaggccuacgcagggccaggaucaucaguauaacagucugccaccuccacaucuugucccacuggaaggucuucggggcaguaacaugcauggagcugucaucuccucugguaaccaugccuucuucuggaauaccuccugaaggaccugccugaggcuguuuuacaguuaacuuuuaaaaacauguagaaggaguacccucaaaaauaaugauagaaaguguaguacacuaaauacauacaccaguaacauagucauuuauuaucauuaucaaguauuauguacagagcacaauuauauguguuauacucuuauaccagcagcacaguauguuuguuauuccagcaucaccacagacacaugaguaauacguugcacuaugacauuauguuggcuaugaugucacuugguaauaggaauuuuucagcuccauuauaaucuuauaggaucaccaugguauauguggucccacauugacugaaguauuguuauauagcacauuacuguauaccuugauucuuuuuauccucacaacagucccaggagggugauacuauuauuauucccauuuuacagaugauacagagucacaggaagacuuuaagugguggagucaggauuccaacccaggcagcuugguuucagagucugcucuuaacugcuacaauuuauauuuuauaagaaauauauauauuuuaauuuaaaauguccuccccuucucacguauccuacucgaaccugcauuucaagacccaggucaaauccuacuccuuauuuuauuuuauuuuauucauuuguuuuuagagauaggguucugcucugucaacuuggcuggaguacaguggcaugaucauauagcugacugcagccucaaacuccuaagggauacuuuugccucaguguccugaguagcuggggcuacaggugcaugcugcugugcccagcuguuuuuuuuuguuuguuuuuuuuuuuuucauagagauggggucucacuuuuuugccccaucugccuacuucuuauuuuaaagcccauccuuuuuuuuuuuuuuuuuuuuuuuuugagacagugucuugcucuguugcacaugcuggagugcaguggcaugaucucggcucacugcaaccuccaaaucccggguucaagcuauucucuugcuucagccuccccaguagcugggacuacaggcacaugccaccacgcccgacuaacuuuuuguauuuuuaguggagaugggguuucaccguguuagccaggauggucucgaucucuugaccuuguaaucuggccaccucggccucccaaagugcugggauuacaggcaugagccaccgcgcccagccuuaaagcccaucuuaauucagccugcagacucucacuuuucuugauucuaauggcaagucuugucuguuaaucuaauuugcagcuagcuuugauacaguucugcaggugcugucuuaaagguauuauuuauuuaaauuauauugcuuaacuugucauuauggccuaacauuuugcauucuggguuaccacuuacaggcuuaggauaacuccucaaaccuaguuuguaucuuuuguaaaguggcaauauuugcucuggggucugcaaaguaaauaguauaucuguaaagcugcuaaacaaauauuauuugucacuacucccuuuagggacaaggcuuuuuauuuuuuuauuuauuaaauuuuauaauuuuuuauuacacuuuaaauucugggauacauguacaaaccugaagguuuguuacauagguguauacgugccauggugguuugcugcacucaucaauccaucaucuacauucgguauuucuccuaaugcuauccuuucccuagccccccaucccugacaggccccgaugugugaugucccccucccuguguccguguguucucauuguucaacucccacuuauaagugagaacaugcgguguuugguuuucuguuccuguguuaguuugcugagaaugauggcuuccaacuucauucaugucccugcaaaggacaugaacucauccuuuuuuauggcugcauaguacuccaugguguguaugugccacauuuucuucauccagucuaucauugauggguguuuggguggguuccaagucuuugcuguugugaauagugcugcaguaaaccuaugugugcaugugucuuuauaguagaaugauuuauaauccuuuggguauauagccaguaaugggauggcugggucaaaugguauuucugcuucuaaauccuugaggaauugccacacuguccuccacagugguugaacuaauucacacucccaccaacaguguaaaagcauuccuauuucuccacauccucuccaacaucuguuguuuccugucuuuuuaaugaucgccauucuaacuggcaugagaugguaucucauugugguuuugauuugcauuucucuaaugaccagugaugaugaccuuuuuguucuuggccacauaaaugucuucuuuugagaagugucugugcauaucguuugcccgcuuuuuugaugggguuguuugauuuuuuucuuguaaauuuguuuaaguuccuuguagauucuggauauuagcccuuugucagauggauagggacgaggcuuuuuuaauuuuuaauguaacuugaggaggaacuaacuagagaauacuagaauuaaagagggacacucugaaaugugagugaaaucaaacuuaaaugaagggacuguuaggcuaaaaccauauagcucauucuacaacauguguaagucagccaaugacaaggcaguaauuccuuacuuuugggaaaaaauuugggaaaauaauagcaagaagcaaugagaaagaacacauuucuuuagaacuguaaaguaagggaaaaugccucagggcauuuuuauuaauaguacguuauuaaugucaguauuuaagacaaaauugcuugugaucagucauuuuaugauauccuauuauuuugcacuaaugcuauuauuuuauaauaauuuaaaaaucaagaacacuuugcauucauguuucauuugugaggcacuugucugucuguggucucuguguccagcagugggagcugugugcugcacacacugggaagagcucaccaggcacugcucccccacacacaaauacuccuccuugacuuucccuggaaacgaccuguuucaacucuuuuaacugaucucuuucauuauuuaucuucauuucuccaaauaacaugcuuauguugcuauuucuugauagcaacccccucccuuuccuccucuccccccaccgccucauuucucucugcuccucccucucccuccuucuccccgcagccugccauuuuccuagcuuuuuccaauagagucuaugauaauuuuugguagaacaguauucaucauuuguauuauggucuauaaaaaaauccacaauuuuuuguacacuccuuauauuaucuuguuuuuuuguguuuauuucucugcuucauuacuuuaauccuaaauucuuugcaggcuguguagaucuccuuggaauuuucaaauauacuaaguacuuuaucaauuuuaucuuugcgaauaaaucucugagggcuuucuggcuggcuucccaaccuuauucacagaaggcucacauagacacugauaauauuuguauagcacagagugugguaaauagccgagaccgcuuguggccagaggcaucacagaggcuccaguagccccaaccccuaccaagcaguucuagguuugaauggauuaauaccuagauauauuuauaacucacucaagauagacuucagugucuuucagcacauuucuuaggaagcugugguccaagggaucuccaucaucuaggguauuuccuacaacuuugucuuaugauggaucuucuuuuugccaaaucuccagucguucucuuauuuccucauuuuuguggaagcauuugcacuugucccuugguaucuuuugggggauugcuuccaggaccucccuuagauaccagaauucaaagaugcucgguagcguuagcauacaaccuacgggcauccuccuguauauuuuaaacccucuuuagauuauuuguaacaccuaauacaauguaaguguuguguaaauaguaguuauacuguauugucuaaggaauaaggacaagaagugucugcacauguuuagcacagaugcaaauuuuuuuccaaguauuuuugauccauaguugguugaccucacagauguggagcgaugaauagagggagccaacugucaguaguuauuugcuauuguagauauucucugcuaucuauaauagcuagcuugcaaauauaauuuguucuuuuaauuuaauuauuuaaaaauuuaaaagcuugucaauuacuauuacugagaaguuguagaggaacuggaacuuucauacguuacugggcagaguguaaaaugcuuaccaaaggaauacauggagauaccacauuuaugaaaaugucuauucugcacucgugcgugauuacuaguuuaacuggguguagaauuacagguugggaaauuuugucaagauuuugaagguaugauuccauuguuucuuaguguggaucaaucuuuaucuguucuucuggacacucauugggccccugucagucuaaaaacacaugugugucagcuugggaauuucuuguuuuauuucuuugauuuguccuucucugucuucuccuuuuuuuugagaacuucuguucuucaugaaccuuccacaacaauccucuaauuguuuuuaucuuucuuguuuucuauguauuuucuauuuucucagaaauuuuuucuaaacuggauuuugcauccugcuauugaauuucuauucauauguuuauuaauuuauagaagauccuuucuuugaaaggauuuauguuauuuuuuuaauguauccaguuuuuguuucaugaugcaaugucuuaucucugaggauaguaaugauuuaaaguuuuuuucuacaugcccuguuuccucacauuuuuucuuuuucuuuucuuuucaauuauugacuuucguauuagaauuucuuguacacuuucuggucauccugguugcugcucacaguuaagcgaggggcuguuaaaaauuuuuuuuuaaucuaauuggaacuuugguuucucuggauaggacuuguugaugggggccuucccucuagagugaugaggaugggcuaugcagguggcaaacgccaaauauuauuuuagguauuucauuuugacauguuuaugugacucagaaaaguucauuuagacuauuaccuggugaggauuagucuggcaaaccaguauccugggagcugagcagaggaagaaggcauagguuagcaaucccccuguuuuuggaaugauaguccccauucucaucucuuccuaaaauucuucaauccaaagauauucuguuuuacuuuuccagaacauaaaucuuuauucuucugccaagguaaacaaagguaguccuucgguaguguggagugugggaagggaucuggguagccaacauaucuucaaacaacuuucaagcaguccugcuguuuugagcucuuuauuuccaggggagccugggauagccacucacugagcccuuuggcauuucugugauagaaacaagcuguuuuccuguauuucccauuggaugcuuaagauuuuguuuucucaggucuucuacaucaguuaccauuauccaucugcuuuccagcuuccagauuuuagugauguugcuuuauuucuauauuuugucuuuguccauucacaccuuuaaaaaaaaucuguuuacucuuuggagugauuucaggagguaagggagaaggaaauaguuguuuaaucuauuguguuugccuagaagucccaaguuaucuuuuauagcaccucaauauuuuauugaaaucuugcucauuucucacaauuaauaauaauuuguauuaguauaacuuacauauuuaaucuucuauuuaaaaauaaaagcaacuauauagaauacuuauauaaaaaacaaaucuagucuaaaacuauuuuauugaaaugcugccccucuccuugacuuaagcuuuugaaagugcaaccccauuaauuacuucuacucuaugaaaaauuuagaucauuaggcagugguauacagguugagcaucccuaaucugaaaauccaaaacucaaaauguuuuaaaauucaaaacuuuuugagcaccaccaugaugcucaaaggaaaugcucacuggagcauuucagacuugggauuuuuguuauuuuauuuauuuauuuuuuguuguuuuuagacaggauaucauucugccacccaggcuggagugcaguugcaugaucucagcucacugcagccuugacuuuccaggcucaauagacccucccaccucagccuccugaguugcugggacuacaggcacaagccagcaugccuggcuaauuuuauuuuuuuauuuuuuauuuuuuuauuuuuuuguagagaugggguuucgccguauuguccaggcuggucuuguacuccugggcucaagggaucugccugucucagccucccaaagugcuggguaaauuacaggugugagccacuguccaggcagauuuuagauuuuuagauuagagaugcucaucugagaaguauauaaugcaaucugaaaaggugcaaaauccaacacacuuguggucccaagggauacucaaccugcauuuucuugcauaccaaauugaauguuucaaugaauagcaacaucuuauauaauacauuagggccuaaaguugaagaaguaaacaaaugaaucaugauuauuguuacucugcuauuauaccuuacacaaaacugaguuguauuaaaggacaaaacauaaacuuagcugaugauuguauggaaucuauugugucuuuuaauucuaaaggaaagcaaaacauauugcuacuuggaaauacaguuuuguguuuguguucauuuuuaggugacccacaacacaacucugaauggcaaagauacacuucaucacuggaguugggccucagauaugcccuuggaaugugccauucauuuuguggaaauuagaugcuacauugacaaucuucauuuuucuggucucgaagaguggagugacuggagcccugugaagaacauuucuuguaagcuuauauuuaaagaauguuuguuucagaugaauuaaauuagucucacuuaagaguaagauuuaguuugagcuuucacuucucauaaccucauucagcugcaugaggauuaccugggagcgucuaagcccaccaucccuggagauuuugaucaaaaagucugagauaggcuucaggaaucuguauuuugaaagaacuuucugagugguuggauaaacauccagguuugaaaaucacugucauaggaauugaagagcauuaaaaauuguguguagaugauacugagaugaaaucuauguuuaaaaaaaaaaaacaaaacaguucccaauuucuggcucacagagcagaccccuagaggcugcauaguuauugccaggaacacggggaucugcaagcauaccaaaaagcauccguacauuaaguaaaacucauauacagggagaauguuggcaguuucgaauagggggccuggaaaauuguugaccauaaaaugaaauccugaaaggcugguagucauuguagagauagaucacucuauggauaaaaggauuagaggaaggaaggggacuagauuaaaguaaguuguuuuuuaggguguggaguacuugggcauauauuuaggcugauggaaaguaagacauaugcccuaaauacauugaauaaaaggaauggaauuauuuaauuagugauuuuugggggguguggauuguucacauguauauauaaacccacugaauuucaacccuuagacuucuuagacauaaaccuguggcauuaacuuuagacacugaccuguaaucugcuucugcuuccucaccauuaucccuucauaaguaaauaaaaccacauacacuuuuaaaaaauuuaucguauauaucuugcuccuacaaaaccuguggaacacaccuuaucuuuggaccauuaucauuacaaagcaccuaacaguuuguaguguauauacugggcuauuuuaaaagucaucuuaugaaaagaaagucuuaaaaugcagaaaaguuuauguaaaauacuucuauauaaaauguuuauaauuccucuuuuucuuucuagggauaccugauucucagacuaagguuuuuccucaagauaaagugauacuuguaggcucagacauaacauuuuguugugugagucaagaaaaaguguuaucagcacugauuggccauacaaacugccccuugauccaucuugauggggaaaauguugcaaucaagauucguaauauuucuguuucugcaaguaguggaacaaauguaguuuuuacaaccgaagauaacauauuuggaaccguuauuuuugcuggauguaaguauaugauuuuaaagagagaauuccuauuaaccuguuuuggucuuccuugaaagccuuaauucuucuggagugggggggugggaggagugauucuguuucuuucucauuucuuuguucuuuaauauaaaggcuauacaaaggcacuagaauauuugcuuguuuuaaaaugaauugcaagcuuguuuuccacauaaccuguaucuguguaauuuguugguuuuguaaucagauuugaaacaucuagcuucuaauguuuaguuuaaauucuuaguuaacagcuuuguuaaggauaggauauaauauuucuuaacccugcauuguuuagaaauuaugugaauucauuuuccaguuaaaguauaccuuuuuuaaaguaucuaaauuaaagaaauuauagcaauuuuacacaaaaucuuucaguagcauaacauaucuucuccaucuuuuaacuauuauauuugaggagaacaggcuggcaggaggacaugggugaggggaaacauacucucccacugcguucuauauauguuguaugcucugucauucaaggugucuauuaacaugaucaccccacagucuaaaauuccaugguauuuccaaaaguaguuuguugugggcugcccugcccauguggcuuguguugaauguccacagauaaauauguagaauuuuuaggucucaauuuuaguuuuucugccucccuuccuuguagcaacuguaauguuuuggugucacugacagcuucaucuuuaucagugagucccuuccucccuuuaugcugaauuagaagucugggauuuuggucuaaaggucgccugaauaauguguauaagauagauugacuagauuuuaugauauuucuuuugauuccuuagugcuuuuucuuucuuucuuuuuaugauucucagcuguggucuagaucagcagcucucucguuuacucauacaguacuucgugaugaauuucauucagauacugauguauucccaaaggaauagccggguuuaggugcucgucucagcuugauggcuguaaucugacucucuuuuugucugcucaguaaugcauuuggaauucaagugaaagugagguuauguucaaauuuaaauccuggaaaucauauuauccuucuuaauggaauguuaggaaauuacuugcaacauuucucacaaauaguccuggagucuaaguugagacccagugguauauguagugaaguugcuucgugagcaguaccaaaagugagcuauuacuuaaaaguaugaaagaagaaauuaaaacuuaaaaaaugagacugugcacuguuuccauuuguguuauuucagacaguguuguaaucuuuuaucauaguaauagaacaagcuaauuuauaguuuaaccuucauuuauaacguuuggagguugaaauauuguacaauauuuguugagcagcaguaacaucucccuucagagagaacuuuuaggaaauuuauaagagcagguuauuucgugaguuagguaucaggauucauuuauuuccuuucuuuauggauauccuguuaagccaccauuuacggaaaagacugaaaagaaauuuaggccgggugugguggcuuacgccuguaaucccagcgcuuugggaggcugaggcgggcggaucacgaggucaggagaucgagaccauccuggcuaacacggugaaacccugucucuauuaaaaaaagaaaauacaaaaaaauuagcugggcaugguggcaggcgccuguggucucagcuacucgggaagcugaggcaggagaguggcaugaacccaggaggcggagcuugcagugagcugagaucgcaccacugcacuccagccugggugacagagcgagacuccgucucaaaaaaaaaaaagaaaaagaaauuuauaaucggcuuguuaguuuuucccuacacacacgucugcgugcacacacaccuacccaaucaaaaccugcuggcguuuugauugggauuacauuaaauccguggaucaauuuaggagaauuuucauucuuacaauauuuguaucucccaaacuaugaacaugguauaucccuacauuuacuugagucuucuuuaauucaucuuaauaugaggucuuuaugucuuuugguaaauuuuuuccuagugcuagguguuuucugauauuauuaaaaaugacuuuguuuuuuaaauugcauuuucuauugacugguauauaaaaauguaguugauguauaccuagcuuuuaaccuaguagcuucaguugauuauuuuauaaguuaauuucuuugaaaagaaaauuaguacauuucaaauacuguccucucaaauuuuuccccuucugucuguccuucuauuuaucucuuauuugcucuuguuauuuagauuuuaauauuucaacuuaauaucuaccaaauccuaaaauaaccagcauuuuaaauauauuccauauuuuugguaugugguuuuaauagagugacugaauauuuggccuuagauuuaaaacaauuuucagaauaaauaugucaauguuuguuuacuuaucuaauuguuaaacucucauauaaacacucauuaauccucuuaauguuaccugaaauaucauugaaggauguuauccuuaucucuggggaagguaugaaauuuuccaaguuuugguugauaaacuaaggaguauuuuuuuuuuaauucagauuugugaaaaaaaaauuuuacagaauuuuuaaacaaguaguuuuuuuaaaaaagaacuuuuaccuaaagugaaagauaguuuggauaaauaugagagaggaaauaccaguuucuauauguguaugguuaaacaugauuacagaaauaugaauuucuacaauaagcagugucagacugcagacuuuuaauuuaucacuuuuuuuuuuuuuuuuuuugagacggaguaucgcucugucgcccagaccagauuccaguggcacaaucuggguucagugcagccuccaccucccagguucaagcgguucuccugccucagccucccgaauagcugagacuucaggcacccuccaccacacccggcuaauuuuuguauuuuuaguggagacgggguuucaccauguuggccaggcuggucucaaacuccugacuucaggugauuugcccaccuuggccucccagagugcugggauuacagaugugagccacugcaccugggcucauuuaucacuuugaaggucucgucuuaaaaaaaaaaaaaaaauuucuuuuaauuuuucuaguccugccuuaaagcuggggagagcaguuuugauaaagagaaaaacaacaaaagagccgcagucaguuuguauauacugagaugcagaauuuuaccaagaguuuucuaaacaacaguacuuauaauguauuuuagaacucugaaacauguaacaugacuuacugauuuucaauaugauuugguauuucuuuucgaaucacaguauauugaugauagaugauaauacuuuuaaccuguagauuucucugacaacauauuagacucagguuucuuugagagauuugguagccucugaaauaggauuaagggaaaaaaagugacaacugauauuucaaguugcuacagggaguuuccagaugagcuaagagucauuuuucaguauauuuuaaucugucaauucuaauguaauaugaacucugacaagacaugcuacagagagaauaauuccugcauuauucaaaaguaaaauguaaauaguaaauuauuucauuuuuuaggaaauuguggaaaacauugacguuuauaaaauauuauguuuucagggaaaauauauguaaucauaaguaccugcauuuuuuuucuguuagauccaccagauacuccucaacaacugaauugugagacacaugauuuaaaagaaauuauauguaguuggaauccaggaagggugacagcguuggugggcccacgugcuacaagcuacacuuuaguugaaagguaaugauaacugggaaaagaugucagauggcaaggaguacguuggaagugcauguuaaaugacauagggaacugcacuagaucauuuauguuacaaacaagauauaaaaccaaauaugcuguauaaaauuacacuuauaagcacugcaguucagccacauguacacucaauuuuaugucuccucuuuuaagaagcuuagaaugaagaacacuugaacaugaacagagacuguuucucgguaguaaacuuauggcugauuaauuucuucuauuuucuguaucacauacauuuucuucucugaguauguaauaugcuucuaauuagaaauuuaaacuuuuuauacaaauuaaguauuacgaauuugcccguuuuuuccugcaauauuuaucucuugccauuuugaaauuauuuuucuguuaauuaacaguuuuucaggaaaauauguuagacuuaaaagagcugaagcaccuacaaacgaaagcuaucaauuauuauuucaaaugcuuccaaaucaagaaauauauaauuuuacuuugaaugcucacaauccgcugggucgaucacaaucaacaauuuuaguuaauauaacugaaaaagguaagcuguacauaaacuaaugucuuaaaaauaacuuuaaaaguggugaaaugcuuuaaugaaaaaugcuuauagggauuacuuuuugcugauuauuuucuuuauaguuacuuaauauuaauuucauaaauuuuauuuauaaaaacuuuaaauguauaauuucaaguuuuacuauuuuauugaauuuaaauacuugaauuaguaauuuacucuuucugauaauuuuugauuucugaaauaucuucugcccaauuuuuaaaaacuuuuauuuugaaguaauuguugacucacugguaguuacaauaauaagagccuugugaacccauccccuggcuauucccaguggugucaucuuauauaauucuaguacaauaucagaaccagggaauugacacucuuaaaacacuguuaacuagacuacugaccuugcucaguuuuuaugugcauucauuuguacucguguguguguguguguguguguguguguguguguguguguguguaguucuaugcaauuuauagguauagauucagguaaccaccaccacaugcaagauacagaacugcccugucacuacaaaggaacuugcucauguugcccuuccagcauccccuguacauacagucacaucccugugccuugacaacaacgaaucuauucuucaucucuguuuuaucaguuugagauuguuacauaaguaaaaucauacaguaugcaguuuggcauuuuuuuuuuuaaggauguccuggagagccauccauguuguuguauguauuaauaguucgucccuuuuauuacugauugcauuuuuaccaaucguauuaauauauagcuccaaauaaaaauaaaaugugcuuggucuuuuugguauucauucccaugguccaugugcauuaacacuccaugucaggcucacagcacacugagcaacggccuagaccuucucuuagagacucaggcaggggagaaagggccuaaaccgaaggcaugucucauacagucucacagcugauuaguagaugauccuguugccuuauuuguaagcauaagucacuuuuaucaguuguucuuuccugucgucuuugcgauuucuggauuuuuccuagugucaccauggcuacauuuuauccuugcaugguaguauuuguauguauuugucugcccucugccauuucagccuuauuucccaugugauucuuucccgccacucaacugggcauacacacuaucaccaguguaauaugcaguuugccucgcuguaccuucauuauuggcaucucugccuaaaaugcuuuucugcauuuuuuuuggcuaauuuuugucugauucuuccugcauagcucaucuuaaguuccaucuucacuguaagacuuaccuuaccaugcuuacauuuacauagugguuaauaucuguaucauucauuuagaacuuggcauuuauauucuuauuaauuaccuuucuuucuuuuuucuuuucuuuuuuuuuuuuggucauucccuaaguaaauuagaaguuccuuaaagguagauacugugaucuuaacuaccuuugaguauuccugacacuaauuuaagagcuuugagcaugaucgauuguuuaaaaauguuggcaagaugucaguaguagaaauuagguuugucaauuccacaaauacuggguaggauguuguuggucagcacuaaugaugccucguuguuuuuuauguuuucuucucauuugucauauuagaagauaguuuuucccuuuaaauaaguguuuaaucuuuaaaaauuauauuugcaguuuauccccauacuccuacuucauucaaagugaaggauauuaauucaacagcuguuaaacuuucuuggcauuuaccaggcaacuuugcaaagauuaauuuuuuaugugaaauugaaauuaagaaaucuaauucaguacaagagcagguaagauucucuuaaagacuuccuuugugauuauuuuggauaaaauaguucucaaaaagaauuaagcaaauugauaugcuuaagcucucagauuauuuauuauagagauuuacuaagaaccaagaaagacauuacuauccauguaauaacagcauuguaucauuugaaaaacaauuguaaauaugacuuuuacuccucagaauguucccagaugcacuauaguaccuggcacauagcuggugcuccguaaauuugugaaugaaugaguaguuuuugcuguaacuuuuagcaucauuaauggaugaauuggcacuagacagcagaagugauuuuuuaaaacugugaaguguggcagugggaacaagcuguaauugguacuuaaaagucacaacaugacuuuuuaauacauuuuaaauauuuagguugacuuuuauauuauacuaucuuguaauuugugguaagucugaaauaaaugagguguacuuaacuauucauuuggaaauuuacugaugucuagaaaaucagucacaacuguaaaauauaaccugaaaaccuucuuuguaauguuuuggggagcucagaggcuuuugugaaacaggcagauauucaaauuuguuuagaaauguuucauuuuaacuauauuuacuuaguuuaaggaaguauuuguugaauauuugcuacauguuuagcaucauacuagaaguucuaagugucauauuaacaaagaugcacaaaagguaaugccugccuccaagaaacuuccaaauaucauccaaauaauacauuuauuccucacagucaucucaaauuauaaaucacauuaagguuuauugcaucaccauuagcccuuugauuaucaaaauuauauaauccuuuagauaauuuaauugaccauuauuacuuagagccaguauuuggauuaaaaagauaacccaauuuuuuauuacuauuacagggcauaauuucauuggcuuggcagguauauaagaauuaaaauauuacaguggauaaacugcuuuggguguuacauauacaaacucauugacauuccguugguuuguguuacaaaugugaaggcuuucuuaccaaaaaaaaguguauguauguguauguauauauauauguauucauacacauaauauauacauauauauauauuuauuuguuuuccaauagcggaaugucacaaucaaaggaguagaaaauucaaguuaucuuguugcucuggacaaguuaaauccauacacucuauauacuuuucggauucguuguucuacugaaacuuucuggaaauggagcaaauggagcaauaaaaaacaacauuuaacaacagaagccaguaaguuaacuaagugauguauggcuaauaauuacuguguauucugaaguuuuacaacuucuuuaaaaagaagauguuggccgggugcagugggucacaccuguaaucccagcacuuugggaggccgaggugggcagauuaccugagguugggaguuugagaccagccugaccaauauggagaaaccccaucucuacuaaaaauacaaaauuagcugggcaugguggugcaugccuguaaccccagcuauuugggaggcugaggcaggagugaaucguuugaaucugggaggcggagguugcagugagccaagauugcgccauugcacuccagccugggcaacaagagugaaacuccgucucuaaauaagaaaaaaaaaaugcuauuagaguccuuaaaggugggggaauguuuagauaaauuauguaauaccugcuaauaaaauaucacagauauuuuaaaugauaguuuugaaguuuugucauaguauagaaaaaugauuggcauaaauuaugagaaagccagggcuccucuaucuauacuaugauugccaccauauuacgauaaugcauagaaugauuuuucucccauucuuuucugcuuggaauuuuaauuaugcuuuuaacucauuggccuuuuuuuuaaaaaaaaaaaacaauuacuaaaaaagagaauuuguuaguuuuuauuugugaccuagaccugagaaauguggcuaaaaggucuugaacuucaguuucuguaguauacccaggucaaguuagguauaaaaucagguaacugguuuucuaaauaugauaauuuccaaagacagaaugauauucuaucuucgaauaaccagaugucagguguaaaaaaaaaaaaacucagaaauagguuuaauuuuuuauuuuuuugagacagagucucacuuugucaccuaggcuggagugcaauggcgcgaucucggcucacugcaauguccgccucccggguucaagugauucuccugccucagccucccaaguaggggccccaccaccacgcccggcuaauuuuuguauuuuuaguagagaugggguuucaccguguuggucaggcuggucucgaacuccugaccuugugaugugccugccuuggccucccaaaguacugggauuacaggcgugagccacugugcccggccgaaauagguuuaauuuuuaggaaucauuuaacaaaagauagcaaaagcuuuauuuauauuaugcaguauaauacuuccuccaaaaauuuaagaaauagcaaagcaaauaaaugauagauguuaaucuagauuuuugccucuccacaugaagacaugugaagaauagagaugagggcauuuugcgacauguguaagaauuacuuguaucaucaaaagugaaagcuaugcaugaguacagagagggaggauaugaguuaucuauugcugugcaacaaauuacccuaaaauucaguggcuuaacacagcagauguuuaugaucuucccauuucuauggguuaaaaauccaggagcagcuuagcuggaucucucugacuuggagucuuucaugaggcugcagucaggaauguggguggggacugcaggcuucacuggggcuagaggauccacuuucaagaugguucacucauguggcuaaaggcaggaggccucaguuccucaccuugugggccucucucuaggccugcuuaagugugcucaugacauggcagccaguuccucccagagccggugacugaacaguaucuuuuaugcucuaaaaucggaaguaacauaccauuaugucuacugcacacuguuggucacacaggccaacccugaugcaaugugggagggcaccacgcacauggggauuauuggucauuuuggagacuagccacuguaguuuuugccuucaguuaaugagcuguugucuccaagaggaaacaucuuauuugcaccucauuaagaugaaggcaucaauuuacucaacaaauauuuacugaguaugcauuacagauugaacauacguaaucugaaaaccugaaaugcuccaagauccaaaacuuuuugagcaccaccaggaugccacaaauggaaaauuccacacuuaaguacuuaacacaaauuuguuucaugcacagaauuauuuaaaauauuguaugaaauuaccuucaggcuguguguauaagguguaugugaaacauaaaugaauuuuauguguucuuggaucccauccuccaagauauuucauuauguauaugcagauauucuacaauuagaaaaaauccaaaaucugaaacacuuuugcucccaagcauuucggaugagggauacucaaccuguaugugucuggaauuguucuaguuagcagugauauagcagcagauaaaacagagaucucggccuauggaguuuguaggauccaggacuagaaauaaauuuauauauauacacaucuauauguauguauguacacacacaaacacaaagacacagacacaucaguuuaucagcuggugacaaaugccacagaggagaggaagugauaggaauagaggcugagggauaaggagggggugaagggaauggcaguuuuaaauaggguaguuagaaaagaccucacuaauaagguaauacucaagcugagauacaaagaucaggaagcaugccauauuguuuuuaucuaggagaagagaguuguaggcagaggaagagagggcacagaagaugcagagagccugaggcaguugugucuuuggcauaucugagggacagccaggaagccaguguguggccaagaaaggagggagugagaggaugugaggcagaggggaacccagggaaucaguacagcuggccugcagguagauuuucacccauucgagggggccguguguuuugcaaaaguuguugagagcuuagauuuuccauugcuucauuuucuaaguggaagccacugaacugcuucacguuuuauugagaauuccaaacauccuagaaaaaaaaugccaagcaccauauacauauaguaugugucuucagauauuaacuuuaaaaucuccuuuuuagguccuucaaaggggccugauacuuggagagaguggaguucugauggaaaaaauuuaauaaucuauuggaagguaaauaucuaauuuuucugugaacauuuacauuacuuugcuaaacugcuuaacuuacgcaugguacuuggguuaucaaggagcugaaacuucccagacuggcuuuuguugcaauauuggugagaaucuaaccugguuccuaaaccccccaaauuccucgucacuccuaacuccccacagucauuugaggaucuccugugucagaucugagccuucucgaguuugaucuuauaaggccuguaaaggaccugaagauuucaugaauuccaucucccucacuucagucaaaaucuguagguuagaauccuaaguguuuguuauauuuuuuucuauuaauaggaaaguaaauuuuuauauacuucauguguaauuuauuucccuucaauaaauugcauuauaacaugccaguuauaaaguuuuguaugauuuuguaaaguauuuagaugaaauaugaauugcauauuuuacuaauuuuucucugcuggaacauuuuuuguugccauauuuuuaaguauuuuaugaauaucaaaaacaugaacaauuguuuucuauauuagauuuuacacaagcagucauaauaggauuccuuuaaauagugaauuuuguuauggaaaguaaaacauaauuuuauuuaaaaaaacuuuugacgucgauacagcuuugaguaaagugaaguguacaugcagguucaaugugaguuccauugcuuugagauuguauuugacuguuacauccacucuugauuagaaaaucccccagcuacucucaguugccugucagauuucaugauaauauagcaacgauuauacaauuuacuucaauauacgaaaguuugaaauauuguucaaacuagacgaaaacuuaagacuaaaaacauugaaaugauuuagauucuagcuucauuaucuaugcugauggugccgccauuugccaagucagaguguguucggguagaaauuauguaguuuuggucauagugaguuuucaaaagguaugccacugggauaucaugaguagaguucaguaggcgguuugauauauguaaggcucuggagcucaggggagagguuggcacugaaaacagcuuugaguagcauauaaaugggaucacuuggagaugcaaggugaaaagugggccagggauggagcccaggugacagcagcaugcauagaaccagcagaggaggaggaaccagcagaggagauggggaagguuuagaggggcaggaacaacgaagaaaauagaauuagagaagcugggggaggaggacauuucaaacaguguguggucuggaguaucccaagaagcccauaagucuuaggacuaaagccugccccuuagagcaggccauuuggagcaucacagagaccucugcuggagcagaguguuucgcaguguuagaucauccucagucuugaccagagagccccauacauugguguauaaauuaaggcaguuguuaugaaaagcaguucaguauaaaugaagagguuugaauguucauuuguuuuuauacaguaaguucacuuuuagaaauucauauuaaaaauuucuaugaaaaagaaaaaaaguggcacaaaaaaguucaccaaaauauuuguuuuaguauugugaaaaauuagaaacaacuuaaauuucauuuauuuaagggauauucaaguacacugguaaaaaugcuacauaagacauaaaaccaugaaaauguauauaacuguauuauggacaagcguauauuagcauauauuauggaaaaguaaaaaguaaaaugguguaauaugauuaaaacaauguuaguaaaaaaaucuauaccuagaaaaacaacuugaaagaaauaucaaaaugaaagaauacuuaagaggugggaauaugggagauuuuuacuuguuucaacuucuauauauuuuccaaauuuucuguagugggcauguaauacuuuaaaaugagaaaacaaauguuuagaaaaaaacccaugaugcuauuuuuuaaaauguuuuguuuguugcuaaguagagcagugcuucuggauaguuuuaaaaguuuugcuccugaaaaauguggagauaaauauuguuuuuuauucacuuaauuuuuaaauuuuuguguacucuuacugcuuauagcaaguauaguuuuucuucagugucucuuuccugauuuacccugcucccaguggauuuuaaaucuguguuuuacacuguugagagauucauuuuugcuguuguuguuguugagacagagucucgcucuuugaaccagucuggagugcaguggcacaaacucagcucacugugaccuccaccugccagguucaagugauucucccgccucagccuccugaggugccaccaugccuggcuaauuuuuguauuuuuaguagagacaggguuucauguuugucauguuuggcaggcuggucucgaacugcugaccucaugauccgccugccucggccucccaaagugcugggauuauaggcgcacuuggccagcuucaucuuuucugauacuaccuuguaacugguuguuuuuuguuuuugagauggagucucgcucuguugcucagacuggaguacaguggcaugaucuuggcucacugcaaccuucaccuccuggcuucaagugauuguccugccucagccucccaaguagcugggauuacaggcgcucaccaccacaccugguuaauuuuaguauuuuugggagagacuggguuucaccauguuggccaggcuggucucgaacuccugacuucaagugauccaccugccucggccuaagugcuggaauuauaagcgugagucaccacgccuggccaaccuuguuauuguuaauauaguguccaguuuaaacccaauuaccuugccuagucacagucacguuuugcaggguuuuauaacaauuugucuguuuuucauagccuuuacccauuaaugaagcuaauggaaaaauacuuuccuacaauguaucguguucaucagaugaggaaacacagucccuuucugaaaucccugauccucagcacaaagcagagauacgacuugauaagaaugacuacaucaucagcguaguggcuaaaaauucugugggcucaucaccaccuuccaaaauagcgaguauggaaauuccaaauggugagugcuugagaugauuuaguauauaagaacgggaaacuaaagugagaaaugucugauguuacuugcucuuuugucaugucagccuucuucucguauaccuuguugcugcugaccuagaaggcagaaugagcagauugaugucuacaguucauugagaaagaagucauuaguauugacuugaagcaugugcacugauggauacaaucauuacuguacucaguaacuauaguggauaauauuggagaguuacagugguggauaguacuuuuaggaagaaauauuuuaagaguuuauucaaaugauauucagacgcuucuccaagacacuuccccaagacuaggaaaguuuauuuuaggucagcuaggcuguuuugcaaauuguugggcaggaaaaaaaaaaaacgcuuauuuuaauuagcaccuuuuuugauaagaaauuccuuauuaauagaaauucuuuauugauuaaaaaaagucuucuuaagguauaaauuagaucuucaauauaggccuuagaaaaacaacugugguguaguuuuuaaaauuuagugccuuucuuuaaauuuuacagauguccagugauuaauacauucuucccagcuucugccuugacaacuuugagaguuaugagcuuuaaacggccacuuccaccucuucuuccacagaccucugugcuccagucauuuucugccuacccaccuuugcucucuugccccgauaugggagcaccuuucuguaaccacagcuccuagaggaagaaaaauugguccaguuaggguccucuaaguagcuuuccaacuccaguuugaggcuguuucuuauuguuacuugacugcaucuuuguucucuuugagucagucauaggagaauuaggaggaaggaagggggaaaacaaagugcauuucagagauacaaaccccaggcagcagugcugcuggagaugcacagggguuguggcaggugcugggaggaggggcuuaauaauggcuucuucauuuuggccuggcaaaaauaacaaaauaaaaaaugaaggagacagagaugugaacauccauaagaagauaacauacugauuuagauuauauguuucauugcacucacaaugcuaggcaauagcuauguugucuuuuaauucaggaaacauaauccuaccuuuucuguguaucccuuagaaaaugguaauuuacagaacuagcaauucugucaucagcuuccagacacuuucugaaaccccagaacaaauccucauuccuugaggauuucccgaguggagggaggcucugcagccucaacucagguuuacacuguggcuuuuuaaucacguugagcaaaaaaagcuguuauguccgaaguguucucuauucucagccaaauuguugucuugcguuuaguaguaguugcuuuaugaauguacauuuuguucaaaaaacuugucuguguuuauuuuuacugaacccuuaaauauaaaucaguuauagcuauuaguuacuuucuccuguuacaguggguaaugucuguguugguuuuacugaacgcucucuguagccugugggugauuaaguacucucccauggcugcaucccgucaagggccgcucaccugcaguuugcaggcuccugagcaucuggcuccugcgacaauuacucgucuaaaaauuuauucuuagaaaccuuucuauguuuguuuuuacugaacccuuaaauacaaaucaguuauaaaaucuaccucuuuucuccuguuacggugggaaauuuucuucucccuuuugaccacacugcccuaucuucuaccccaauucuucacccccagccugggguuccacuucuuaccuaggccaagaucuggcaagacagggaaacaaaaccuugccagggccucugcgccugucuucugcccucagccuuugccccuugccccuugccccuugccccuuggugucuccuaggacgcugugcagacuucuccuucucaguguccacacuggccaucccaccucaucgccucugggugucuccacagcuuucucccuugcccccacccuaccccuggucagccagacaaccccuucagcccagcucuugggcugcagucuucguugaaagaaagagggggcuaguucuucugcuguuuccacaaguuuguugugugccuacucugcacauuguacugggccccgcuuguucucugcacgcauucauagugagugaugagaggagggcuucagacuguccacuguccccuccccagucucccucucccacccugucccagccaguguccuuagcugcguccuuccugugccuugaucuugauguccuagucccaguaugucacuaccugauccuaggcgcuuuuuaaaaacgacuuucuuugagcugcuguguuaaucuauguauacagguaagugcuacaguuguuaaaaugaaaauaacagagcaacacuucuaaucuuugcucuagguuuaucuaguuugagcacuauuuuauaauuucuucacaaugaagugauuuuucuaacucauguccauuuuuaugagauuugccuuauauuauuguuuuuaaugccaguaaaauauccuccuuucuuauugaagaugaucucaaaauagaacaaguuguugggaugggaaaggggauucuccucaccuggcauuacgaccccaacaugacuugcgacuacgucauuaagugguguaacucgucucggucggaaccaugccuuauggacuggagaaaaguucccucaaacagcacugaaacuguaauagaaucugguaagaugaauuagugucucucaauuaaguucuacaaaauauuuuuaaaaggcaacacguaagacugggugcagugaagugauucucuuuacugcuggauggguauaaauagguuugacuuuccugggaggguaguuguggcagcacauggaaggauccaaacccuuugaucugguaauuacuggucuagaaauuuauucuuagaaauaaucagagaacaacacagauuuaaucuaagaauguucaugacaguauuauugauaauugugaaaaauuaaaaacccaaauagcaaauaagggaaugaguaaaugaugguacaccuauaaaauggaauguuaaguaacauuaaaaauuauguggaaaauuaaauaaauguucaugaaaaaaaaaaacuacggaacuguagccuggucucacacaagggccuuugccuuguuugcccaggguccagguuaccaagguuagggagagacugagcacaaagaccgugaaccccuuaccacuuaacccugaugcagggcaagggggcaucggcuggacugagcgcagugugggugggaggccuugcguuccaugagccugaugcucaggagcuugugagcugccggugagugucccucuaugggaugcagccugagaaguuuuuccacagaggaguguuuaauaaccuacaggcuaauccagccuuguccuuaggaauuagagcccucucugcaauaucaucguuguuuuccuggcacaaugggaguguauccugccuguccccaugggauuucuggacccuguagcuugucaguagugaugcuucgugaucauuccugucuccugccucccucgcguguuagggaagugcagaagagcaagcagccugcuccuuaccucucucucagggaacacuuucuacuugcuuacuguuucucucucagaugaugaggaugggucccauucauuggauuaucauguaugaguucagauuauuuuccaguucuacuuggaauacagccaaacuccuccacauguauaauuggcugaagugguaaugaucuuccugaguuguucccuuuauccuuccuuacagugcacuguacuuaucaaggacccagccacaugcuacccuucuuuuccugcaccuucccuuccauccccucccauguugcugaaugagccuuacacgauuccagucuguccuuucucaccugagcuuuuagaauaaucaggauggacugggauaggcuggaguggauauaaauggaguaucuacccauuuaaguuuuagcugagaccugcaggauauggggaagcugccccgcgaugauugugggaagagaacuuucugugccaacucaauugaacaaagacacaaagcuugagaaaacaaaaacucagagaaguuaggugccuuuuccaaggucacaaaauuaguaugugauagaacccagguucaaauucagaguuauucagagcuucaagaggcugggaauauugucuuuuauuuacugcugagcuucuggaacagcaaguggcacauaguaggcacaccuuuuauuccucucucauccuguucucuacucauuaagcuguccacucucuuuuuugaccuuagcacauuccuaaugcucuaaccuucucagccucuuuuuuuaaagugucagagcccuauaaaauauuguuaauaaauaauuuuaacauaaaaagagguacagauuuacagauguacaugcaguauaaaaugauaaccucaagcauaccuuucuccaaagaaaaauguuacaaaacuaaacacaguuggcugagcuugaguugcauuacugcauacuuaggacgugccagcacauaacaaacguuuaaggaaagugauuacaagaagaaaaguuaauauuuuagacaaguugauucaguuuuucuuggguuguaugauguuagaaguugacuacugucucaaauuggagccuguaggccacugguguuuuauaggcacuugauuggagaacuaaugcuuuaaccacaccagaauaauugcauucugcaaauuaaaugcaaugccauaugcugccaauccccccugcgugucccccggcauuaucuucuuucucgaccaccacugaugagcaucuaauugcccuucaaggccuuauucagauggcccuuauuguagcuguuucugaucuuuuuagacucauuuggccccucacuuaagauuccauggcaucugauacauaccucuaauauaacacacuguuaugguuacccuuguucgucugucuuccccaccacucugcaagugucuccaugcuugacguuuugugcaugucuguguugcucacauuguacacauugcauuguauucaggagacauuuaaaagcagccuuuugaauuuaaguuaagguacuucaauuggaaguaccucuauguccuguggaguuaauucaaaguauuucuauaucuuguggaguuaacucacccaaggacacuuaauggugauguuauaaagaggaauaaacucuaagaccuaauuccuuuaacacugaagcuucaaggcagagugcaacuuuuaauucugcuucuuggaacaagaggagagagcaguggguuuguuugcuuuuuccaacucagaaauaacacuagguaaggaagggauuuauagaggcaugauguggaccucgaaugaauggcuuagugaacugacccaggaaguugauguagacuuacauuuuguucauuaaaaucaagcaguugccagcacuuugggaggccaaggugggugggucacgaggucaggaguuugagaccaaccuggccaagauggugaaacccuuucucuacuaaaaauacaaaaauuagccaggugcgguggcgggcaccuguaaucccagcuacuugggaggcugaggcaggagaaucacuugaacccgggaggcggaaguugcagugagcuaagaucaugacccugcacuccagccugggcgacaaagcaagacuccgucaaagaaaaaaaaaaaaaaaucaagcaaugaugauuucuuccuggaaaaaggaacaaaauguaagccuuaaaucaucguuguucucuucaaugcaaucccaucuuauauuacuaaacuuuuuguuaaaauagaaguaaauuuaauuuuuguuuagucaauuuucuuuugaauauuuacuagucuuuaaaauauauauguauuuuuuaauaagaaaacaucuuuaaaauuagcuuuggaaauuuuagaguauguuaugaacuugauguuucuaaaauagauauucauaguaauauauuuaugaaaguuugcugauauguucauccuauagaugaguuucgaccagguauaagauauaauuuuuuccuguauggaugcagaaaucaaggauaucaauuauuacgcuccaugauuggauauauagaagaauuggguaaguuaaauggguacuuauuuauaagagcucaaggcaacaugagaaauuauaaauuggcaacaaugguaugauugaauucuaaaaauaagauguauaauugaaggaagguaaaauaauuugauaaauuaaaaaguauuugauuacuacuuuuuucuccuccuccucuuuuuuuuuuuuuuuuuuuuuuuuuuugagagagggucuuacucugucacccaggcuggagugcaguggugagaucauggcucucuucagccucaaccuccugggcucaggugauccucccaccucagccuccuggguagcugggacuacaggugcaugccaccaugcucagcuaauuuuuuuuuuuuuuuguagagaugagguuucauuauguugcccaggcuggucucaaaauuccugggcucaaacgauccucccaccucagccuccuaaagugcugggauuacaggcaucagccacugcacugggccugcuuacucugaaaucauuuguugaauguuuacauuucacaauuuuacucguccucaggaaaauuaaaucugaacuuggaugucaaaaauauuuaauuaguacuuuuacaaguuuaaaaaacuauuaacuucuucaggacuaucaauaaagaugugaaauacaaaugaagucuaucugaauagccacugaaagauuuugcauagauugcuucccuagauauguguuugucuaaaagggauauuguaaguucuaccuuuguuccuaaaaauauuuuugucuaugguuauuaguauguaagcuucacaaaaaaagcguuugugaucaucucucucugaaaguuuaugauuaaauaaaguuuuaauuccaaguugaauuauuuuugaggcuagaaagcucaggaaacauuacuguauuacucuguauucauacacuccccuuuagcaauugacuuuuuccuuuuacagcucccauuguugcaccaaauuuuacuguugaggauacuucugcagauucgauauuaguaaaaugggaagacauuccuguggaagaacuuagaggcuuuuuaagaggauauuuguuuuacuuuggaaaaggagaaagagacacaucuaagaugaggguuuuagaaucaggugaguaaauugauagcacaaggaaaguguuucuuagaaguuucucauuaaccacaacagaaaaaaaaggaaaguccugcucaguaguuuaguacugguuuucaaaacuaucugaaagauagagaaaugaaaaggcaguaauucuaugaauauaagaguuuuaagauuuuagugugcaauaaugacauguauagucuuucagaaaucauuuaaaucauuuauucugaagccguugauuauaagccucauaggacagaaaccaucucuuauuagagcuguacauaauccauaacaaggcaucucaugaaguuuacuuccaaaaagaaaucuuuuacuuacagcaguggaggagaaaaacucaggaauccaaagaguuagcuucagauccucaguuguaauuugacaaaaaaccauuggccuauuagcgucuuagccaugcccuugauaagcuggaaaacuuaauugacuugauuggggauguauuaaaaaguacagacaauccuuggaaaucggcaaguguacauccaaagacuuuagagaauucucagauuuacaaauacaaaauuguacagauuucuggcuuuuccuuucauuauguuucugcugagaaucagauauuucuuauucauagcugcauaacacaagcauaucaucuuuucaguuugagagcuuucaugucccuggaugaccucgccucagaaagaaaucauuuuaauuauuuaaugccugucugagaaauagagaacuccaccacgguauggcagugcuggccgagcacugucucagucacucccuagaacaccugcagaaagugugugccuccccuucgguccccaaguucugcauuuccugaaccuucaugauugcuggugaaugagggacauccugaauaucaaauuccacaaacauccagagccuagugugacuugccucacaugcuuggaaauuuuacacuugaaccaguuaaaauucuagcaucuggauuuccagugagacaugguagaugggucacuaaaguuagcauaaagaaggggaaacacccccaaacucuaauaaagccacaaggagagaacagaagaggcaaaacaacacugaaaaagaagauucagaaauuuguggguggaaguggggcaaaugacuuaaaugaguggaagauugugaaaucugugugggcagucaggcauuguugagaaggaacuucuccaguaccugccagaccaggccuuggaggcugaguggugaggaucaaucuggucugaacggaggggucgauugaagaacguuccuuagaacugaagggccuaacuacaagcagauccccuucuccgcuguuucacuuaccaugguuucgcuuucugccauuucaguuaccccuggcaaaaagcagucugaaaauagaugaguucaguacaauaagauacuuuaagaaagagagagaccauauuuacguaauuuuuauuacaguauauuguuauaauuauucucugaggaaaaugggcggacuacuguauauagagccaaagaauucauuaaauacacagcaaaauaaauagaaaaaagaucuaugccaagguaugucauuaugaauuuuccaagcagcuaaugugaaagaaaugaucagagacaagcaggucaugugcaagcaaucaggaauaauaauggcaauagacagcccagcaacacuccagauacuagaagucucuucaaaauacugaaugaaaauuauuuucaaccuaaaauucgauacuccaccagucugucaaccaacgugagagagaaaugcagauauuuuguacaugcgaggcugcaaacauuuacuuuccccauguugcuuuucucaagaagcuacuagaagagugcauccuaaugaggaaaugaagugaggccgguccaggaagccacaggggagagagagcagggagcuccaggagggccucagcccugaaggcauccagucuagugcaggaggcaagggauggguggaggggagggcagagaagauguggaccugggauuuuguuguguuugaccacguggaaaaucugaguguacauuggaggauaugggaagaauuauugacugguauguagaaaaucaagcaaaugagggaaaaagcaguuauaacaaugggaaaacaagauaggaaacaugaugacaccaagcaaugugucuuagcaguaacucauauuuauauaaucauaguaauccaaacacugaauucaucaaaaguuccgauguuucuauacgaaugauguggugggggaaagggugaugguagcguaaaagagcucuaucuuuaucugcccuuauaaaguauguguagauaaggucuaauaguuaaaagucacaucucucuaaguuugcuacuuuggaauauagagauaaauacccaaagaaacuugauuacauggcuuuuacagugguuguagggggcgaggggaggagcugguagagaacugucacuuuuuguuaguaaccauuuaguacuauuuaauuuuuuaaccuguuauccugcauuauucugguuaaauuuuuaaaaauaaaauaguaguucaaaugauuccucacucuuccuuuugaaguuauaacccaaaggauuucucauuagucuuauuugagaguccccaucacacugauccuuuuucuaagugguuuggagucaucucuauugaucugcagguuugcuucaucccaucuuucacucucacucaugggaaggcucagccuaaguggcuuuugguuguggugguuuucaugcuuuuaguagcagaaaugggacuauuauugauugccugcugugugccaggcauuaugcuacagaaugugugugaaaacuucaaacagcuuaagucaugauauucuauuucaucaguagaaaaacuccacuugagagugguuuaaauaaggggcccauacgacacagcuaaugacuggcguggggguagagcuugaacaagguaguggcagcuccagaguccuuggcugggauggccucagcuagacccacuuagaagggcaguuggugagacagguguggguaaccaugcauuugaaacggguuagagauuagugcuaacauacuucauuuuaaaaauaggucguucugacauaaaaguuaagaauauuacugacauaucccagaagacacugagaauugcugaucuucaagguaaaacaaguuaccaccuggucuugcgagccuauacagaugguggagugggcccggagaagaguauguauguggugacaaaggaaaauuguaaguuucagguugcuguugaggugcuuuccauccugcaugcguaguguucuagugauucuugguuuauguaggaaccccuccccgcccuuucuaaaaaacauucacauuuuguugcaguuuuuggcugguagagggaaggguuaaaaagcuguaagauuacuucauguuuauucuugucaguuauuugaaguuauuuccaaaugaguaccuaagaaauuaaugaauuugggauacaucugaagucuagaggucuaaagucauauugaauuuaucuaacggucaacauuuaaaaauauuuugcuccagcuguuaugugauuucuaacauaucuagggaaaagugaaggagauauucuuaaaaaaauuuuuuguaaagcacaacacucaaauuugagagaagagugauggccuugacuaucuuucugcgguaaagaacuucacuucgaucauaggcuuauccucuaccccugaguuggaguucacacacagcucuuauauaaagagccaugaggauaugguucuauaaagcagugauucucaacggagagugauuuugucaccuaagagauacuuggcacugucucgugucauuuuugguugucauaacugggggauacugcugguaucuagcggugagaggccauggaugcuguuaaacuuccaguagugcaaggacugucuccccugauccucuagugaagaucugucuggccuaaaaugucacaaguaucaagauugagaaacccuacuuggaagaguuuaaguauuuguauaaaaauuaucacaauaccugaaaguuugauuuuaauaguuuuucagugucccugcagcaguuaauuuuguuuuuuuccuaaauaauuuaccaaccuaaauaccuucuaacauacaucuauucuguacuucacacuaaaaauggcgauuuuaauauuugcaauacucucguuucagcugugggauuaauuauugccauucucaucccaguggcaguggcugucauuguuggaguggugacaaguauccuuugcuaucggaaacgagaaugguaauaguucugcauuuacucuugcuguuuucuucuuaaaggcaugauuauaagauuuguaagauuaguuuauguauuaaauaaguguaucuuuuuuguuguaauaaguuaguuaaaaaauguuuuaauuagaauuaauguuggauuuaauauuaagaacaugacauauuauuuaaaggucuuaauagagucaauguguaaauuuuuucuacuauuuuuccuaauaauuuaaagucauagcaguuacuauuauaaaaaauauuuauaggcugaaauauggcaauagcuaucuacaagauuaagcauaauuuaaugauuaagaucucacuugcccuggugaccuauuuagaaaaucuggucauuuuaaucauuugcucauuuauucaacaaauaugaaugaccucuuccaugugaagggggauaucauaucguggugcacaaaacaagccauggcucuuauagacuuggagcacagugugggaagagggacaguaaaccauaggcauccagcaagugugugcuugcagagugugagugggugcuaggaagacugaaccagguacccugaggagaccagcagggggcuacguccugcgagcuggucggccauggcccgucacggcuggucugcgguacaguuccaaaggguaaggagagggaaaagaauguuacagacagauaauuauuucuuugagggcccugaaauuggaaagagucaaaccuucagagaaagugggaggagcugugugccuggugaaacaggaaugagugacaugaggugaggucagcgggagcuccgugggagagagggccaugugcauggucaccuggcaagagcuguccuggcuggguauggagccaguggcugcauucaugcuuagaccaguccucaccgaccuuaaaaaugccaucauuuaugacaagagaacauauuuuagcaauccuggcuuauaaaucaaaauaguaauaguuguagaacuauagaauagucuauuuugguaaccauauucucauuaccaaaauucacauuuuuaaaacaacuauuaggccgggugcaguggcucacgccuguaaucccaacacucugggaggccaaggcaggcagaucacaaggucaggagaucgagaccauccuggccaacauggugaaacccugucucuacuaaaaauacaaaaaauuagcugagcauaguggcacgugccuguaaucccagcuacuuaggaggcuaggaggcugaggcaggagaaucacuugaaccagggaguuggagguugcagugagucaagauugcaccacugcaccccacccuagcaacagugcaagacucugucucaaaaaaaccaaaaaaacaaaaaaaacccaacuauuaaaguaccaaaaaaagaaaaaaaagacaaaauaagaagggaguuuagaaguuacagcguuucaaacucacauuaacaaaguuauuuuuucuguaggaauuucaaguaauacaguucuuuuuaguagcuauaaauauaaaaauaugauaggacacugagcaaaucucauuuuugguugcguuuaguuuucggucaagauuaauagccuuuuucuuagcacagccugcaguguacucgugacacguggcuaucacuuuuaugaccaccucgguaaaggcaaaucucauuuuuggcugcauuuaguuuuuggucaagauuaauagccuuuuucuuagcacagccugcaguguacucaugacauguaguuaucaccuuuaugaccaccuuuuuaaccaccucaguaaagcagugccaugggaucacagcuguucuuacauaguccagauccuuuggacuagauggcacagccacaauuuuaauuacuugcuuuccauuuucaugagauacauggguauuauaguuccagaaauggaauucuguuuaugguuuucaaguuggaaccucucagugcauuguauagacagcuguagugaaugaucacacuaaagaucuuccauuuuaaucucagaugugcauuaaaggauucauaaauacuucaaaauaagccuaaugauuuauuaauuuauuaucuaauaaucuuaaaacuauuaaauuuacuguaauaauuuuuuauuuaaaggauuaaagaaaccuucuacccugauauuccaaauccagaaaacuguaaagcauuacaguuucaaaagagugucugugagguaaucuuuuauuuucuuauauuuaucuuugaugugcuggcuucuuuuuuuaaucuuuugugaaaaguuuuuaacaugcaaaugucauuuuaauuaaaaaguauugggaaaauuauauacuuuaaaacaucucaguuucuaaaauuauuaauuuuaaauuauacagugcucuuuuuucucccacaaguauuaauaacaaggaaaauacugauacggaagaaaaaaguggcugugcuguugugugaaauacagaguaguagagacaccuguuuacaagcagauuggggaaaaaugugucccuuuuuauaggaggagcauugcaauggcauuuagugcuauuuuuaaucacuguguuuaaauuuauuucuagggaagcagugcucuuaaaacauuggaaaugaauccuuguaccccaaauaauguugagguucuggaaacucgaucagcauuuccuaaaauagaagauacagaaauaauuuccccaguagcugagcguccugaagaucgcucugaugcagagccugaaaaccaugugguuguguccuauuguccacccaucauugaggaagaaauaccaaacccagccgcagaugaagcuggagggacugcacagguuauuuacauugauguucagucgauguaucagccucaagcaaaaccagaagaagaacaagaaaaugacccuguaggaggggcaggcuauaagccacagaugcaccuccccauuaauucuacuguggaagauauagcugcagaagaggacuuagauaaaacugcggguuacagaccucaggccaauguaaauacauggaauuuagugucuccagacucuccuagauccauagacagcaacagugagauugucucauuuggaaguccaugcuccauuaauucccgacaauuuuugauuccuccuaaagaugaagacucuccuaaaucuaauggaggagggugguccuuuacaaacuuuuuucagaacaaaccaaacgauuaacagugucaccgugucacuucagucagccaucucaauaagcucuuacugcuaguguugcuacaucagcacugggcauucuuggagggauccugugaaguauuguuaggaggugaacuucacuacauguuaaguuacacugaaaguguucaugugcuuuuaauguagucuaaaagccaaaguauagugacucagaauccucaauccacaaaacucaagauugggagcucuuugugaucaagccaaagaauucucauguacucuaccuucaagaagcauuucaaggcuaauaccuacuuguacguacauguaaaacaaaucccgccgcaacuguuuucuguucuguuguuugugguuuucucauguguauacuugguggaauuguaaguggauuugcaggccagggagaaaauguccaaguaacaggugaaguuuauuugccugacguuuacuccuuucuagaugaaaaccaagcacagauuuuaaaacuucuaagauuauucuccucuauccacagcauucacaaaaauuaauauaauuuuuaauguagugacagcgauuuaguguuuuguuugauaaaguaugcuuauuucugugccuacugua

SEQ ID NO: 17727 - RNA, 114410 nt, Homo sapiens
uacaguaggcacagaaauaagcauacuuuaucaaacaaaacacuaaaucgcugucacuacauuaaaaauuauauuaauuuuugugaaugcuguggauagaggagaauaaucuuagaaguuuuaaaaucugugcuugguuuucaucuagaaaggaguaaacgucaggcaaauaaacuucaccuguuacuuggacauuuucucccuggccugcaaauccacuuacaauuccaccaaguauacacaugagaaaaccacaaacaacagaacagaaaacaguugcggcgggauuuguuuuacauguacguacaaguagguauuagccuugaaaugcuucuugaagguagaguacaugagaauucuuuggcuugaucacaaagagcucccaaucuugaguuuuguggauugaggauucugagucacuauacuuuggcuuuuagacuacauuaaaagcacaugaacacuuucaguguaacuuaacauguagugaaguucaccuccuaacaauacuucacaggaucccuccaagaaugcccagugcugauguagcaacacuagcaguaagagcuuauugagauggcugacugaagugacacggugacacuguuaaucguuugguuuguucugaaaaaaguuuguaaaggaccacccuccuccauuagauuuaggagagucuucaucuuuaggaggaaucaaaaauugucgggaauuaauggagcauggacuuccaaaugagacaaucucacuguugcugucuauggaucuaggagagucuggagacacuaaauuccauguauuuacauuggccugaggucuguaacccgcaguuuuaucuaaguccucuucugcagcuauaucuuccacaguagaauuaauggggaggugcaucuguggcuuauagccugccccuccuacagggucauuuucuuguucuucuucugguuuugcuugaggcugauacaucgacugaacaucaauguaaauaaccugugcagucccuccagcuucaucugcggcuggguuugguauuucuuccucaaugauggguggacaauaggacacaaccacaugguuuucaggcucugcaucagagcgaucuucaggacgcucagcuacuggggaaauuauuucuguaucuucuauuuuaggaaaugcugaucgaguuuccagaaccucaacauuauuugggguacaaggauucauuuccaauguuuuaagagcacugcuucccuagaaauaaauuuaaacacagugauuaaaaauagcacuaaaugccauugcaaugcuccuccuauaaaaagggacacauuuuuccccaaucugcuuguaaacaggugucucuacuacucuguauuucacacaacagcacagccacuuuuuucuuccguaucaguauuuuccuuguuauuaauacuugugggagaaaaaagagcacuguauaauuuaaaauuaauaauuuuagaaacugagauguuuuaaaguauauaauuuucccaauacuuuuuaauuaaaaugacauuugcauguuaaaaacuuuucacaaaagauuaaaaaaagaagccagcacaucaaagauaaauauaagaaaauaaaagauuaccucacagacacucuuuugaaacuguaaugcuuuacaguuuucuggauuuggaauaucaggguagaagguuucuuuaauccuuuaaauaaaaaauuauuacaguaaauuuaauaguuuuaagauuauuagauaauaaauuaauaaaucauuaggcuuauuuugaaguauuuaugaauccuuuaaugcacaucugagauuaaaauggaagaucuuuagugugaucauucacuacagcugucuauacaaugcacugagagguuccaacuugaaaaccauaaacagaauuccauuucuggaacuauaauacccauguaucucaugaaaauggaaagcaaguaauuaaaauuguggcugugccaucuaguccaaaggaucuggacuauguaagaacagcugugaucccauggcacugcuuuacugaggugguuaaaaagguggucauaaaggugauaacuacaugucaugaguacacugcaggcugugcuaagaaaaaggcuauuaaucuugaccaaaaacuaaaugcagccaaaaaugagauuugccuuuaccgagguggucauaaaagugauagccacgugucacgaguacacugcaggcugugcuaagaaaaaggcuauuaaucuugaccgaaaacuaaacgcaaccaaaaaugagauuugcucaguguccuaucauauuuuuauauuuauagcuacuaaaaagaacuguauuacuugaaauuccuacagaaaaaauaacuuuguuaaugugaguuugaaacgcuguaacuucuaaacucccuucuuauuuugucuuuuuuuucuuuuuuugguacuuuaauaguuggguuuuuuuuguuuuuuugguuuuuuugagacagagucuugcacuguugcuaggguggggugcaguggugcaaucuugacucacugcaaccuccaacucccugguucaagugauucuccugccucagccuccuagccuccuaaguagcugggauuacaggcacgugccacuaugcucagcuaauuuuuuguauuuuuaguagagacaggguuucaccauguuggccaggauggucucgaucuccugaccuugugaucugccugccuuggccucccagaguguugggauuacaggcgugagccacugcacccggccuaauaguuguuuuaaaaaugugaauuuugguaaugagaauaugguuaccaaaauagacuauucuauaguucuacaacuauuacuauuuugauuuauaagccaggauugcuaaaauauguucucuugucauaaaugauggcauuuuuaaggucggugaggacuggucuaagcaugaaugcagccacuggcuccauacccagccaggacagcucuugccaggugaccaugcacauggcccucucucccacggagcucccgcugaccucaccucaugucacucauuccuguuucaccaggcacacagcuccucccacuuucucugaagguuugacucuuuccaauuucagggcccucaaagaaauaauuaucugucuguaacauucuuuucccucuccuuacccuuuggaacuguaccgcagaccagccgugacgggccauggccgaccagcucgcaggacguagcccccugcuggucuccucaggguaccugguucagucuuccuagcacccacucacacucugcaagcacacacuugcuggaugccuaugguuuacugucccucuucccacacugugcuccaagucuauaagagccauggcuuguuuugugcaccacgauaugauaucccccuucacauggaagaggucauucauauuuguugaauaaaugagcaaaugauuaaaaugaccagauuuucuaaauaggucaccagggcaagugagaucuuaaucauuaaauuaugcuuaaucuuguagauagcuauugccauauuucagccuauaaauauuuuuuauaauaguaacugcuaugacuuuaaauuauuaggaaaaauaguagaaaaaauuuacacauugacucuauuaagaccuuuaaauaauaugucauguucuuaauauuaaauccaacauuaauucuaauuaaaacauuuuuuaacuaacuuauuacaacaaaaaagauacacuuauuuaauacauaaacuaaucuuacaaaucuuauaaucaugccuuuaagaagaaaacagcaagaguaaaugcagaacuauuaccauucucguuuccgauagcaaaggauacuugucaccacuccaacaaugacagccacugccacugggaugagaauggcaauaauuaaucccacagcugaaacgagaguauugcaaauauuaaaaucgccauuuuuagugugaaguacagaauagauguauguuagaagguauuuagguugguaaauuauuuaggaaaaaaacaaaauuaacugcugcagggacacugaaaaacuauuaaaaucaaacuuucagguauugugauaauuuuuauacaaauacuuaaacucuuccaaguaggguuucucaaucuugauacuugugacauuuuaggccagacagaucuucacuagaggaucaggggagacaguccuugcacuacuggaaguuuaacagcauccauggccucucaccgcuagauaccagcaguaucccccaguuaugacaaccaaaaaugacacgagacagugccaaguaucucuuaggugacaaaaucacucuccguugagaaucacugcuuuauagaaccauauccucauggcucuuuauauaagagcugugugugaacuccaacucagggguagaggauaagccuaugaucgaagugaaguucuuuaccgcagaaagauagucaaggccaucacucuucucucaaauuugaguguugugcuuuacaaaaaauuuuuuuaagaauaucuccuucacuuuucccuagauauguuagaaaucacauaacagcuggagcaaaauauuuuuaaauguugaccguuagauaaauucaauaugacuuuagaccucuagacuucagauguaucccaaauucauuaauuucuuagguacucauuuggaaauaacuucaaauaacugacaagaauaaacaugaaguaaucuuacagcuuuuuaacccuucccucuaccagccaaaaacugcaacaaaaugugaauguuuuuuagaaagggcggggagggguuccuacauaaaccaagaaucacuagaacacuacgcaugcaggauggaaagcaccucaacagcaaccugaaacuuacaauuuuccuuugucaccacauacauacucuucuccgggcccacuccaccaucuguauaggcucgcaagaccaggugguaacuuguuuuaccuugaagaucagcaauucucagugucuucugggauaugucaguaauauucuuaacuuuuaugucagaacgaccuauuuuuaaaaugaaguauguuagcacuaaucucuaacccguuucaaaugcaugguuacccacaccugucucaccaacugcccuucuaagugggucuagcugaggccaucccagccaaggacucuggagcugccacuaccuuguucaagcucuacccccacgccagucauuagcugugucguaugggccccuuauuuaaaccacucucaaguggaguuuuucuacugaugaaauagaauaucaugacuuaagcuguuugaaguuuucacacacauucuguagcauaaugccuggcacacagcaggcaaucaauaauagucccauuucugcuacuaaaagcaugaaaaccaccacaaccaaaagccacuuaggcugagccuucccaugagugagagugaaagaugggaugaagcaaaccugcagaucaauagagaugacuccaaaccacuuagaaaaaggaucagugugauggggacucucaaauaagacuaaugagaaauccuuuggguuauaacuucaaaaggaagagugaggaaucauuugaacuacuauuuuauuuuuaaaaauuuaaccagaauaaugcaggauaacagguuaaaaaauuaaauaguacuaaaugguuacuaacaaaaagugacaguucucuaccagcuccuccccucgcccccuacaaccacuguaaaagccauguaaucaaguuucuuuggguauuuaucucuauauuccaaaguagcaaacuuagagagaugugacuuuuaacuauuagaccuuaucuacacauacuuuauaagggcagauaaagauagagcucuuuuacgcuaccaucacccuuucccccaccacaucauucguauagaaacaucggaacuuuugaugaauucaguguuuggauuacuaugauuauauaaauaugaguuacugcuaagacacauugcuuggugucaucauguuuccuaucuuguuuucccauuguuauaacugcuuuuucccucauuugcuugauuuucuacauaccagucaauaauucuucccauauccuccaauguacacucagauuuuccacguggucaaacacaacaaaaucccagguccacaucuucucugcccuccccuccacccaucccuugccuccugcacuagacuggaugccuucagggcugaggcccuccuggagcucccugcucucucuccccuguggcuuccuggaccggccucacuucauuuccucauuaggaugcacucuucuaguagcuucuugagaaaagcaacauggggaaaguaaauguuugcagccucgcauguacaaaauaucugcauuucucucucacguugguugacagacugguggaguaucgaauuuuagguugaaaauaauuuucauucaguauuuugaagagacuucuaguaucuggaguguugcugggcugucuauugccauuauuauuccugauugcuugcacaugaccugcuugucucugaucauuucuuucacauuagcugcuuggaaaauucauaaugacauaccuuggcauagaucuuuuuucuauuuauuuugcuguguauuuaaugaauucuuuggcucuauauacaguaguccgcccauuuuccucagagaauaauuauaacaauauacuguaauaaaaauuacguaaauauggucucucucuuucuuaaaguaucuuauuguacugaacucaucuauuuucagacugcuuuuugccagggguaacugaaauggcagaaagcgaaaccaugguaagugaaacagcggagaaggggaucugcuuguaguuaggcccuucaguucuaaggaacguucuucaaucgaccccuccguucagaccagauugauccucaccacucagccuccaaggccuggucuggcagguacuggagaaguuccuucucaacaaugccugacugcccacacagauuucacaaucuuccacucauuuaagucauuugccccacuuccacccacaaauuucugaaucuucuuuuucaguguuguuuugccucuucuguucucuccuuguggcuuuauuagaguuuggggguguuuccccuucuuuaugcuaacuuuagugacccaucuaccaugucucacuggaaauccagaugcuagaauuuuaacugguucaaguguaaaauuuccaagcaugugaggcaagucacacuaggcucuggauguuuguggaauuugauauucaggaugucccucauucaccagcaaucaugaagguucaggaaaugcagaacuuggggaccgaaggggaggcacacacuuucugcagguguucuagggagugacugagacagugcucggccagcacugccauaccgugguggaguucucuauuucucagacaggcauuaaauaauuaaaaugauuucuuucugaggcgaggucauccagggacaugaaagcucucaaacugaaaagaugauaugcuuguguuaugcagcuaugaauaagaaauaucugauucucagcagaaacauaaugaaaggaaaagccagaaaucuguacaauuuuguauuuguaaaucugagaauucucuaaagucuuuggauguacacuugccgauuuccaaggauugucuguacuuuuuaauacauccccaaucaagucaauuaaguuuuccagcuuaucaagggcauggcuaagacgcuaauaggccaaugguuuuuugucaaauuacaacugaggaucugaagcuaacucuuuggauuccugaguuuuucuccuccacugcuguaaguaaaagauuucuuuuuggaaguaaacuucaugagaugccuuguuauggauuauguacagcucuaauaagagaugguuucuguccuaugaggcuuauaaucaacggcuucagaauaaaugauuuaaaugauuucugaaagacuauacaugucauuauugcacacuaaaaucuuaaaacucuuauauucauagaauuacugccuuuucauuucucuaucuuucagauaguuuugaaaaccaguacuaaacuacugagcaggacuuuccuuuuuuuucuguugugguuaaugagaaacuucuaagaaacacuuuccuugugcuaucaauuuacucaccugauucuaaaacccucaucuuagaugugucucuuucuccuuuuccaaaguaaaacaaauauccucuuaaaaagccucuaaguucuuccacaggaaugucuucccauuuuacuaauaucgaaucugcagaaguauccucaacaguaaaauuuggugcaacaaugggagcuguaaaaggaaaaagucaauugcuaaaggggaguguaugaauacagaguaauacaguaauguuuccugagcuuucuagccucaaaaauaauucaacuuggaauuaaaacuuuauuuaaucauaaacuuucagagagagaugaucacaaacgcuuuuuuugugaagcuuacauacuaauaaccauagacaaaaauauuuuuaggaacaaagguagaacuuacaauaucccuuuuagacaaacacauaucuagggaagcaaucuaugcaaaaucuuucaguggcuauucagauagacuucauuuguauuucacaucuuuauugauaguccugaagaaguuaauaguuuuuuaaacuuguaaaaguacuaauuaaauauuuuugacauccaaguucagauuuaauuuuccugaggacgaguaaaauugugaaauguaaacauucaacaaaugauuucagaguaagcaggcccagugcaguggcugaugccuguaaucccagcacuuuaggaggcugaggugggaggaucguuugagcccaggaauuuugagaccagccugggcaacauaaugaaaccucaucucuacaaaaaaaaaaaaaaauuagcugagcaugguggcaugcaccuguagucccagcuacccaggaggcugaggugggaggaucaccugagcccaggagguugaggcugaagagagccaugaucucaccacugcacuccagccugggugacagaguaagacccucucucaaaaaaaaaaaaaaaaaaaaaaaaaaagaggaggaggagaaaaaaguaguaaucaaauacuuuuuaauuuaucaaauuauuuuaccuuccuucaauuauacaucuuauuuuuagaauucaaucauaccauuguugccaauuuauaauuucucauguugccuugagcucuuauaaauaaguacccauuuaacuuacccaauucuucuauauauccaaucauggagcguaauaauugauauccuugauuucugcauccauacaggaaaaaauuauaucuuauaccuggucgaaacucaucuauaggaugaacauaucagcaaacuuucauaaauauauuacuaugaauaucuauuuuagaaacaucaaguucauaacauacucuaaaauuuccaaagcuaauuuuaaagauguuuucuuauuaaaaaauacauauauauuuuaaagacuaguaaauauucaaaagaaaauugacuaaacaaaaauuaaauuuacuucuauuuuaacaaaaaguuuaguaauauaagaugggauugcauugaagagaacaacgaugauuuaaggcuuacauuuuguuccuuuuuccaggaagaaaucaucauugcuugauuuuuuuuuuuuuuucuuugacggagucuugcuuugucgcccaggcuggagugcagggucaugaucuuagcucacugcaacuuccgccucccggguucaagugauucuccugccucagccucccaaguagcugggauuacaggugcccgccaccgcaccuggcuaauuuuuguauuuuuaguagagaaaggguuucaccaucuuggccagguuggucucaaacuccugaccucgugacccacccaccuuggccucccaaagugcuggcaacugcuugauuuuaaugaacaaaauguaagucuacaucaacuuccugggucaguucacuaagccauucauucgagguccacaucaugccucuauaaaucccuuccuuaccuaguguuauuucugaguuggaaaaagcaaacaaacccacugcucucuccucuuguuccaagaagcagaauuaaaaguugcacucugccuugaagcuucaguguuaaaggaauuaggucuuagaguuuauuccucuuuauaacaucaccauuaaguguccuugggugaguuaacuccacaagauauagaaauacuuugaauuaacuccacaggacauagagguacuuccaauugaaguaccuuaacuuaaauucaaaaggcugcuuuuaaaugucuccugaauacaaugcaauguguacaaugugagcaacacagacaugcacaaaacgucaagcauggagacacuugcagagugguggggaagacagacgaacaaggguaaccauaacaguguguuauauuagagguauguaucagaugccauggaaucuuaagugaggggccaaaugagucuaaaaagaucagaaacagcuacaauaagggccaucugaauaaggccuugaagggcaauuagaugcucaucagugguggucgagaaagaagauaaugccgggggacacgcaggggggauuggcagcauauggcauugcauuuaauuugcagaaugcaauuauucuggugugguuaaagcauuaguucuccaaucaagugccuauaaaacaccaguggccuacaggcuccaauuugagacaguagucaacuucuaacaucauacaacccaagaaaaacugaaucaacuugucuaaaauauuaacuuuucuucuuguaaucacuuuccuuaaacguuuguuaugugcuggcacguccuaaguaugcaguaaugcaacucaagcucagccaacuguguuuaguuuuguaacauuuuucuuuggagaaagguaugcuugagguuaucauuuuauacugcauguacaucuguaaaucuguaccucuuuuuauguuaaaauuauuuauuaacaauauuuuauagggcucugacacuuuaaaaaaagaggcugagaagguuagagcauuaggaaugugcuaaggucaaaaaagagaguggacagcuuaaugaguagagaacaggaugagagaggaauaaaaggugugccuacuaugugccacuugcuguuccagaagcucagcaguaaauaaaagacaauauucccagccucuugaagcucugaauaacucugaauuugaaccuggguucuaucacauacuaauuuugugaccuuggaaaaggcaccuaacuucucugaguuuuuguuuucucaagcuuugugucuuuguucaauugaguuggcacagaaaguucucuucccacaaucaucgcggggcagcuuccccauauccugcaggucucagcuaaaacuuaaauggguagauacuccauuuauauccacuccagccuaucccaguccauccugauuauucuaaaagcucaggugagaaaggacagacuggaaucguguaaggcucauucagcaacaugggaggggauggaagggaaggugcaggaaaagaaggguagcauguggcuggguccuugauaaguacagugcacuguaaggaaggauaaagggaacaacucaggaagaucauuaccacuucagccaauuauacauguggaggaguuuggcuguauuccaaguagaacuggaaaauaaucugaacucauacaugauaauccaaugaaugggacccauccucaucaucugagagagaaacaguaagcaaguagaaaguguucccugagagagagguaaggagcaggcugcuugcucuucugcacuucccuaacacgcgagggaggcaggagacaggaaugaucacgaagcaucacuacugacaagcuacaggguccagaaaucccauggggacaggcaggauacacucccauugugccaggaaaacaacgaugauauugcagagagggcucuaauuccuaaggacaaggcuggauuagccuguagguuauuaaacacuccucuguggaaaaacuucucaggcugcaucccauagagggacacucaccggcagcucacaagcuccugagcaucaggcucauggaacgcaaggccucccacccacacugcgcucaguccagccgaugcccccuugcccugcaucaggguuaagugguaagggguucacggucuuugugcucagucucucccuaaccuugguaaccuggacccugggcaaacaaggcaaaggcccuugugugagaccaggcuacaguuccguaguuuuuuuuuuucaugaacauuuauuuaauuuuccacauaauuuuuaauguuacuuaacauuccauuuuauagguguaccaucauuuacucauucccuuauuugcuauuuggguuuuuaauuuuucacaauuaucaauaauacugucaugaacauucuuagauuaaaucuguguuguucucugauuauuucuaagaauaaauuucuagaccaguaauuaccagaucaaaggguuuggauccuuccaugugcugccacaacuacccucccaggaaagucaaaccuauuuauacccauccagcaguaaagagaaucacuucacugcacccagucuuacguguugccuuuuaaaaauauuuuguagaacuuaauugagagacacuaauucaucuuaccagauucuauuacaguuucagugcuguuugagggaacuuuucuccaguccauaaggcaugguuccgaccgagacgaguuacaccacuuaaugacguagucgcaagucauguuggggucguaaugccaggugaggagaauccccuuucccaucccaacaacuuguucuauuuugagaucaucuucaauaagaaaggaggauauuuuacuggcauuaaaaacaauaauauaaggcaaaucucauaaaaauggacaugaguuagaaaaaucacuucauugugaagaaauuauaaaauagugcucaaacuagauaaaccuagagcaaagauuagaaguguugcucuguuauuuucauuuuaacaacuguagcacuuaccuguauacauagauuaacacagcagcucaaagaaagucguuuuuaaaaagcgccuaggaucagguagugacauacugggacuaggacaucaagaucaaggcacaggaaggacgcagcuaaggacacuggcugggacagggugggagagggagacuggggaggggacaguggacagucugaagcccuccucucaucacucacuaugaaugcgugcagagaacaagcggggcccaguacaaugugcagaguaggcacacaacaaacuuguggaaacagcagaagaacuagcccccucuuucuuucaacgaagacugcagcccaagagcugggcugaagggguugucuggcugaccagggguagggugggggcaagggagaaagcuguggagacacccagaggcgaugaggugggauggccaguguggacacugagaaggagaagucugcacagcguccuaggagacaccaaggggcaaggggcaaggggcaaggggcaaaggcugagggcagaagacaggcgcagaggcccuggcaagguuuuguuucccugucuugccagaucuuggccuagguaagaaguggaaccccaggcugggggugaagaauugggguagaagauagggcaguguggucaaaagggagaagaaaauuucccaccguaacaggagaaaagagguagauuuuauaacugauuuguauuuaaggguucaguaaaaacaaacauagaaagguuucuaagaauaaauuuuuagacgaguaauugucgcaggagccagaugcucaggagccugcaaacugcaggugagcggcccuugacgggaugcagccaugggagaguacuuaaucacccacaggcuacagagagcguucaguaaaaccaacacagacauuacccacuguaacaggagaaaguaacuaauagcuauaacugauuuauauuuaaggguucaguaaaaauaaacacagacaaguuuuuugaacaaaauguacauucauaaagcaacuacuacuaaacgcaagacaacaauuuggcugagaauagagaacacuucggacauaacagcuuuuuuugcucaacgugauuaaaaagccacaguguaaaccugaguugaggcugcagagccucccuccacucgggaaauccucaaggaaugaggauuuguucugggguuucagaaagugucuggaagcugaugacagaauugcuaguucuguaaauuaccauuuucuaagggauacacagaaaagguaggauuauguuuccugaauuaaaagacaacauagcuauugccuagcauugugagugcaaugaaacauauaaucuaaaucaguauguuaucuucuuauggauguucacaucucugucuccuucauuuuuuauuuuguuauuuuugccaggccaaaaugaagaagccauuauuaagccccuccucccagcaccugccacaaccccugugcaucuccagcagcacugcugccugggguuuguaucucugaaaugcacuuuguuuucccccuuccuuccuccuaauucuccuaugacugacucaaagagaacaaagaugcagucaaguaacaauaagaaacagccucaaacuggaguuggaaagcuacuuagaggacccuaacuggaccaauuuuucuuccucuaggagcugugguuacagaaaggugcucccauaucggggcaagagagcaaagguggguaggcagaaaaugacuggagcacagaggucuguggaagaagagguggaaguggccguuuaaagcucauaacucucaaaguugucaaggcagaagcugggaagaauguauuaaucacuggacaucuguaaaauuuaaagaaaggcacuaaauuuuaaaaacuacaccacaguuguuuuucuaaggccuauauugaagaucuaauuuauaccuuaagaagacuuuuuuuaaucaauaaagaauuucuauuaauaaggaauuucuuaucaaaaaaggugcuaauuaaaauaagcguuuuuuuuuuuuccugcccaacaauuugcaaaacagccuagcugaccuaaaauaaacuuuccuagucuuggggaagugucuuggagaagcgucugaauaucauuugaauaaacucuuaaaauauuucuuccuaaaaguacuauccaccacuguaacucuccaauauuauccacuauaguuacugaguacaguaaugauuguauccaucagugcacaugcuucaagucaauacuaaugacuucuuucucaaugaacuguagacaucaaucugcucauucugccuucuaggucagcagcaacaagguauacgagaagaaggcugacaugacaaaagagcaaguaacaucagacauuucucacuuuaguuucccguucuuauauacuaaaucaucucaagcacucaccauuuggaauuuccauacucgcuauuuuggaagguggugaugagcccacagaauuuuuagccacuacgcugaugauguagucauucuuaucaagucguaucucugcuuugugcugaggaucagggauuucagaaagggacuguguuuccucaucugaugaacacgauacauuguaggaaaguauuuuuccauuagcuucauuaauggguaaaggcuaugaaaaacagacaaauuguuauaaaacccugcaaaacgugacugugacuaggcaagguaauuggguuuaaacuggacacuauauuaacaauaacaagguuggccaggcguggugacucacgcuuauaauuccagcacuuaggccgaggcagguggaucacuugaagucaggaguucgagaccagccuggccaacauggugaaacccagucucucccaaaaauacuaaaauuaaccaggugugguggugagcgccuguaaucccagcuacuugggaggcugaggcaggacaaucacuugaagccaggaggugaagguugcagugagccaagaucaugccacuguacuccagucugagcaacagagcgagacuccaucucaaaaacaaaaaacaaccaguuacaagguaguaucagaaaagaugaagcuggccaagugcgccuauaaucccagcacuuugggaggccgaggcaggcggaucaugaggucagcaguucgagaccagccugccaaacaugacaaacaugaaacccugucucuacuaaaaauacaaaaauuagccaggcaugguggcaccucaggaggcugaggcgggagaaucacuugaaccuggcagguggaggucacagugagcugaguuugugccacugcacuccagacugguucaaagagcgagacucugucucaacaacaacaacagcaaaaaugaaucucucaacaguguaaaacacagauuuaaaauccacugggagcaggguaaaucaggaaagagacacugaagaaaaacuauacuugcuauaagcaguaagaguacacaaaaauuuaaaaauuaagugaauaaaaaacaauauuuaucuccacauuuuucaggagcaaaacuuuuaaaacuauccagaagcacugcucuacuuagcaacaaacaaaacauuuuaaaaaauagcaucauggguuuuuuucuaaacauuuguuuucucauuuuaaaguauuacaugcccacuacagaaaauuuggaaaauauauagaaguugaaacaaguaaaaaucucccauauucccaccucuuaaguauucuuucauuuugauauuucuuucaaguuguuuuucuagguauagauuuuuuuacuaacauuguuuuaaucauauuacaccauuuuacuuuuuacuuuuccauaauauaugcuaauauacgcuuguccauaauacaguuauauacauuuucaugguuuuaugucuuauguagcauuuuuaccaguguacuugaauaucccuuaaauaaaugaaauuuaaguuguuucuaauuuuucacaauacuaaaacaaauauuuuggugaacuuuuuugugccacuuuuuuucuuuuucauagaaauuuuuaauaugaauuucuaaaagugaacuuacuguauaaaaacaaaugaacauucaaaccucuucauuuauacugaacugcuuuucauaacaacugccuuaauuuauacaccaauguauggggcucucuggucaagacugaggaugaucuaacacugcgaaacacucugcuccagcagaggucucugugaugcuccaaauggccugcucuaaggggcaggcuuuaguccuaagacuuaugggcuucuugggauacuccagaccacacacuguuugaaauguccuccucccccagcuucucuaauucuauuuucuucguuguuccugccccucuaaaccuuccccaucuccucugcugguuccuccuccucugcugguucuaugcaugcugcugucaccugggcuccaucccuggcccacuuuucaccuugcaucuccaagugaucccauuuauaugcuacucaaagcuguuuucagugccaaccucuccccugagcuccagagccuuacauauaucaaaccgccuacugaacucuacucaugauaucccaguggcauaccuuuugaaaacucacuaugaccaaaacuacauaauuucuacccgaacacacucugacuuggcaaauggcggcaccaucagcauagauaaugaagcuagaaucuaaaucauuucaauguuuuuagucuuaaguuuucgucuaguuugaacaauauuucaaacuuucguauauugaaguaaauuguauaaucguugcuauauuaucaugaaaucugacaggcaacugagaguagcugggggauuuucuaaucaagaguggauguaacagucaaauacaaucucaaagcaauggaacucacauugaaccugcauguacacuucacuuuacucaaagcuguaucgacgucaaaaguuuuuuuaaauaaaauuauguuuuacuuuccauaacaaaauucacuauuuaaaggaauccuauuaugacugcuuguguaaaaucuaauauagaaaacaauuguucauguuuuugauauucauaaaauacuuaaaaauauggcaacaaaaaauguuccagcagagaaaaauuaguaaaauaugcaauucauauuucaucuaaauacuuuacaaaaucauacaaaacuuuauaacuggcauguuauaaugcaauuuauugaagggaaauaaauuacacaugaaguauauaaaaauuuacuuuccuauuaauagaaaaaaauauaacaaacacuuaggauucuaaccuacagauuuugacugaagugagggagauggaauucaugaaaucuucagguccuuuacaggccuuauaagaucaaacucgagaaggcucagaucugacacaggagauccucaaaugacuguggggaguuaggagugacgaggaauuugggggguuuaggaaccagguuagauucucaccaauauugcaacaaaagccagucugggaaguuucagcuccuugauaacccaaguaccaugcguaaguuaagcaguuuagcaaaguaauguaaauguucacagaaaaauuagauauuuaccuuccaauagauuauuaaauuuuuuccaucagaacuccacucucuccaaguaucaggccccuuugaaggaccuaaaaaggagauuuuaaaguuaauaucugaagacacauacuauauguauauggugcuuggcauuuuuuuucuaggauguuuggaauucucaauaaaacgugaagcaguucaguggcuuccacuuagaaaaugaagcaauggaaaaucuaagcucucaacaacuuuugcaaaacacacggcccccucgaaugggugaaaaucuaccugcaggccagcuguacugauucccuggguuccccucugccucacauccucucacucccuccuuucuuggccacacacuggcuuccuggcugucccucagauaugccaaagacacaacugccucaggcucucugcaucuucugugcccucucuuccucugccuacaacucucuucuccuagauaaaaacaauauggcaugcuuccugaucuuuguaucucagcuugaguauuaccuuauuagugaggucuuuucuaacuacccuauuuaaaacugccauucccuucacccccuccuuaucccucagccucuauuccuaucacuuccucuccucuguggcauuugucaccagcugauaaacugaugugucugugucuuuguguuuguguguguacauacauacauauagauguguauauauauaaauuuauuucuaguccuggauccuacaaacuccauaggccgagaucucuguuuuaucugcugcuauaucacugcuaacuagaacaauuccagacacauacagguugaguaucccucauccgaaaugcuugggagcaaaaguguuucagauuuuggauuuuuucuaauuguagaauaucugcauauacauaaugaaauaucuuggaggaugggauccaagaacacauaaaauucauuuauguuucacauacaccuuauacacacagccugaagguaauuucauacaauauuuuaaauaauucugugcaugaaacaaauuuguguuaaguacuuaaguguggaauuuuccauuuguggcauccugguggugcucaaaaaguuuuggaucuuggagcauuucagguuuucagauuacguauguucaaucuguaaugcauacucaguaaauauuuguugaguaaauugaugccuucaucuuaaugaggugcaaauaagauguuuccucuuggagacaacagcucauuaacugaaggcaaaaacuacaguggcuagucuccaaaaugaccaauaauccccaugugcguggugcccucccacauugcaucaggguuggccugugugaccaacagugugcaguagacauaaugguauguuacuuccgauuuuagagcauaaaagauacuguucagucaccggcucugggaggaacuggcugccaugucaugagcacacuuaagcaggccuagagagaggcccacaaggugaggaacugaggccuccugccuuuagccacaugagugaaccaucuugaaaguggauccucuagccccagugaagccugcaguccccacccacauuccugacugcagccucaugaaagacuccaagucagagagauccagcuaagcugcuccuggauuuuuaacccauagaaaugggaagaucauaaacaucugcuguguuaagccacugaauuuuaggguaauuuguugcacagcaauagauaacucauauccucccucucuguacucaugcauagcuuucacuuuugaugauacaaguaauucuuacacaugucgcaaaaugcccucaucucuauucuucacaugucuucauguggagaggcaaaaaucuagauuaacaucuaucauuuauuugcuuugcuauuucuuaaauuuuuggaggaaguauuauacugcauaauauaaauaaagcuuuugcuaucuuuuguuaaaugauuccuaaaaauuaaaccuauuucggccgggcacaguggcucacgccuguaaucccaguacuuugggaggccaaggcaggcacaucacaaggucaggaguucgagaccagccugaccaacacggugaaaccccaucucuacuaaaaauacaaaaauuagccgggcguggugguggggccccuacuugggaggcugaggcaggagaaucacuugaacccgggaggcggacauugcagugagccgagaucgcgccauugcacuccagccuaggugacaaagugagacucugucucaaaaaaauaaaaaauuaaaccuauuucugaguuuuuuuuuuuuuacaccugacaucugguuauucgaagauagaauaucauucugucuuuggaaauuaucauauuuagaaaaccaguuaccugauuuuauaccuaacuugaccuggguauacuacagaaacugaaguucaagaccuuuuagccacauuucucaggucuaggucacaaauaaaaacuaacaaauucucuuuuuuaguaauuguuuuuuuuuuuuaaaaaaaaggccaaugaguuaaaagcauaauuaaaauuccaagcagaaaagaaugggagaaaaaucauucuaugcauuaucguaauaugguggcaaucauaguauagauagaggagcccuggcuuucucauaauuuaugccaaucauuuuucuauacuaugacaaaacuucaaaacuaucauuuaaaauaucugugauauuuuauuagcagguauuacauaauuuaucuaaacauucccccaccuuuaaggacucuaauagcauuuuuuuuuucuuauuuagagacggaguuucacucuuguugcccaggcuggagugcaauggcgcaaucuuggcucacugcaaccuccgccucccagauucaaacgauucacuccugccucagccucccaaauagcugggguuacaggcaugcaccaccaugcccagcuaauuuuguauuuuuaguagagaugggguuucuccauauuggucaggcuggucucaaacucccaaccucagguaaucugcccaccucggccucccaaagugcugggauuacaggugugacccacugcacccggccaacaucuucuuuuuaaagaaguuguaaaacuucagaauacacaguaauuauuagccauacaucacuuaguuaacuuacuggcuucuguuguuaaauguuguuuuuuauugcuccauuugcuccauuuccagaaaguuucaguagaacaacgaauccgaaaaguauauagaguguauggauuuaacuuguccagagcaacaagauaacuugaauuuucuacuccuuugauugugacauuccgcuauuggaaaacaaauaaauauauauauauguauauauuauguguaugaauacauauauauauacauacacauacauacacuuuuuuuugguaagaaagccuucacauuuguaacacaaaccaacggaaugucaaugaguuuguauauguaacacccaaagcaguuuauccacuguaauauuuuaauucuuauauaccugccaagccaaugaaauuaugcccuguaauaguaauaaaaaauuggguuaucuuuuuaauccaaauacuggcucuaaguaauaauggucaauuaaauuaucuaaaggauuauauaauuuugauaaucaaagggcuaauggugaugcaauaaaccuuaaugugauuuauaauuugagaugacugugaggaauaaauguauuauuuggaugauauuuggaaguuucuuggaggcaggcauuaccuuuugugcaucuuuguuaauaugacacuuagaacuucuaguaugaugcuaaacauguagcaaauauucaacaaauacuuccuuaaacuaaguaaauauaguuaaaaugaaacauuucuaaacaaauuugaauaucugccuguuucacaaaagccucugagcuccccaaaacauuacaaagaagguuuucagguuauauuuuacaguugugacugauuuucuagacaucaguaaauuuccaaaugaauaguuaaguacaccucauuuauuucagacuuaccacaaauuacaagauaguauaauauaaaagucaaccuaaauauuuaaaauguauuaaaaagucauguugugacuuuuaaguaccaauuacagcuuguucccacugccacacuucacaguuuuaaaaaaucacuucugcugucuagugccaauucauccauuaaugaugcuaaaaguuacagcaaaaacuacucauucauucacaaauuuacggagcaccagcuaugugccagguacuauagugcaucugggaacauucugaggaguaaaagucauauuuacaauuguuuuucaaaugauacaaugcuguuauuacauggauaguaaugucuuucuugguucuuaguaaaucucuauaauaaauaaucugagagcuuaagcauaucaauuugcuuaauucuuuuugagaacuauuuuauccaaaauaaucacaaaggaagucuuuaagagaaucuuaccugcucuuguacugaauuagauuucuuaauuucaauuucacauaaaaaauuaaucuuugcaaaguugccugguaaaugccaagaaaguuuaacagcuguugaauuaauauccuucacuuugaaugaaguaggaguauggggauaaacugcaaauauaauuuuuaaagauuaaacacuuauuuaaagggaaaaacuaucuucuaauaugacaaaugagaagaaaacauaaaaaacaacgaggcaucauuagugcugaccaacaacauccuacccaguauuuguggaauugacaaaccuaauuucuacuacugacaucuugccaacauuuuuaaacaaucgaucaugcucaaagcucuuaaauuagugucaggaauacucaaagguaguuaagaucacaguaucuaccuuuaaggaacuucuaauuuacuuagggaaugaccaaaaaaaaaaaagaaaagaaaaaagaaagaaagguaauuaauaagaauauaaaugccaaguucuaaaugaaugauacagauauuaaccacuauguaaauguaagcaugguaagguaagucuuacagugaagauggaacuuaagaugagcuaugcaggaagaaucagacaaaaauuagccaaaaaaaaugcagaaaagcauuuuaggcagagaugccaauaaugaagguacagcgaggcaaacugcauauuacacuggugauaguguguaugcccaguugaguggcgggaaagaaucacaugggaaauaaggcugaaauggcagagggcagacaaauacauacaaauacuaccaugcaaggauaaaauguagccauggugacacuaggaaaaauccagaaaucgcaaagacgacaggaaagaacaacugauaaaagugacuuaugcuuacaaauaaggcaacaggaucaucuacuaaucagcugugagacuguaugagacaugccuucgguuuaggcccuuucuccccugccugagucucuaagagaaggucuaggccguugcucagugugcugugagccugacauggaguguuaaugcacauggaccaugggaaugaauaccaaaaagaccaagcacauuuuauuuuuauuuggagcuauauauuaauacgauugguaaaaaugcaaucaguaauaaaagggacgaacuauuaauacauacaacaacauggauggcucuccaggacauccuuaaaaaaaaaaaugccaaacugcauacuguaugauuuuacuuauguaacaaucucaaacugauaaaacagagaugaagaauagauucguuguugucaaggcacagggaugugacuguauguacaggggaugcuggaagggcaacaugagcaaguuccuuuguagugacagggcaguucuguaucuugcaugugguggugguuaccugaaucuauaccuauaaauugcauagaacuacacacacacacacacacacacacacacacacacacacacacacgaguacaaaugaaugcacauaaaaacugagcaaggucaguagucuaguuaacaguguuuuaagagugucaauucccugguucugauauuguacuagaauuauauaagaugacaccacugggaauagccaggggauggguucacaaggcucuuauuauuguaacuaccagugagucaacaauuacuucaaaauaaaaguuuuuaaaaauugggcagaagauauuucagaaaucaaaaauuaucagaaagaguaaauuacuaauucaaguauuuaaauucaauaaaauaguaaaacuugaaauuauacauuuaaaguuuuuauaaauaaaauuuaugaaauuaauauuaaguaacuauaaagaaaauaaucagcaaaaaguaaucccuauaagcauuuuucauuaaagcauuucaccacuuuuaaaguuauuuuuaagacauuaguuuauguacagcuuaccuuuuucaguuauauuaacuaaaauuguugauugugaucgacccagcggauugugagcauucaaaguaaaauuauauauuucuugauuuggaagcauuugaaauaauaauugauagcuuucguuuguaggugcuucagcucuuuuaagucuaacauauuuuccugaaaaacuguuaauuaacagaaaaauaauuucaaaauggcaagagauaaauauugcaggaaaaaacgggcaaauucguaauacuuaauuuguauaaaaaguuuaaauuucuaauuagaagcauauuacauacucagagaagaaaauguaugugauacagaaaauagaagaaauuaaucagccauaaguuuacuaccgagaaacagucucuguucauguucaaguguucuucauucuaagcuucuuaaaagaggagacauaaaauugaguguacauguggcugaacugcagugcuuauaaguguaauuuuauacagcauauuugguuuuauaucuuguuuguaacauaaaugaucuagugcaguucccuaugucauuuaacaugcacuuccaacguacuccuugccaucugacaucuuuucccaguuaucauuaccuuucaacuaaaguguagcuuguagcacgugggcccaccaacgcugucacccuuccuggauuccaacuacauauaauuucuuuuaaaucaugugucucacaauucaguuguugaggaguaucugguggaucuaacagaaaaaaaaugcagguacuuaugauuacauauauuuucccugaaaacauaauauuuuauaaacgucaauguuuuccacaauuuccuaaaaaaugaaauaauuuacuauuuacauuuuacuuuugaauaaugcaggaauuauucucucuguagcaugucuugucagaguucauauuacauuagaauugacagauuaaaauauacugaaaaaugacucuuagcucaucuggaaacucccuguagcaacuugaaauaucaguugucacuuuuuuucccuuaauccuauuucagaggcuaccaaaucucucaaagaaaccugagucuaauauguugucagagaaaucuacagguuaaaaguauuaucaucuaucaucaauauacugugauucgaaaagaaauaccaaaucauauugaaaaucaguaagucauguuacauguuucagaguucuaaaauacauuauaaguacuguuguuuagaaaacucuugguaaaauucugcaucucaguauauacaaacugacugcggcucuuuuguuguuuuucucuuuaucaaaacugcucuccccagcuuuaaggcaggacuagaaaaauuaaaagaaauuuuuuuuuuuuuuuuaagacgagaccuucaaagugauaaaugagcccaggugcaguggcucacaucuguaaucccagcacucugggaggccaaggugggcaaaucaccugaagucaggaguuugagaccagccuggccaacauggugaaaccccgucuccacuaaaaauacaaaaauuagccgggugugguggagggugccugaagucucagcuauucgggaggcugaggcaggagaaccgcuugaaccugggagguggaggcugcacugaacccagauugugccacuggaaucuggucugggcgacagagcgauacuccgucucaaaaaaaaaaaaaaaaaaagugauaaauuaaaagucugcagucugacacugcuuauuguagaaauucauauuucuguaaucauguuuaaccauacacauauagaaacugguauuuccucucucauauuuauccaaacuaucuuucacuuuagguaaaaguucuuuuuuaaaaaaacuacuuguuuaaaaauucuguaaaauuuuuuuuucacaaaucugaauuaaaaaaaaaauacuccuuaguuuaucaaccaaaacuuggaaaauuucauaccuuccccagagauaaggauaacauccuucaaugauauuucagguaacauuaagaggauuaaugaguguuuauaugagaguuuaacaauuagauaaguaaacaaacauugacauauuuauucugaaaauuguuuuaaaucuaaggccaaauauucagucacucuauuaaaaccacauaccaaaaauauggaauauauuuaaaaugcugguuauuuuaggauuugguagauauuaaguugaaauauuaaaaucuaaauaacaagagcaaauaagagauaaauagaaggacagacagaaggggaaaaauuugagaggacaguauuugaaauguacuaauuuucuuuucaaagaaauuaacuuauaaaauaaucaacugaagcuacuagguuaaaagcuagguauacaucaacuacauuuuuauauaccagucaauagaaaaugcaauuuaaaaaacaaagucauuuuuaauaauaucagaaaacaccuagcacuaggaaaaaauuuaccaaaagacauaaagaccucauauuaagaugaauuaaagaagacucaaguaaauguagggauauaccauguucauaguuugggagauacaaauauuguaagaaugaaaauucuccuaaauugauccacggauuuaauguaaucccaaucaaaacgccagcagguuuugauuggguaggugugugugcacgcagacguguguguagggaaaaacuaacaagccgauuauaaauuucuuuuucuuuuuuuuuuuugagacggagucucgcucugucacccaggcuggagugcaguggugcgaucucagcucacugcaagcuccgccuccuggguucaugccacucuccugccucagcuucccgaguagcugagaccacaggcgccugccaccaugcccagcuaauuuuuuuguauuuucuuuuuuuaauagagacaggguuucaccguguuagccaggauggucucgaucuccugaccucgugauccgcccgccucagccucccaaagcgcugggauuacaggcguaagccaccacacccggccuaaauuucuuuucagucuuuuccguaaaugguggcuuaacaggauauccauaaagaaaggaaauaaaugaauccugauaccuaacucacgaaauaaccugcucuuauaaauuuccuaaaaguucucucugaagggagauguuacugcugcucaacaaauauuguacaauauuucaaccuccaaacguuauaaaugaagguuaaacuauaaauuagcuuguucuauuacuaugauaaaagauuacaacacugucugaaauaacacaaauggaaacagugcacagucucauuuuuuaaguuuuaauuucuucuuucauacuuuuaaguaauagcucacuuuugguacugcucacgaagcaacuucacuacauauaccacugggucucaacuuagacuccaggacuauuugugagaaauguugcaaguaauuuccuaacauuccauuaagaaggauaauaugauuuccaggauuuaaauuugaacauaaccucacuuucacuugaauuccaaaugcauuacugagcagacaaaaagagagucagauuacagccaucaagcugagacgagcaccuaaacccggcuauuccuuugggaauacaucaguaucugaaugaaauucaucacgaaguacuguaugaguaaacgagagagcugcugaucuagaccacagcugagaaucauaaaaagaaagaaagaaaaagcacuaaggaaucaaaagaaauaucauaaaaucuagucaaucuaucuuauacacauuauucaggcgaccuuuagaccaaaaucccagacuucuaauucagcauaaagggaggaagggacucacugauaaagaugaagcugucagugacaccaaaacauuacaguugcuacaaggaagggaggcagaaaaacuaaaauugagaccuaaaaauucuacauauuuaucuguggacauucaacacaagccacaugggcagggcagcccacaacaaacuacuuuuggaaauaccauggaauuuuagacuguggggugaucauguuaauagacaccuugaaugacagagcauacaacauauauagaacgcagugggagaguauguuuccccucacccauguccuccugccagccuguucuccucaaauauaauaguuaaaagauggagaagauauguuaugcuacugaaagauuuuguguaaaauugcuauaauuucuuuaauuuagauacuuuaaaaaagguauacuuuaacuggaaaaugaauucacauaauuucuaaacaaugcaggguuaagaaauauuauauccuauccuuaacaaagcuguuaacuaagaauuuaaacuaaacauuagaagcuagauguuucaaaucugauuacaaaaccaacaaauuacacagauacagguuauguggaaaacaagcuugcaauucauuuuaaaacaagcaaauauucuagugccuuuguauagccuuuauauuaaagaacaaagaaaugagaaagaaacagaaucacuccucccacccccccacuccagaagaauuaaggcuuucaaggaagaccaaaacagguuaauaggaauucucucuuuaaaaucauauacuuacauccagcaaaaauaacgguuccaaauauguuaucuucgguuguaaaaacuacauuuguuccacuacuugcagaaacagaaauauuacgaaucuugauugcaacauuuuccccaucaagauggaucaaggggcaguuuguauggccaaucagugcugauaacacuuuuucuugacucacacaacaaaauguuaugucugagccuacaaguaucacuuuaucuugaggaaaaaccuuagucugagaaucagguaucccuagaaagaaaaagaggaauuauaaacauuuuauauagaaguauuuuacauaaacuuuucugcauuuuaagacuuucuuuucauaagaugacuuuuaaaauagcccaguauauacacuacaaacuguuaggugcuuuguaaugauaaugguccaaagauaagguguguuccacagguuuuguaggagcaagauauauacgauaaauuuuuuaaaaguguaugugguuuuauuuacuuaugaagggauaauggugaggaagcagaagcagauuacaggucagugucuaaaguuaaugccacagguuuaugucuaagaagucuaaggguugaaauucaguggguuuauauauacaugugaacaauccacaccccccaaaaaucacuaauuaaauaauuccauuccuuuuauucaauguauuuagggcauaugucuuacuuuccaucagccuaaauauaugcccaaguacuccacacccuaaaaaacaacuuacuuuaaucuaguccccuuccuuccucuaauccuuuuauccauagagugaucuaucucuacaaugacuaccagccuuucaggauuucauuuuauggucaacaauuuuccaggcccccuauucgaaacugccaacauucucccuguauaugaguuuuacuuaauguacggaugcuuuuugguaugcuugcagauccccguguuccuggcaauaacuaugcagccucuaggggucugcucugugagccagaaauugggaacuguuuuguuuuuuuuuuuuaaacauagauuucaucucaguaucaucuacacacaauuuuuaaugcucuucaauuccuaugacagugauuuucaaaccuggauguuuauccaaccacucagaaaguucuuucaaaauacagauuccugaagccuaucucagacuuuuugaucaaaaucuccagggauggugggcuuagacgcucccagguaauccucaugcagcugaaugagguuaugagaagugaaagcucaaacuaaaucuuacucuuaagugagacuaauuuaauucaucugaaacaaacauucuuuaaauauaagcuuacaagaaauguucuucacagggcuccagucacuccacucuucgagaccagaaaaaugaagauugucaauguagcaucuaauuuccacaaaaugaauggcacauuccaagggcauaucugaggcccaacuccagugaugaaguguaucuuugccauucagaguuguguugugggucaccuaaaaaugaacacaaacacaaaacuguauuuccaaguagcaauauguuuugcuuuccuuuagaauuaaaagacacaauagauuccauacaaucaucagcuaaguuuauguuuuguccuuuaauacaacucaguuuuguguaagguauaauagcagaguaacaauaaucaugauucauuuguuuacuucuucaacuuuaggcccuaauguauuauauaagauguugcuauucauugaaacauucaauuugguaugcaagaaaaugcagguugaguaucccuugggaccacaaguguguuggauuuugcaccuuuucagauugcauuauauacuucucagaugagcaucucuaaucuaaaaaucuaaaaucugccuggacaguggcucacaccuguaauuuacccagcacuuugggaggcugagacaggcagaucccuugagcccaggaguacaagaccagccuggacaauacggcgaaaccccaucucuacaaaaaaauaaaaaaauaaaaaauaaaaaaauaaaauuagccaggcaugcuggcuugugccuguagucccagcaacucaggaggcugaggugggagggucuauugagccuggaaagucaaggcugcagugagcugagaucaugcaacugcacuccagccuggguggcagaaugauauccugucuaaaaacaacaaaaaauaaauaaauaaaauaacaaaaaucccaagucugaaaugcuccagugagcauuuccuuugagcaucaugguggugcucaaaaaguuuugaauuuuaaaacauuuugaguuuuggauuuucagauuagggaugcucaaccuguauaccacugccuaaugaucuaaauuuuucauagaguagaaguaauuaaugggguugcacuuucaaaagcuuaagucaaggagaggggcagcauuucaauaaaauaguuuuagacuagauuuguuuuuuauauaaguauucuauauaguugcuuuuauuuuuaaauagaagauuaaauauguaaguuauacuaauacaaauuauuauuaauugugagaaaugagcaagauuucaauaaaauauugaggugcuauaaaagauaacuugggacuucuaggcaaacacaauagauuaaacaacuauuuccuucucccuuaccuccugaaaucacuccaaagaguaaacagauuuuuuuuaaaggugugaauggacaaagacaaaauauagaaauaaagcaacaucacuaaaaucuggaagcuggaaagcagauggauaaugguaacugauguagaagaccugagaaaacaaaaucuuaagcauccaaugggaaauacaggaaaacagcuuguuucuaucacagaaaugccaaagggcucagugaguggcuaucccaggcuccccuggaaauaaagagcucaaaacagcaggacugcuugaaaguuguuugaagauauguuggcuacccagaucccuucccacacuccacacuaccgaaggacuaccuuuguuuaccuuggcagaagaauaaagauuuauguucuggaaaaguaaaacagaauaucuuuggauugaagaauuuuaggaagagaugagaauggggacuaucauuccaaaaacagggggauugcuaaccuaugccuucuuccucugcucagcucccaggauacugguuugccagacuaauccucaccagguaauagucuaaaugaacuuuucugagucacauaaacaugucaaaaugaaauaccuaaaauaauauuuggcguuugccaccugcauagcccauccucaucacucuagagggaaggcccccaucaacaaguccuauccagagaaaccaaaguuccaauuagauuaaaaaaaaauuuuuaacagccccucgcuuaacugugagcagcaaccaggaugaccagaaaguguacaagaaauucuaauacgaaagucaauaauugaaaagaaaagaaaaagaaaaaaugugaggaaacagggcauguagaaaaaaacuuuaaaucauuacuauccucagagauaagacauugcaucaugaaacaaaaacuggauacauuaaaaaaauaacauaaauccuuucaaagaaaggaucuucuauaaauuaauaaacauaugaauagaaauucaauagcaggaugcaaaauccaguuuagaaaaaauuucugagaaaauagaaaauacauagaaaacaagaaagauaaaaacaauuagaggauuguuguggaagguucaugaagaacagaaguucucaaaaaaaaggagaagacagagaaggacaaaucaaagaaauaaaacaagaaauucccaagcugacacacauguguuuuuagacugacaggggcccaaugaguguccagaagaacagauaaagauugauccacacuaagaaacaauggaaucauaccuucaaaaucuugacaaaauuucccaaccuguaauucuacacccaguuaaacuaguaaucacgcacgagugcagaauagacauuuucauaaaugugguaucuccauguauuccuuugguaagcauuuuacacucugcccaguaacguaugaaaguuccaguuccucuacaacuucucaguaauaguaauugacaagcuuuuaaauuuuuaaauaauuaaauuaaaagaacaaauuauauuugcaagcuagcuauuauagauagcagagaauaucuacaauagcaaauaacuacugacaguuggcucccucuauucaucgcuccacaucugugaggucaaccaacuauggaucaaaaauacuuggaaaaaaauuugcaucugugcuaaacaugugcagacacuucuuguccuuauuccuuagacaauacaguauaacuacuauuuacacaacacuuacauuguauuagguguuacaaauaaucuaaagaggguuuaaaauauacaggaggaugcccguagguuguaugcuaacgcuaccgagcaucuuugaauucugguaucuaagggagguccuggaagcaaucccccaaaagauaccaagggacaagugcaaaugcuuccacaaaaaugaggaaauaagagaacgacuggagauuuggcaaaaagaagauccaucauaagacaaaguuguaggaaauacccuagaugauggagaucccuuggaccacagcuuccuaagaaaugugcugaaagacacugaagucuaucuugagugaguuauaaauauaucuagguauuaauccauucaaaccuagaacugcuugguagggguuggggcuacuggagccucugugaugccucuggccacaagcggucucggcuauuuaccacacucugugcuauacaaauauuaucagugucuaugugagccuucugugaauaagguugggaagccagccagaaagcccucagagauuuauucgcaaagauaaaauugauaaaguacuuaguauauuugaaaauuccaaggagaucuacacagccugcaaagaauuuaggauuaaaguaaugaagcagagaaauaaacacaaaaaaacaagauaauauaaggaguguacaaaaaauuguggauuuuuuuauagaccauaauacaaaugaugaauacuguucuaccaaaaauuaucauagacucuauuggaaaaagcuaggaaaauggcaggcugcggggagaaggagggagagggaggagcagagagaaaugaggcgguggggggagaggaggaaagggaggggguugcuaucaagaaauagcaacauaagcauguuauuuggagaaaugaagauaaauaaugaaagagaucaguuaaaagaguugaaacaggucguuuccagggaaagucaaggaggaguauuugugugugggggagcagugccuggugagcucuucccagugugugcagcacacagcucccacugcuggacacagagaccacagacagacaagugccucacaaaugaaacaugaaugcaaaguguucuugauuuuuaaauuauuauaaaauaauagcauuagugcaaaauaauaggauaucauaaaaugacugaucacaagcaauuuugucuuaaauacugacauuaauaacguacuauuaauaaaaaugcccugaggcauuuucccuuacuuuacaguucuaaagaaauguguucuuucucauugcuucuugcuauuauuuucccaaauuuuuucccaaaaguaaggaauuacugccuugucauuggcugacuuacacauguuguagaaugagcuauaugguuuuagccuaacagucccuucauuuaaguuugauuucacucacauuucagagugucccucuuuaauucuaguauucucuaguuaguuccuccucaaguuacauuaaaaauuaaaaaagccucgucccuauccaucugacaaagggcuaauauccagaaucuacaaggaacuuaaacaaauuuacaagaaaaaaaucaaacaaccccaucaaaaaagcgggcaaacgauaugcacagacacuucucaaaagaagacauuuauguggccaagaacaaaaaggucaucaucacuggucauuagagaaaugcaaaucaaaaccacaaugagauaccaucucaugccaguuagaauggcgaucauuaaaaagacaggaaacaacagauguuggagaggauguggagaaauaggaaugcuuuuacacuguuggugggagugugaauuaguucaaccacuguggaggacaguguggcaauuccucaaggauuuagaagcagaaauaccauuugacccagccaucccauuacuggcuauauacccaaaggauuauaaaucauucuacuauaaagacacaugcacacauagguuuacugcagcacuauucacaacagcaaagacuuggaacccacccaaacacccaucaaugauagacuggaugaagaaaauguggcacauacacaccauggaguacuaugcagccauaaaaaaggaugaguucauguccuuugcagggacaugaaugaaguuggaagccaucauucucagcaaacuaacacaggaacagaaaaccaaacaccgcauguucucacuuauaagugggaguugaacaaugagaacacacggacacagggagggggacaucacacaucggggccugucagggauggggggcuagggaaaggauagcauuaggagaaauaccgaauguagaugauggauugaugagugcagcaaaccaccauggcacguauacaccuauguaacaaaccuucagguuuguacauguaucccagaauuuaaaguguaauaaaaaauuauaaaauuuaauaaauaaaaaaauaaaaagccuugucccuaaagggaguagugacaaauaauauuuguuuagcagcuuuacagauauacuauuuacuuugcagaccccagagcaaauauugccacuuuacaaaagauacaaacuagguuugaggaguuauccuaagccuguaagugguaacccagaaugcaaaauguuaggccauaaugacaaguuaagcaauauaauuuaaauaaauaauaccuuuaagacagcaccugcagaacuguaucaaagcuagcugcaaauuagauuaacagacaagacuugccauuagaaucaagaaaagugagagucugcaggcugaauuaagaugggcuuuaaggcugggcgcgguggcucaugccuguaaucccagcacuuugggaggccgagguggccagauuacaaggucaagagaucgagaccauccuggcuaacacggugaaaccccaucuccacuaaaaauacaaaaaguuagucgggcgugguggcaugugccuguagucccagcuacuggggaggcugaagcaagagaauagcuugaacccgggauuuggagguugcagugagccgagaucaugccacugcacuccagcaugugcaacagagcaagacacugucucaaaaaaaaaaaaaaaaaaaaaaaaaggaugggcuuuaaaauaagaaguaggcagauggggcaaaaaagugagaccccaucucuaugaaaaaaaaaaaaacaaacaaaaaaaaacagcugggcacagcagcaugcaccuguagccccagcuacucaggacacugaggcaaaaguaucccuuaggaguuugaggcugcagucagcuauaugaucaugccacuguacuccagccaaguugacagagcagaacccuaucucuaaaaacaaaugaauaaaauaaaauaaaauaaggaguaggauuugaccugggucuugaaaugcagguucgaguaggauacgugagaaggggaggacauuuuaaauuaaaauauauauauuucuuauaaaauauaaauuguagcaguuaagagcagacucugaaaccaagcugccuggguuggaauccugacuccaccacuuaaagucuuccugugacucuguaucaucuguaaaaugggaauaauaauaguaucacccuccugggacuguugugaggauaaaaagaaucaagguauacaguaaugugcuauauaacaauacuucagucaaugugggaccacauauaccauggugauccuauaagauuauaauggagcugaaaaauuccuauuaccaagugacaucauagccaacauaaugucauagugcaacguauuacucaugugucuguggugaugcuggaauaacaaacauacugugcugcugguauaagaguauaacacauauaauugugcucuguacauaauacuugauaaugauaauaaaugacuauguuacugguguauguauuuaguguacuacacuuucuaucauuauuuuugaggguacuccuucuacauguuuuuaaaaguuaacuguaaaacagccucaggcagguccuucaggagguauuccagaagaaggcaugguuaccagaggagaugacagcuccaugcauguuacugccccgaagaccuuccagugggacaagauguggagguggcagacuguuauacugaugauccuggcccugcguaggccuaggcuaacguguguguuuuuguccuuguuuuuaacaaaaaaguuuacaaaguuaaagaaaaauaauuuuuaaaaauacaaaaaagcuuguagaguaaggauauaaaaauauuuuuguacagcuguacuauguguuuguuuuaagcuaaguguuaauacaaaagagucaaaauauuuuuuaaaaauuaaaaguucugaaguaaaaaaguuacaguaagcuaagguuaauuuauuaccaaagaaagauaaaaaguuuuauaaguuuaguguggucuaauuguaccauguagacuacaguggugaauagucauguccuaggcccucaauucacucacugacucacccagagaaacuuuuaguccugcaagcuccauucacgguaagugccuuauacagguguaccauuuuuuaucucuuuaaacauuuuauugauacauaguauuuaugggauacaugugaguauugguuacaugcacagaauguguaaugaucaagucaggguauuugggguauccauuaucucaugaguauuaucauuucuguguugggaacauuucaagucuucuagcuaccuugaaauauauaauacauggaugcuaacuacagucacccuacuugacuaucuaacacagaacuuauaucuucuaucuaacuguacauuuguacccauucaccaaccucucuuccugccccgucccaccaacacacccuucucagucucuaguaucuaucauucuguuacuaauaauaucuuuaccuccaugagaucagcuuuuuuagucuccaugagugagugagaacauacuauauuuaucuuucugugccuggcuuauuucgcuuagcguaguggccuccaguuccauccugguugcugaagaugacaugauuucauucuuuuuuauggccaaacagaauuccauuguguguauauaucacauuuucuuuauccacucaucuacuggacacuuagguugauuccacauauuuucuauugugaauaguggcaugauaaacaugugaauucagguaacccuuuaauacacugauuuauuuuccuuuggacagauacccagaagugggacugcuggauccuauaggaguucucuuuuuaguuuuuugagaaaucuccauaccgauuuccauaguaguuguacuaauuuacauucccagucgcauuguauaagagcuucccaugcuccacauccucaccaauauauaaguuuuuuuugucuuuuuaauaauagccauucuaauagaggugagcugauuugauugugguuuuaauuuguauuucccugguaaguagugauauugagcauuuuuucauacaccuguuguccauaugucuucuuuugagaaaugucuauucauguccuuugcccacauuacaaugggaguauuaauuuuuuaauuguugaguuguuuuaguucacgguagguucuggauauucguccuuuguuggaugaauaguuuggaaauguuuucucccauucaaccgucucuucacuccacuguuuccacuguugugcagaagcuuuuuaguuuaauauaaucuauuuuugcuucugcugucugugcuuuugcaguuuuagccauaaaaucuuuaccuggaccaauguccuauaguauuuuccccauguuuuauaguuucagucuuauguuuaagucuuucaucuaucuugaguugauuuuuguauaugagagacagagauccaguuucauucuucugcauaugaauauccaauuuucccaguaccauuuauugaagaugauauccuuuccccaacuauguauguucuugguaccuuugucaaagauaaguuugcuauaaaaacauaguuauuucuggauucucuacucuguuccacuggucuauguaucuguuuuuauacaaguaacaugcuguuuugauuacuauagauaaccuuuuaauauauuuugaaguugaguagugugaugucuccaaguuuguucuuuuacucaggacugcuucagcuauuuggguuucuuuugacuucauacaaauuuuaggauuguuuuuucuauuucuguggaaaaugacauuggcauuuuuguagggaaugcauugaaucuaaaugugcagauugcuuugggcaguuugguccuguuaaugauauuaauucuuccaaucuguaagcauggaaugucuuuguguccucuucaauuucuuucaucaguuuuguaguuuuccuuauagagaucuuccaacuacuugguuaaauuuauuccuagguacuuuauuuuucuguagcuauuguaaaugggauggcuuucuugauuuuucagccaguucauuauuagcauauagaaacacuucucauuuuucuauauugauuuuaccuccugcaacuuuacuaacuuuauuuacagaucuaaguuuuuugggggagucuuuacacuuuucuagauacaagauuauaucaccagcaaagagggacaauuugacucucucuuucccaauuuggaucccuuuuauuuucucucuugcccgacugcucuggcuaggacuuccaguacuauuguugaauaagaguggcguaagugguccagucuuugggucccggcaguggaagugguaagccgaguaugccugucuuuggaccccaggauggcauucacuggccccauuguuaguggguccaagggggccaauucuugagcguccagguggcuugcuuggaugcugguauugagaguggugggcuggguacguucucaggccccuggccagcagguguggugugggugauggcaguagcagugguaggauaacccucugggucuugagcagugcacucuggugcugacaguagauacaaugugcugagugggccagucuucaggcccgcagguagcaugugcaguaggugccagcuguggugguagcagcagggugugugggccuaaucucaggccccuagaagaggugcucaggugcugauggugguagacuaggcuaggugauuccuagguccauaggcuguaaguucuggcaccagggcaagggaacaaagcugggugggcuuguccucaggcccucucguaguacauguagacacuagcugugguaggcaggcaugcgguguuccccaugcucccuccagaaugcucagguggacagcagcaguggcugugcugcggcccugcuacugaggaggaagagauugcuuucaaugguagccauaggcaugcaaguggggaacgcacaauuugcauucuagucucaguagcuguagucugcgcuucacucacgcuucagccuuagugguggcacaucacgccccacuugugcuucagcaguugcaggcaggggacucugggcacauggaaugcacuuuagcaguggagccacugcugguguucugcuggcugccucacuuuccucuuccuucccugcuuuaggugcuuccugucacuucucuugaaucccgaugcucucucuaggaugaucuauuugaagugugaagaucuacuauucccuaucuugguucuucuuuguagagaaguugaguacgaggugccucuagucagccaucuugaagucccuccuccauuuaaagucuucuauaccauauuuuuacauaucuuuucuauauuuagauacagaaauacuuaccaauauauuacaauugccuccauuauucaguacaguaacaugccaugcagguuuguauguggccuagaagcaauaggcuauugucccauauaggcuaggugcuagcugacuauuguuauuuuaggaaugaaauacauggguugucaaagagaaacaauaagaaaguaugaaauauagaauaaucuuuuuuauuaucuuuacuauuuuaucuauguacuugagcaacuugaacaaauaaacuguaaaaucaugagauggucuucuaauucuuaaaccuguaacuaagcaaacuccaaaucuaucaagaaaaagaguaaaaggcugaaagggagcauuuccagguaacagcugucaaacuuuucauaaauguuguucauuacuccuuagaggccauucauaaacaggaaugaaaaaacgagagagggaaaaagcauguacugauaaauucaagcuuauagauuuauaaaaaaaaauucucuauggcuaaguucuggcuaaacaugcuucaaaacauuagacaaagguaaaauaauacacuaaauuaaaugugcacuuucauuuacauaaaaacaugcauauaaacaaguccagacaggaauacacaaaaacaguacuuacuauuuucaagugguagaaucacggcuuauuucuccccuaauuuccuaugcuaucuguaaugguuacacaucauuuaauaauuaacaagugauuuuuaaaucaugcaugauguuuuuaaugaacccugaaagguaucugauuuacuuccuaaauaauccaaaaguucacugauaccaccuuaaggcuucuuaaaaaaaauuauucaguuucuuuaaugucauaggaagaaaaucuauguucaaacuuacuaauuuuacgagcuccauacucucuuuacguagaacuuuaauuucccagauaacauuugagcgguguggaaaaacugaaccccugucguuccacuuuagguauaauguagagguugagaaaucagcagacaaauucaagaucucuggaguaucuggaauuaaggcuuuaaaaagaggaaacaaaagagaaaacuuaguaaaauaaguaaugauuuuucauacuguaacuccacuaaucaacuacuuauaaacucuauuccuucuugaucaaaaaaucaauaaucaagauuuaaaaggaaacucuagaacccaguaauaaggacauggacugagaugccauauauggaaaagauaaaaugucauggauauuucaaagaaaugacuggaucaaagaaaugaaggguugguucuaaugagaaagggaaacgacuaauauucucucaaauuucugaaaaaggggaacauauauauuauuuauuuguagaggcagcucccaaugcuucaucagccaaauuuaagaaaauuauuuauuagcuggcuguuucaaauccacagcacauuuucuaauacaaacagcaacuagguuuccacaguacucuagugucauuuagucaggaaccuacagguaggcaacaucagagagaagaaaacgaguuuccucuguauggcuguagggcagcccuaagaaaauaacaaaauauagaaagcuuccuuugguaaaggcuucucucuguuuucucugcagcugucucaggcaucuccuggugucaagagucucucgugcugggggaugucacccacuugagaaaugcuaugggcauuacugauuuucaauaccauuaaacaguagcaggauugucucagugacuaaggcauugaguuaagaagccagugguuacugugcagaaguagcaggauauaagaagugugucagaaagguuccuuuaucaguaguaugcaacacagacugcgggggauugagacaggggauaaggugaccaauuaggagaccacuggagcaauccuggcuagagugacaaggauauaaacuaagaugccaucuauggaaaagaugucauggauauuucaaagaaaugacuacaucaaagaaauaaacgguugguucuaaugaaaaagggaaacaaccaauauucucucaaguuucuagcucagaaagcagcaagaggagcaaaaggaaucgggaaucacugugaagagacacagaagccuggcuauggaugaguaagggucaggggaagaagacaccauggagucagaacguggaugcagacuuaaaaggaacugauugaguguagugguagaaaagagcaugaacacaaagacauaaaccagccaaagcuccuuuuaggggcugccaauagacaauuacaucuucaaggagccaaaaacaccaacaugaauccagagagggaauccuagaagcagaaggaaaccagagaaaauccaggaucaucgaaauaaaaacaaauaguuguuaccugugccaaauaaaacaguuuauagaggaagacuguggaaaaaccacuggcgaggcuacuguuaauaucugagaaagaaguuuaggagaacagugggcucugaagcugcauuacaaaagguaaaagagaaaaaaauccaugcucaaagguuugggcaucuccuagggagaauccaggacacuaaaaaagguagcaggaagaguaauguauccuugaaaaucauuaacucucccuaagggcggauaaaucauggaaaauuuuggaccaauggaaaacaaagaagguaugagcauguuccauucuaugaaauguagacuuucugguuugagaaucagagagacuuggacuuucuuccauguuuccuccucaaauaacaguaaaguaaaggugaguuagaagaaauccauagacucacccuuucuugccucauuucuauccuagaagcucaaggaccaauuacauauagucaugguaagcccaaaacugcaggacagugcagggcuaggguagcugaauaugcuaaauaacaaaaagggcagaacaaaccaauacacauuaaucucggaacuuaaaaauaguuauuaaaaauagguuuaacuaaaauuuggccaauacaguguucaacacuggauuuauguaaaguguuuagggcuguacaggacacagaacauguggauuuacagucuaaacuacagagcaaagucaacaguuacacagcuguauaaggacaguggaggaugcuuuaaaaagaaguuuuaagugggcagcuccuuguggaaaaggaaaaaugcagacaaacgagaggcaagaaguugauuuagugccaggacagggaaagcucagggugccagugugaccagaaaagagcaagaggcuuccaagaacacagcuauucuuucaaaugauucaggaugucacaugauguaguaacuuacaauuuaugaaacacgggaguauuuuacuaagacaacgcucaucuuuaaaaugcuucccucccugaaaaguccacauaauuuacauuuuauuuaaauagcagugggcuacucuuaaaaauacaaguaauauccaacauuucaagcuaaagacaguaauggccauaauuacaaguacaaggauuuuaaaaagccacugcucccuuucuuuucuuuauagcauauagggaaguuuccccuaagcucccauuaacugccaucugcauuucuuugugcuaaacagacaugugaggacaauguuaacuugcuuucuagaaacucagauagggaagaaauuuaaugaaaaucuuuuuuauuuucuucuaaugcuaauucagcuuuacccauaaucuacgugcuccugcuuccuuaggacauaagaagauaagaguauucccagcuuuuuuuuacaggacccacauucugcuucagaaugacccaaauuuucaggugauuuuaagaaaugcagaaauuaaaaaucuuaugaagaauuuuucaugcuuacacaugguaaguacaaacuuuacuguguguguguguguguguguguguguauauauauauauauaaaaucuuguuugcuuuauauaauuuagaaagcaucuuuagauccacagacacuuaauuuucauacuuuuauuuaguagcaaauugucaagagauccagauccucuaaaggacagcuauacaugcauugcagagcuucucuugcacacaguaggugcucaaagauuugcugauguauccaucuccuccguuccuuacacucaccuaauuugcuuuucaauuuucuuaucccaauacuguuauucuaaucaugaucaggaccauuauuauuuauaaugcuaccaauacauuacaugauauguaaaacacaaugaacuauuaaucgacugagucuccuacagucugucuugauuugccuuucugauucuaauacugucauuuuucaguagcuucccagauaagacuacacccuagagcaaggggcaucugagaaauucuggaagguacgcaggagucaagggggcuaaagaaagaguauggaacugagggaaggagccugaauucugggcuauuuugacuggccagaagaaaaguuugcuuccuucugaucuuggcuaccaucuacaauucauagggagguugcugagugaauuaaaaguaauagcauaacacaugaaauucaaaaaacuagaaagcaccacaauacuaacaagugacacuugacuuacuuuaaaauugaguuuguuuucaaauacuuacaaacguuuuguucauuuagugugaauuuacuuguagaacuuccaaaaucauguagagaauuuauuguuauuucauaaucaccaugugaaagagcuggaauuuuaauacugguuuucuccaacugauaacaagaacgggaccuguaauaagaaauugaauuuuaauuagcaaauaaaauuaauaguauaauuuucauaaaaauuugguuaacacaaaauacaauggaaaauacuuuaugcccucuuuguugcaaaaacaugauagguuguaccgcauuuuaagacugaaaaaacagauugauaguaacuuuaccaauguggggguaggaaaaacaaccucauuguaccaaaaguagaauaagcauagaugacuccaaacagcuggaguuuuugcaugccuuucaaaaucccaccucaaccuucccuuuguaggcugacuuccacuacucacacuccaccccuucacugagggaccagugcaucacagcgcuccucaugcuaggaugauguucaacggaugcugaugaaggaaaugaaacuggcaacuccccugcuccucugccuuggcucaugguuucuucuuaacagaacuuccucuucaguucuguuuucaaaaugcuuccaguuccccugguaucucuuaggcaaaaugauauuuuccucucuuguuccacagcccuugauaucucuccagagcaugcuuauauuccuuauacuguuguucauauauguuucaaacuucuuauacaaauguuuacuuuacugaaaggacuuuccaugccucuugcauuccugcccccaccaacuacccagccccagccuuagggcugggugcuuaggacucuggacuugaauggguccagcucaucuccuucuaaaccucucacauggugaggcuucuuuaggcaucagcaaugcaaaaacaccugaauucuccaaaucacgccaucucauacauucaagccauuguacucaauauucuuucaggguagaauguccuccuauuccuuuucugcugagaaaacugacugugccuacuccagaauuacaccuccucugacagccuuucuagacauucauacuccuaguguccacucccuugcacaaaaaccacagccuugcuacuauuuguuuauugugaccucccaggggagcagggggccagaacuaacuuccucucuguuuggccuguggugggcaugugugcucuucagcaaacuuuucaggcucccccuucuggacucacacuaagaccguccuucccugccucucugaagcaagguauggccauguggcuuuauuugguggcagaaaucugagugacagucuuaucuaccagaucugcacugaaagccacugcagacucuguccccucuucucaccuugccaucacaccucauaaugcuuggugcccuacaggagaaaaaugaggcagaggucacggcagacucugcuggacacagaacacaagcaggaaauaacccuuuaguuucacaagcaauaagguaagaacugagggucguuucugcaauucaaccuagcucauugugaauuaaaguaaauuaaaauuaccuguuuucaaugcaaacuucauaaucaguaccacggccuguuccagagggugcuuuccaagaacaguuccacacuugcaaauuguuaguuacacacuucaaaucaugaggagccccuggaggagacacacacacacacacacacacacacacagacacacauaaacacagaauaugcugaauaagucaacugcacucuaaaaagucaaccauuuucaguuguaagcacaagcaugugugucugcagagagcccauguuuuuuuuuuuuucaaagagaugauccugcaagucaugggaguggacugguuuucuauuucuuuuugcagcuuugguuaaaaaaaaacaacuaaaggguaaacugaugaaagugggccagcuacuagaccauuuugggguuaggcugcuaucaaaaauuccacuuccaagcaacuaagacaaauuaagggagugaguggcuagucauguagauucaauaaugggaccaagagagggcuugaggggauucuagcaccucuugaaucuucaauagccccacuuaaggaaaaaacaaaaaacaaaaacaaagaagucuuaaguaaaaaugaugugccuuccaaguuuuuaaacaaaacuuugaaacuccuagucacccccaccucauugcuugcuaccagacugcccccuugguagaacucccauaacuaaucuuuagguuauuaugaaguauauuaaauuuaaacaguaauaaacucaugaguucauuugagaaauauauuuuuggugugggccuaaacaauugaaaguaacaauucagaagauuacaauccuacuaguacuuacucacaucuauaaaauaacauuacaccauggaauauguaagcacuaugcaaugaaaaaagucaccccgaaaagaaaaugaguaaaaagaagggggguauaagagagagggaaagagggaagaaaggagggaaacaaggggaaaaggcaacuauagaauaaaaaagguaguccaucucagauucuauaaauguuuaugaaaaauguuuuuguuuuuguacaugguugguacgauauucacuguagcaauaaauuauacggcuauuuauaugacagaaaaacaaauauuacauuaaaaguacucacauuauaaagcagcacuaaucauaauaauaaaguaauuuaaugaaugaccuuggagaaaagagaucuauuuaaauauggaaauaauauaaaaacuaaaccaacgggcaggaggaugauaauuucuuuauauaaauaagcuauaaaauaucuacauaaacauucuuaauauauuuaagauguaacauaauacauuuaaaaauauuuggauuucauugauaugacauucuaaaaagguaacauuauagagacagaaaacagugucuauggagacaaggcagugcuggcaggggaugggccugggagggcugacuacagaggagccaggaagcuuuugcagugccggggcuguucccuaucuugauugugcuggugguuacauaacuacauucauugucaaaacucacagaacugaaucuuaaaaaggcaaauuuuauuguauguaaauuauauuuuaauuuuucaugguaaaauaauauuuugaucuaucauuaaggaucuuuuuaaaagaaacuaaaaguacauagaaaaaagaugacaaaaaaaaugaauuuuaaccaacaaaauccuaaaggggucaauaaagcaacaaaauugcuucgucaucaaaauggaaauaaaacugcaaucuguucauucucuggaaggcugaugcacuuacccuuuuucuggcuauuuacuugauucauuagauauagaagaauaaauguugauaacagccacuggaaauuugaagcaguccucauucuuuuauuguccaccauccaggauggucguuucaaacauacguaaauauccaucaucugugcaaugcagucaguccuagguuaggagaggaauuccagaugguguucagauuguucugaaggcucaccuuauacugugcacacaaacacucaaauagauucugacagauucugaaacacuguacauuuagagacuuuggagauacucaaacucaagcuucccuggcuuguggagacaucaauaauuggacacagcuguugcuuuagguaucuacuacgaggccaauuuucaaaugaugggcuucaaguuaaagaucauaacuauaauuauaaaauuacaacaaaauuauaagcacauggcuaucaacucuacuccaacucuacuaaaauguagaaaagcagugcaugagacugaauuuuugacaauuuuaagugauaccuggauugauauuuuuauguauuuuauuaguacguuaacuuguguuuagucauuuaugacaaguuauauuaguuuugucucccauuuacaugguguuggaaaguuucuauuucauacaaauuuaauaauuuaaaaagaaaaaacuaggguaacaguauggagauguugcacauuggacauuuagggaucccccagaguaaugaaauucccauccacccuucauccuuucuuccuagagggacaccaccagccaacaagauccuuaugauacacugaaaacucuugugucagaccuaaaauugccucauuuauuacaacauuggcacagggcaccaaagaucacaaaacauauaagcaaaggcuaaaauauuaaagagaaauuuaggauaaccaaaaggaaaauaaaaaguacuuccagagaaaauggggaugauauaggaaacaagaaaacuuaaaagaaaaaaaaagaaccuaaaaaacucuaaauaguguccucugagcaaacauggcauaacuauaaaaaacuagaggaugcaaugaaaaaggaauaacaggaaauaaaaauagcucuuagaaguuaaacauauugucugauauuaaaauuaaaauaagaaaaagauugaguaaucuuucagaacaaaauacaaaaaaaaauugaaaaugugggaaaagagauaagaaaugaagacuugauaaaggaaaggagauccaacaccuaaauaacuggagcccauugagagaauucgaaaaaauauuuuucuuagugaaagcagauggcaagaucucuucucggcuacugucaaguacugucaaaaacccaggaaaugaaucccaaauagcuuaauuauaaccauaacaugcaaaaggcgugagcacacauuucaaaaguguucuauuauuuucuggaugaaugaauaacuuccuagucaauuccagggucauugaguuuacuuaguagaaugaaaauguauucacaaaauaucuaaaaugccaguugcugaauuuauagaauuauacaacuguacaagaauaacugaguaauggagccaaacaugacccuaaaacucaaacucugacuaaaauaaucauaaaccauauucacugacuggcuaaacauuaucuugaaaugaaacagucccucacuacaaguuucgauuauucuaaaaagagacacaggcccuacagccaugccaggaagaagugcaagaaggggcggagggaggcagcugagaaagagcucuggaccaggugcuuccagauuuagaugcuaaucuuggcuccauuacuaauuagugguauggcugaggguaaaucacuuaaucccucccugcuucagccucaaccauuggagcagagaggcaugcucucuauucaggauccacauaagagacuucccaaagcgaagcuguaauauuccauuccugcuggcagggaacaggcacgcagacaguagcgagcucgcacaaagccuaugccagcaacagccacggaucaaagacucugcugaggaggucaguaagcaggaggaaggcgaugcccagggacagaaggaucaacggcagugucacugaagccugcuuaacuuaagcaggauaauaaagaagacuuucuggugugauacauuuacacagagaauucugggcaagucuauuugggcaauacaauauugugcuuauaacacaucagacuuccccaccaagcaaaacuuucaaauggacuuacugugggccagaacaauacaugaacagagccuuccgaaguacuuucagaaaaaaagugaugcuugugaagcuuuucucugcucacuccugauagaaacauugucagaauucacuuuuuuccccugucaaugccuuauuccuuagaggagcacaaauuuuuauacgauuucaggagcuaacuuucaaaauuaggaugcagcaacagggugcaaaugcaaauaugcaggggcaaagcaaguaacaaacguguucacagcaggugcaaacugcagccccucugccuagcauaaaaguggcagccaccagccucauuuugccaaauaugcugauuuuuccagaugagguagaaaucuggcauuuuaaaugaaacaccaaaguuuguaaaugugagaaaauaaugcauauguuuuacacauucuaaaggccagacaaaauaugcucaugggcaguauccuuccugcccaagggugaccaguuuguuuccuauacuaauuauuuuaaaggacuuaaaaagucaauaaacccuucugcuaaagaaaaguaaucaugcagaauaaaucuguaagacuguugaauggaaagaaaaauaucugguucuauuucuuuacacauaugcugacuucaaucuuagaccaucauaaagcacaggcagaacuugagccuggggccccacauggcaaaguucaguccugucaacacgggccccugagcuuuuaaaggccuuguuugugaagaugaguguucacacauguacuuugacuuguauuuuucucaaccuugagaauucugguuccaguguacaugagguuuagggcuuuucugccgaagaaaauuagaaaaaaagaguugagaaaaguaaagcuaaauaccagaaacuagucccaacacauuuuguugcuuauuuugucucuguuccccugucccccaaccccucucuauauacauaaauaugguggcggugguggggacagguagguagagacagaucaggaaacgugacagagagugaguuagcauguccugcuggcacgaaccuagccugguggcacugaggccuccagccuugugugcagaaggaggccucaggcaacaccugcacagucagggugaaaggaaucaagacagcccaaagcaucuuuuaucucaagaaucuaucuuuuugccauacaauaagaugacucccuugucauuaauucucaaaagaaauuaaauacuaagcuggaacacucgagggagaaaagacucugaacuacuguaaagguaaauaagccuacgagugggucacccauccacaggaguggagaugcugggaguugagcaaaacaagugcaaucacacaggcaguaaacaguacccgcacugcucauuuguauucuuccuagugucccuuucuuuacuguuuccuaggaggaaacaucaacauuguuuaaaaacuuugaccagcaacuauuuuccuuaucccauuucccucccacaagaucuuaaauuccuccagcauuagcucccagugaagaaggcuuuucaggaucauaaacucugcaguuugguagacuccauuguguuauugaagugaaguguaggggcucuucaaguuaaaagaaagaaauacuuacgaaaaacauacacuuggccagacugagaaguucuaucugggaagacuagacugcacaggaaggcaugaauagcuuuucagaaagagggaagcuggaacaaagugauguuucaaggagauuaacuaggacauagcugcaguaacaaagauguaugcaaaauuuaucaguauauaggucuaguccuagcaaaaaucuaguccucaaagagcccacauaacccagcacaaggaaucugaaaagacugauaccaagaugcaucacugagaauaucaaaauaucuguaucaaagauguuacaaguuuccagggaguggaggccauacacaagggcucaggaauaagaacaacaucagaauaaauuagucaagucaggccucugugacuugcggugugaguguggacaaacccccauuguaacacagggauggugacagcaccaccuccagagcagguuacggguguacaugagacacugggugugugacccauaaauauucuugagaaggggaggaacacaccagacuuuuuagcaauaaaagcuaaaaagaacaccuuccaaaauacaagugaaaauuauuuucacacuugaauucuauacucaaacuguugaguggauaacauauauuuuacaaagacaugcaaaaugucaaaagauguaucaccuuccguguacccauucucuggaagcuacugcaggacaugacugaccaaaaugagguacaaaacaaaaaagaacaagagagaaaauauacaauccauacaacuggagucagaaccuagaaagaggccuugcacacugccucugcuguguguccgggccacacuaaaauggcugccauuccacagcugccagacccuucaggacuccuuaggccagcacccuuuuucccuucuugcuaauuucaucugcacccuccucaagucagcagugaugcuccuagcaggagguauguuugucauugccucugagaguccacagguuagaugccaucugcugcugcuuccacaacacuuuaauuauauuuaugucaugggguugcacaauucauguuccauaggccaaaucuuacccgccucuugauuuuguaaaucuuccuagaacacagccacgcccacuaguuuaaguauaaccuaugacuacuuucccaugacaauguuagagcugaguggcuaggauagagauugaaugguccacaaagccuaaaauauuuacugccuggcccuuuacagaaagaguuugcugacuucugcucuacugcuucacuuccuaaucuuauaauucucccuacagaccgucagauccuugagagcaaacacauccgaguucacuguaacccucaguguccaagcaguaccuggcacaaagcagacaccaaaaacucuaagccagcuggcugaaugaauaccaaggcacaaauuauuauaugcccacacaguauacuuucauuguuaggcugcaugcuaacccagguacugccaacacuaggaacccaaguuaaagcucuggcucccaaacugcacugaggcaccccaagacaccaaagcaaacugacagagcuaucacagaauaucuaaguuuuugaaggaaauaaagugacaucuguccaacacucugaaaaccguuaguucaagguaguccacaguuucaauauuugcucaugcuacauuuuuuugugugacaucguaucuuuaucuuuggugaagagagggagggacuaguaauugcugggauaaaacacaaguacuacccaaacaaaucaauguagaaauggaaaugagggugcugguuuccaagauuugggaagcuaugcaguacucaauagcuucacacaucucaucaguaauuaagguuuuuuaagaaugaaauaaaaauacuaccauagacccuucauaucccaggguucugcaaccacagauucaaccaaccuuggauugaaaauauucagaaaacaaaaccaauaaaagacaacaguacaacaauaaaaaaacaguaaaaaaaaaaguaccguuuaacaacugcuuacauagcauuaacacuguauuagggaugauuuaaaguaaucuagagaugauuuaaaucauaugagaggauaagcacagguuauauacaaauaccacaccauuuuauauuagggacuuggcauccaaagauuuucacaucugugaaggucuuggaacgugcccccacagagauagagggacaauuauauuuuuccuuuuaaguggauacacguuauuucuucaaacugcuacuaaagugcuugaucauaaauacucauuaaauuguuuggacccagcuauuucauaaagagaacuguuagguaauucuuuugacuacaagcaucauaaaaaacauuaacaaaacacgacgggcacugugaacuaugacagucuggggaccugaguuagaggauagcuuggcugcuuagggauuccacuguaucauacuucaauaugcguucugcauguaggaaaauaauauugaaauuuaacauuugcuacauuauaaagacaaaucuaucacugugcauaaugcaggauauucauuccccaaaauaacuuuuuggucuauuauucaaauagaauaaucuugucaauuuuuuuuucuuaauuccuuugcauuuccugggaacuuuuaaaaauagacugucuuccaaaguuuuucuuuuucaggauccuccaugucaguuuuaguaaucuccauugcaguguggacuucccuguuaauucaagagccaguccauuaugaaccucagcaugucaaaacaaguuugaauacaucacuuccaugcuuaaaauccuccaaaggcucuccacuguuucaacacacaguuccaguuccauacugugggcacagcccuucgagacggccaugaaccccuuccucuccauaccgcagcagcuccccaaacacuccacauucccuuuggucucaaggccucucccaaaaccacugccuccaauggagugcccccugcaaugucuccuauauuucccauucuuccaucuuucgggacucacgcuaucauacuuuagaguaacaucugacuacucauaucccacuucaacuacgcuauaagagugacugguauguaacagucuucaauaaauauaaaagucuaccaaacgaaugaacuuguuucuucccuuuuaacgaugaagugcucuauuauuaaacaaccugaagaacauuccuccaauaaaucuuuaacaugcaggaaaacaugacgaaaacuuaucucuaaaaagaaacaggaacaucuccauuucccaguacuucucacuaauaccaaggauugucuuuaaaaaaaaaaauuauucuguugggccauaaauggcauuucuuuuuauugcguaauuaaaauauccuuucauauguuuauugauaauuugcaaugcuuuauuuauaagcuguuuauucucuuuugcuccuuuuucuaauugggcauuaaucauuuccuuaaugauugcuaagaaaaaaaaucuuaauaugcauauuaacucuguuacauacauagcaaauagauuccccaaucgcuuuuacuuuccagugagucuuuuguuuaacucuuacuagaucagauuucucuauuuuguccuuugugguuucuaaccauaaagguuuuucucaugccgggacuaugcaaauuguccugauguugccuucaaguacauuuaagguguuucacauuuuaagcuucaugccauauaaaauuaauuucaguguacaguugagucaaggacccaccuuuucuguuucccucuaagugguuaccacuuaucccaacaccacuuauuagguaauccauuccuucucucacugacuugagaugccauucagauucuauuccuacuuagcuuccuuggugggacuccuuagccuacugcuccuucuauccuucacuuccugacugaacaguauuaucugugcuuguggcuauaacaucacuuguaugcuaauuacuuccaaauccguguucccaggauuggccucuucccaguuacagauuaaccauucacuagacaauuucuugcuuacuuagacaaauccacucaaguaagguuccuucaggcaugacaaaauauucugaugcuucauauccacuuggauauuucagauuccucaaaaacuccagauguacugaauuaagcucacuuuccccuccaaaccugcucucuuguagccccgucuuagcccauggcaccagugucuucugaguaacccugacucuuccuucuuccucacaccucccaccugacuugccacuuuuaccuaaaacaugccuugacucuuuccccauccucucccuccaguccauuucuacugcucuggaggcugaggcccuccucacucucuggcauacguaauuuacaacccucuggcaagggccucacacaauccaucuuccauagugaguugcaaagcuuuaaauagcaucuauaucacuaacccuaucauucuuugaagcuccaggccaaauaucagaaggcuggcccaccaacagcucagacaaccguccacacuaaaauucacacgucuauuccgcaaucuucuuccaccuccucuacuccuuuccuaggggcaucucuuccucuugguucucucuuuuuuuuuugagacggagucucgcucugucacccaggcuggagugcaguggcgcgaucucggcucacugcaagcucugccucccguguucacgccauucuccugccucagccucccgaguagcugggacuacaggcgccugccacugugccuggcuaauuuuuuguauuuuuuaggagagacgggguuucaccguggucucgaucuccugaccuagugauccgccugccucggccucccaaagugcugggauuacaggugugagccaccgcgcccggccuuccucuugguucucaugcugaccacuauguccaaccagacacagugcucuguuuaugcucccacuggacaucaauuuccccuuuaggcauuguucuuaucauaccagguauuauggaaaucauucucucccuuccuuccacccucuuuuccacuauaagcuaagaucagagccuuaucuuuguaaaauccauagucuaggagugcuuuauauccaccacacguacaagauuuauuuggugacugaagcaaauccauucaaauagaguccucggugaggacuuaaaauauuuucauaccauucaguuauuugucuacauucugaagaguaagcugacaaacuuuaugcuuuucaaugaaccuguuugcuauacaaaaauucauuaauaaaaagaauacuggcucaaauugaaguuuuuuugguuuuuugggggggguaauacauagaguaaaacuaucccuaaaggccuuucuaaauucuaggagggggaaaaauacuaauuacacaauaauucuaucuagguaacaagcugguuuuagcuaacucuaccauguaaaauauaauuuauacauauauuucagauauuaugcauuauuuaaauacuguuuauuaaggagcagccacuuuucuaaguucuuucaaugaaaaauuggauuuaauuuucauaucaauccuauaaggucgguauuauucauauuauuucccucuuuuuauaauaagaaaacugaggcacagaaaggucauacagcuaguaaggagcaaagugggaucuguagccaacucugacugcaaaucucagcuccaggccauuauacuaaacuguaaaaugagcaacuaagcuggagucaggaguccuggacuccagucccuauucuaccacugaauaggugacagguaggggcucgcagauaaaucaccuaacaucucaggucuuagcucucaaauuacacaacuaagacccagcaccugcuuucccuacuuuaaguaucauaagaaacuuacgguuguuuuguuuucagaaaaccuuguuugucaccugcaggaacaaacugguagauguacaaugugauuagaaauucagcucucccccgaccuguccggugaauacuguugcugggggaaacaccaccugcucuaccaagcacuuccacuaaucacauuauaacaaagaucagacagucuauguucagagaacaaauggaaaauaacugccaucuuacuguucuccuuccaacucuaaguacacuuuuaauugguuaagcucucaacucagcaggugcaaacucaaacauacuccaagagccagccagaugaaaugacuggagccauucacaugacacaggcuggcgggcagccccucgccagcuccuugugucuguauuacaccacagaggacgagcggccaguacagccacagaucuuccaguuuuuccaaaagggcaggaaauccagguuguugcuuuuuuaguuuuuuuuauuauuauuauuaugaaauauccuuauuuuuaaaugcuggcaauuaauuccaauuaaaaaaaaaacacuaugugggccaaacaaaauacauuugcaagccaaauauaguucuuagggagccaguuaaccugucacaaaauguacuggcauuaaaaaauucuugucuugcugcugaaauaaucuuaaaauauaaacuguuuuaagaccuagauuucaaugcacagauguugaccaaaaugugccugaaugcuuucuuaacauucuuuagggucagaaucugaagcuuuccacuccaaaauaauucaaaauuuuuuucuuuaugacauuauuuaaccccagauaucaaaaucuuaagcaucaucuuagauuaugcuucucaaaacaacaacuaaaauaaagccuuuagcucuggcuucagaccacggucuacaacaucuaagcaggugaaacaucuucuauguaagaguggaacagcauaugaaaaacauaacagcaccuaaaauaacugauauuuggcaaagcuauuucagaaaggggcauucuuguuaagaaauaaaauccuacagacacagaggccugugagcuugauaacugauccuggauaagaugaucaacaguacuaagaaaggaauccuagaaaaccucagacccaugcacgucagcccauccuuagccucgacuugauaagcuguuguacugggaaaagcaaggaucagaaacaacaaaauguaucucuguuugaacaaaaucuuuucuaauacaugaaagaugaguauuagcaagguaaagaaauucaagcuguguaaacagagugaagaggcugcuuuuaucacaugaucaaccuuacucagagugcuaauucauaggaugaugucaaccuggacaaaagugauauagacagauaucaaaaacuucuguuuuucuugguaucuucauuaaugaguugcaugaagauauaggaaucauauccaacuuaucuguggauggaaaaaaaugggcaaaauagcaaauauacaggguguaauaauaggauucuaauaaauaaauccaauaaaauaaauucagcauggaugucaggguccaaaaugaaaugauaauguugauaacaauaacacacagaaaaugaacaaauacagaugggaggagauaugauuuagcagcaacacacgggaaaaccacaaaaaaagguuaauaagcugggccaauauuguaagauggccauaaaaauauuaagaaggacuacuuuuuugucuucucacuuuaucagacacauaaugucuaaaaucguguccuccagugguauuaaaauuggaggauucauuuuaguuugaaaaauaaguagauaaucuaauaucaaaguauuaacaugaaacauaaauuaugauuguugguuuuauuacugcccaagucaucauaaauucuugcucaauguaaaucuuacucuaguaaaucccaucucaccauaagugccagcuacuaccuauuucauagaagaaguacccacauguggggacacuugaacguuuagcaacuugaggguaaggcaucaauaaaucuguguuugagagcuuuaaauaacaaauccuuuuuuauuauguaaguuuaaucagaagcuuuauaaaaaggacaugauagaagacgguagaggcagcaugaugccucuaguuaugacuaccacuugugccacucccucaacuuuaccagguaaauaaggacaaaccuccagagucgggccuaguuggggccucuuucccucagccugcacaaaggcaaugcuucuaaccggucucaggacuucugauccucccauagcacaaauucaguuuuguaugccuagaauccuccauggcucucccuggccuacagggaaaggucccaaguugaacagggcaugaggcucuagcuuuuucaugccagccuaaguccccagugccaucucugugcaccuccucacaguggccccgugcuuaaguuccaccaaauguguaaacaugucaggcucuguggugccucaguguucccgcacagacagaucaucuaccuggaauguccuucccacuccacucuuccuugucccuuuaacaaauaucaacucguccuucaaauuucagugcacacuguuccaaauccaaccuuccccaguguucucaggucguaaugcauaugcuuacauuacuacauauaauauuauauagcaaugauuuauaaaaccaucuuucucaccaaacugagcacaaugaagauuuuuucccugggaaaaaauaugugcaacaaauaugacaagugucacuauacuuaggauauacaaauggcuaaaaaagaugcuaaagcaagaugaauaccuucaauagaaauaaaaauaugcaacucacauacuaagaaauauaaauaggcaauaaacaugaaaaugacgugaaaccauauuucuacugauuggaaaagguuaauaagaaugauacuagauacuacccuggacaauguggagaaauuggaacccaaccuguaguuguguaaagccacaggccacaugcuccagggaggcccaagcacuuaaccuguacucucucaacccuccaaagagguuugguauuuuucacauggcaugcaugaggaaauagauuaagugacuuauccaaaguauuguggcucguaaggagcaaagccagaauuugaaccuagacuugcaauuaugacucuagagucugaauugugagccauuauguugucuuuccaauugaaagccuuucacucaauaacaguaagaaugaugaagauaaaccaaggcuacaaauauuuaucaagagcucacuaugugguaggcuccauucaagcacuucacaugcaacuuaugaucuacuucuaggaaauucuccucaggagauaucagacaagauuucaaagguguguucacuaaaugcacuuauaauuuaaaugaaauaaccugaauguucaucaauuugggauugaguaaagaagaugacaucucugcaugcauuccagcccacuucucucuuucuguacucuuaauaauuucucaaucauguuaauuaaaaucuauaugugguaauuuaaaaauuuaucuuacccuuccuuccucccagauuuauaugccacuuucuaccugacuuuucuccagauauacguacaacuugucaccuggaagucucauaggugucuugaacuauguccaaaacugauugauucauaacccuccuaaauuuguucuuccccuaaccuacacccucucaaaauauagcuaauuuauucaagcaaaaaaaccuagcagucacccuugagucauuccuuuccuucccuaucggccucuacccacuccccauguacuaccagcugcuacaccuucaaaugcaugccgaaggaaaaaacacccaucauccucauugccacccccaaauuaagcgcaccaaccucuuuugccugaacugcuauaagagccucugaagugguccucuuguuuccagucuugcuccccaccaauccacuccgcacaaagcagaaccuuucaaaaacagccaucagaucaugucacuccccaguuuaaaaccgucuaguggauucuccuuauaagcacaccccacucucuguccugcauccccuuccacacucuucacauacacgucucuccuuuggucaccggcuuccagucuccuccagggccuucuuccauuccucacaugcaccaagcuugauccaccaagggcccuggcacuugucauuccuaucauggggaaucaccuuccccugacucuucucaucauucaaauuaacacucacuuccucaggaaggccucuacucaucaccuagaaagggggacaauucccugcuugccucccucccccaaaucccgcaccacaaccacacacugcucacucuuccuugugguauccuauuuuauauccuucagcguacacaucaauaccuagagguaucuaugcauacauaauuccugacuuauugucccucccuccccaccuagaugcugagcucuaugaguauccaguacugaauauccagcaugaccugagaguucagcauagguggggaggaagagacagagagcaggcuccuguucagcacuccucuucagcgcuauagcccccaagagcuagaaaaacugccuggcacacaaaaagugugcaguaaauauuuguuaaguaaacugaauaauggaugaauaaacugaaucuagugugcaguuaugcaccauggaagauuauuaauauaaguuaaaaaacuuaaaucauggccaggcacaguggcucaugccuauaaucccagcacuuugggaggcugaagccuguggaucaccugaggucaggaguucaaggccagccuggccaauauggugaaaucccaucucuacuaaaaacacacaaauuagccgggcgugguggcggacgccuguagucucagccacucaggaggcugagacaggagacucacuugaacccgggaggcggagcuugcagugagccaagaucacgccauugcacuccagccugggugacagaccaagacuccgucucaaaaaaaaaaaaaauuaaaucauguuacaagacagaauguacauacgguuuaacauauuuggagauguagacauaaauauauguguguguguguguauguguguguguguauacacauauauauaugcacagaaauuaaucuagaaggauauguaacaauguugccugggguuaucucugaauggugaaacuaaaauuuuuuuuuguauuuuuacuuauauucccugagcuuccuuaauuuuuauaaaaugagcauuuuuacuuuuauaauuuuuaaaaagcuacuuauguuuaaaaaaauaacaauccagggcagggcacgguggcucacgccuguaaucccagcacuuugggaggccgaggugggcggaucacgaggucaggaaaucaagaccauccuggcuaacacagugaaacccugugucuacuaaaaauucaaaaaauucgcggggcaugguggcgggcgccuguagucccagcuaugugggaggcugaggcaggagaauggcgugaacccgggagguggaccuugcagugagccgagaucacgccacugcacucuagccugggugacagagcgagacuccaucucaaaaaaaaagaaaaaaaaaaaaaaaagaaaaaauccaauguaaaaucaaauaauggauaaaucacaaaauaaaaccagcuaauaaaaugaacaaauauuuuauuuccuaguauucaaauaaauguggagaaaauucaacuguaucaaaagucuuaaagauauuuaguuguuuugacucaauaaaccaauuuuaagggaagaaugugaaauuuauuggagaaggggaaaaauccagcuuuaugcuuaaauauauuuacuguaacuuuaauuacgaacuggaaaaauuuaaaacaauguaaaugcucaaguuaugguucauccagagaauaaaauguuacacagucaucaauacauacuaaagaauuuuuagcaacaugaagaaacauauauacgccauuacaugaaaagauaaggaacaaaacugaauauccaguaugaccugaacuauaugaaaaaagugaaggaaaagaugggcaaagaaauguuaccuaccauaguuuaaaacuggcaggcuuugccuuuagauguguuuuguuugaaccauauacauaaaaaaaacaaaauuuaaaaacccuugaauuauuugucaauauugcaaaauggaguguuuaaaaaucaaaauuaagaagcucuggaaauacucauuccacaucucacaggauaacaaucaacuccagguaagagcaguuacuccuuccuaagaacauguguucuggaguuuuucauaguucucaccuuuccuuacuggucuucaaaacugagacaaguuccaguugccauuuaccaucuagauugucaauguugucuaucuugcaguagaguuaaagagaaagugauauauuucugauugucucuauaucaaaagcauaaagacaaaaggcaggacaggcccacuucugccauuuauguaacguccacugucccuguaagcauuugaguuuuugaucccagcaaugcagccuguggaauguacugaguucagcacucacagcuuugacuauuugugagcugaaaaaguuucaaaacagucaucuguaauuuuauugaagcuggccuucaggaaagggugaguuggcaaaguccuaagucuagccagcgacccaaugucuacaugucaacacagcuugguugcucuccagucaccauuacauacucagugcagcucauacaguguuucuuugugaaaaguaaauccccaacacccccaaaagaaagcuaacugccaguuccagugggggcaaggggaguaaaguccauguaaggcaaugguaugggguagaacaaugugagauagaaguaauauguaucuauauguacaauuugucaccugcaagucuugucaccuccagugugacgagauagauagaauacauaucuauaugcacaacuugucaccugcaagucucacacguaucuuaaacuguguccaaaaaugauucuugauucauaacucuccuaaauuuguucuuccccuaacuuacacccucucaaaauauggcuaauuuauuaaagcaaaaaaagaaguaaaauggugacuuugcuguugguuacacaaccugugauguaacuuauccuaccaugaauucuacacaggaacaugaaaacaugacucaagaaauuuucuuuuuuuuauuuggccguaugaggaaaauaaaaugcaagcucaguauuugucauagauuccaagacguaucuuucacgacuacugagggucuacauguuaucaaaauauuuagaacaguugccaacuuuaaaaaaaaagucccuacauaaaacuaauuacaaaacuaauguaguuuuacacacugucaaauggagacauuauuuuuaaauauagucacgugugcuuaaugacaaggauacaguucugagagacgugcuaggcaauuuuguuguugugugaacaucauagaguguacuuacacaaaccuacaugguauagucuacuagacaccuaggcuauaugguauaauagccuauugcuccuaaggcuauaaaucugugcaccguuacuguacugaauacugaaggcaacuguaacagaacggaaguauuuggguaucuaaacauaaaaaagguacaguaaaaauauaguaucauaaucuaaugagaccaccaucauauauauggucuguuacugaccuaaacaucuuucuaugguacacgacuauaaaugcuuuauugccacucucucucaguaagaucaugugcuagaauuucucaagugggauagccauaaauuccaugcauccuagauuugcuaggaggagcucauuuucaauaauuuuacaaaagauaaucucaaaaaggcaugaggucauacuuaagauaaugaaagauuauccuucacagaagauauauaguagcaauuuuaagccuauuaaccuaggauauucucacacuuguguaauguaagucaucacuaaaucauucaugaaugucaacgaagugaaauaaccuaguauguuccucauauacaguaguuuguugaauaagcaggaggcaauguuuguguucaguaagauguaacaucacaacaaaauuccuuuuaaaaucagaggagagaaaaugagaacuacuugauacuuaacugcaguaacuaucuauuuauugagugggccuccuggcuuugaaccacauuggucacuuccauaugucauucacagggcagagacauguggguccaggacacugcugcaaaucugaugccuaccuagugccuguuaaagaaaaggcacucaacagugacuugaaugacucacaucccacucuaacaccucuauaaaaggaaagaaagaucagacccugaccuucaaaaauuuauacaggacuauucaagacaacaacagaaaaagaagaaaaaugccuucaauucaaaauaaaauguauuggcaauggaaggcauuucaguuuuaaaguaaauaaaacucgacaaaguauuucccagugaccagaagcaacaaaauaguuugucagaaugcccugaaaugcuuuccguaacaguuugauaaaacuuacauaacacaauuauucugcuuggaaauucuguauuaagaauagaauacuggcuuuaaucaccauaucagaucagugagaucaagguaacguuuauuaaauacuacaugugggcaccgugagcuggauauuauuauccccauuucacagauaaggaaauacaaaacuugcccaaguucacacaaccaguaguagcaaaugggaaaugggaucugauccaagacucuucaccacacggcaugcuuuaugugugggaaauccaggaaaguaaaaagaauaacagucaauuguaauuuccacacaugaaagacaguaucaccuaacauucggccuauagucuuccuggcauuuuacuacauaauauguagaaaauuguacacacacacacacacacacacacacacacacacacuccauaagcaaaaacaaggaucaacguacccauauguuuuacaaucugcuuuuucaguuuacaaauauugaguaucuuuccacaucuauaaauauuccccuacaucacuguuaaagaaaggguauucuaucacauguaugcaccacaauucauuuaaugagucccccuauuauugagcauuuaagguguuucuaguuuauaacuauuauaaacaaacuuacaggcugguuacaguggcuaacgccuguaaucccagcacuuugggaggccgaggcaggcggaucacgaggucaggagaucgagaccauccuggcuaacacggugaaacgcaucucuacuaaaaauacaaaaaauuagccgggcgugguagcgggugcccauaaucccagcuacuugggaggcugaggcaggagaauggugugaacccaggaggcggagcuugcagugagcugagacugcgccacugcacgccagccagggcaacacagcgagacuccguuuccacacacaaaaaaaaacuuacaaaaauuauuuuugcaaauuagaggaggguuuuuuuaaauguauuuuuuuugugguggucacuagaaucuggaagugaguuuuuuccaaauuucagaggaccucccuccagauuuugguacaucccaguaaguaggcuucuuaagaaucacugcgaggagaaagguaucgacaggaguauggugcacaaaugcacuauaaccacugcuaaagacuggucacuguacacauacuuuaucguuucuccuuuguuuacauugcuagcggugaacaugccugacuaagggacggggcacauuuuugaggcuucugaugaguaauacaaaauugcccuccuguaaaguuauaacaauugaaacacccaccaacagcauuugaaagugacaauuuccaaaauccuccaguugauuagauuugguuuuaaacaaucauauccccauauggccauaaauuuuuaaaauagcugagcuauugauaaagcacaacugaaaaaaaaacagggaaaaauucaaacaauaaaugcuagauuuuaaagcaucuguuuucaaauacaaaauauaaaacuuaaugauaccagauaccaguaggcugaacuuaacagaauggcuuuagaaaauccagugauaacagacuuugaaagguaccaagcuaagauguaaaacacugcaccuucguuugccugucuggcuuaagaguuuggguuuuaauagcaacaugcucuauuuuucuaacaagaaacucauaaaacuguauauucuuucagauuguauaaguacugucuuauagcuaacauggcaaucugaaguucuuaaaauuccuuuagauaaucacuuauucaacaaauaugugaacgucuacuauagacuaggcacuguucuaaugcuagggacacggugguaaaucucgcaaaaguuccugcccuugaggagcuguugguucuagagaggaguugagaacccugcacuuaaagaguccgaagaucaugguuacacugccaaucaggacuccuggauucuucggcaaauuauaacaccaccucugggucuaaguuucuuuaucuuaagaagcugaccagauggaucugaagggccuuccagcuuucaaucaaguuaucuacuuuacuugauuuuuguuuaagugcuuaauuuucuauuauucauaagagcuaugcauuuuaagcucuaaauaguuuuuccacaaaaucagacucucccaaaagaacaauuuuacauuuacaguaaaauuguggugauccaggcaacuucaaggaauaaauguagucaugaugaaguuccagcaagaagaaaauguaugcuccuaacuuuaacuguuucuauggagauguuuuugcaauggucuugccuccuucaccuuuguacugcauuauaaacacuaaggcaugaagcauggcagggcuaugggucuccaggcccguugcauggaaacaguuggcauccuguccccaugcagcaggcgccuuagugcuuacuguggcacucggguguccucaggggcugcagccuaaaguccugguggcgauucucaucucucucccacucaccuuaccuccaacucgacagguacaacaauucugccugaagucuacaucucacugccccauuagcauuucugucaccucuugcuauuuuccaccagauguuccacaauucaacaguccucggauucaaggugucuuuggagaagcccacuuuggggagaaguuaaaagaagguauugcaagaggccucaguauuccaaggcauucucuggaagagcaccacacauacacuuuagguagugauaucaccgccuuguggccucuaaggauacugccgcuuaguaauauagcauauaaacaaugauuccaauucuuucucuguaucugccuuacaaaccagaagaaugauuggaagccaagauuuucaccucugugcaaaaguauagaaaaaauccaccuaccagaaguuuuuccucaacuuccaacaugaaagcauagaauaguaucucccaaacacauaucuuugcucaccugagcaguaccagcagcaacauccuauaagaaugcauguguugucauuuuagacaacguaagacaaauuugcaauucccauauuucacaaaaggaaagguaaaggaauugguaaaaguacuuuaacucgggcaucuaagccucuaaauuuaccccaacugguagguguuucuacucuuuuacugaagagcuuuuacuauaucaggacaaaaggacacaggcuucuuuacugaagacugaggaccuaaagaacccuccuuuacauauaauuugcacagaacuuaagagaaacaguuggaaauaaaauugucuuaaguagaaacugcuuauuaugcuaaguuauuaauugauuaagauaggaaauaaaaaaguuaaaaaccaucauucuggaagaucacaacacuucuaauauggaacaggaguccaaaagucacaggagaaagauguagauucuuauuagacaucuauaacaauugcuuggcauaaaacucauuucccaaguuuucaauuaauauuuagaaugacagauuagaaguugggaaaaggaaaugccacaaauuauugauauucccuauagggcaggcacacauuccuccugugagaauaaaaguaccuacauauauuuuaucuacucauuagucugucaucuggcccaaagaauuaaaacauucaauacacacacccacacacaaaaggcaucuuugaacucuuacacuuauacaaauggcuauuccacggaaauaaaagauaaaaaugcucaccuuucugaaaaucucucauaaaucacuauaauuuacugaaaagguuuguuuuuaagguuuuacacuugaauuucauggaagagcagucaaguguaauugacuuaaagcaacaguuugacaaaagugauaauuugaaagaaaagugauaacaguauaaccgauuggcugaugucaaaggccagagccaagcuggaaaacuaaaagacucccgaaucuaaguauuuugaccaaaagcagguaagauuauuucguaaauucucuaauuauucauuuacucaauaacuauucauagcccacuaugugaugaaggugguuccuggugcugcaaaugcaauggguaacaagcagauguguugcuagcccccuggagcuuccagccuauagaggaacuccaccacucacaucuuucccacgucuguaaacauuucuugacaugcaacacauaugggcaccaaccccagcccacucuucuucugccugcagcucucuccuuuccuuucaccaacuccagccacagaggugguccucugucccucagguaugcaaggcucaguccugcuccagggccuuugcacuugcccuucccucugccuaagccacucuucuuucagaucuccaaaaucauaggcuucuucccccucauucaacucucagcucagaccccuccaccccagagaggcuucucaggccacuugauguaaaacagcagcccacauccugucccauucugccaugcaacccugauugcuuucuuucacagcacuuagcacuaucuagucaccaucacuuauuguaucuuugcuucuuauccaucuccuucgcugagauuauagcagggucugucuguccugugcagugccauaauuuagucccuagaaaguugucuggaauauuaacagaugcccaauaaacaccuauuucagaaaaaauacagacaacguuagcaguuuuguaucacaacaguaccaaauaaaaggcaagagaaugccuuaaauucuaagaggaguuuggaccauuuaaacuauauauauauauauauauauauauauauauauauauauauauauauauauuauauguauguauauauuuuaaaagauuaugauagcuuacacuaguccuaaaagcccucaaaaauaagcauaaugaaaauacugaagcucaacauuggcuaauguucaagcuuuauaauguauuaggcucaauuucuagcauuagcauuacuuuuacaauuuauucuuuuucaagagcaugcugacgagaccccaauuuuuuuguuuuaaagaaaagcaagagcuaaguauguuuuaaaagcauccauccccuuaaaaguuauuaaccccaucauaaacuguaaaaucuguaaccauauuauacuaacauuaaaauauaagauacuggugauaaucuacagaaggcagggauuugagugccuaauggcaaccgaauuuuaugaaacauaaacuacccucaucuucaauuuaaucaaagguacaagcugccucucuacguucaaaaauauuuaaacacuuaagaauuuuuccucagauuauucuuuaaaauguguaucuguuccuucuuuucuuuuguuaaaacaaagagccaaguuguuacccaaggaauaaugacuuuaguuacugaccaucauggcucccacuucacagcaaagaugccaaagacucuuauggauuacugugaaguuauauagaagcaaacaguguaugcuggggagaaggcacacuuauuuccuggaaggugauauaaagaaacaaaugacuacugccuuuaggccuuugggaauaaccaaauccacuuaaaaaccucaaaaacuaaugcuuuacaauuucauagcaaauuauuagaaacaaccuacauauaucacaaugaagagauuaaauaaauuaugguccaucccuaauggaguacucagcagcuguuagagaaugaggcagauucucuuagauaccaauggagacugccaugauuuaguacucuggggagggaagcggggcagggggagcuggugcacaguauacaauggguccucaucuuuaggaauacaaacaaaaagaacacguacagaauguuuacaugagcauaggcuaugucuggaaagacauacacaaggagccaguagcuguggaacaugaugggagagagguauacuccguaucuuuuauaucuauugaaucuucuccagugugaauagauuaccugcugcacaauuaauguaagaaaaaugcacacuauuaccaacauauuugucaaggaugaccauucagaagcaaauuuuucaaaaaucacaaaaguuuugcuccuucaacagcagagucccugauucucauuccccagaagagaauacaagucuccacuaaucaagaggcuugcuagugaucucacucaccuauuacaaagcaaagaagucucaauucaauucuugaagaggaaauagcugcuccgaucaccuugggaacacaucauauauuuaaauugagcuugcaacuaacucccuaaugaaguuuccaaaugaacaguugcccccgacuauaaagcauaaagucaacguagaagacaacuaaaagaauggucucguguuuuuaaaaaacacauuauacuuaggcuuccuuuucucugccaggcuuagacaagaaacucucugguaacagugaaauguaauuucagaucugugacaaaauaaucauguaaggggaagggcaaguagcauucgcgcugaaaaaacuccuugguuuuuccacuugugaaaaggaaagguuugccuuaaauuuaauuucuguaccauuucuggaccccugccuaaacgauacuacuauaucacauuaaucuuacuucaagcaaauacuuuuuaaaauuaaaaacuaaucugaaacugaacaggaaucggaagacaaacuuuaaacugaaacuuuucuguugaaagaauguaucuuuuaaagacacauaaaaagaaaugcaaagaaccgauuuccauauaaaugccacucaauaacaauacagguuauaacaauauuugacugcauuaaacauucaaaaaggaacacaaagauacccaacugcaaauaaaagaccucauauauuuuugguagcggaaugugggggguggggggcaaaaaucacauuaauucagauuaaucauguaaauucagaacacgugaugugcaguuuugugucgcucagaacuccugaauccagcuuugugcuuuuacacaacauaacagaaauggcaucuuucacaaagccuaacuuugaccuccaacacuuuaacuuuggguuuaaccaguacaccaccuucggaaguuagcacauaaaaauacagguaagucaaaugcacuacggauacagaaaggacgaggaacagguuuaaaggggaguugaagcagaggggcacgaaaucaccuggcaggucaccucuccgaaggaaaaacauuucaagcucccucccaucccccagguaaccucuggccucagaacucacugcccugcguggggcagaaguucugggcgcuggaguccgcgucccccaggacacgagggugacccaagggcgcgcggagagcggcgggacccggagcggcgcucuccggggucacuccccuaggacgcuccgcagagcugggagcgcugccccaccccgcccgggccgccccuggggaccccgcucggggcuccgcggcuccccugcuccgcgccgcgcccacccgcccccaggacucacgguacgcucccgcgccgcuaucuugccauccccugccgccggcucuguagccucggccgccgccccggggcugcccagaucccacagccgcccgggggcaggagccgccaaggagggggccgggcacaaugcgccgccgccuccgcagccgccgucucgccuccccugugucggcgcgaggcugcuugaggcggccacgggcgaagggcggcccgcugcgcuccgcgaaccccgcgggccgccgccgccgccagagccucccagaggcaacgguaacggccaccgccacggccgagucgcuccagccgggacugcggcgcgcgggggcggcgccugcacgccgcucggcugggggcgcagcgggcccggccccgccccugacccgccccugcccccggccccggccccgccccaacccgcgcgcccccgccgauccccggccgcgcgcccgcgcgcgcgggugcuccaaggagucggaggaacgcggccgcgcgacgggccccggacgccgaggguggugcuuccuccgagccuccgguggugaggccgcucucagaaggucauggaagcgcaggggagagcgaggcggccgagcccaggcaaauccucgagaaaggccgagugcgcgacggcucugcggggaggaccgcgccuccccgaaugcggccgcugcugccgcugcaaacagugccuugaggagaggaaagcggggaaccguguuuucgccgccucuguaaccacugcacacaagaaaaccagcuucugggagagggggaugauuguugggacuuugcgaauuaccuaaacagcccagggccgaggcgccgccgcucgcguccugguccuccugccggguguggggcuccccugcccgagauggccagcgggcgcgccgagaguauccuggagccaucuagucuugccucggaggcggggugggcuuauuugugcggagaagaaacggaucucuuaauggggugagauuuuuccuccguacauuguucccauuuccgcaguuucacuuggccucgguuuucuagcagaguaaucaccaaaugaaauuagcuggagagcguuugauggcgcagaaucacggucugaagauguuuacgcuguaugccggacgcguuugaugguguucucuucggcacaauuaauuuugcaaaguucagaaaugugccagacagagccccuggcacgcagucaggacucuacagacacaccuugaguaggaaacaggcuuguuuguuucaucugugauuuaugugaugcaccagcaccaaggccaacguguuuuuuaaagaccuuucgaugaaacuccaaagcaauuuauaaauuggcaaaaugaagcuuguuuuguaaaauaacucuuccuuguugaucauguaauuaaaugggcaacaaaacaccugaaaggacauuuacugaaaaguagacucccaaaacaaaaauauguauuucacagcuagauacggucgcuauuagcguccuaauggccaacuccauccaugugcguauuuugaacacuaaaaacgccuccuguuaccccuaagaccuuguuuggauaacauuuuucuauuauaaguacucgaaaccaaccccauuuaagauguuuacccuuauucuugaguccuugaugguuugggaaauuuaucauuauucauauugcacaauccugucacugucuuuuccauuaggcacagugccuaagguccacaauauuuuuagaggcccacaaaaaauauuuuaauuucuuuucaaaucagaaggaaaaaaaauuuagguuuaagaaaguauuuuaauauauauuaauauauuuguuuuugugcuaauacaaucuuaaaauguauguauauauguguguguguauauguauauauauuuuaauggaguaaggggcucaacgaaggcaaaaaggccuagagcccaagaaaaacaugauguggcccuguugccugggguugaaaaaucccauuccaugagaagaauuuaguuuuaagaauauuacauaaaaugcucauuucuguggccuugcuauaauagaaagauggagauucagaguagugauaauggcuaacauccaccugauacacaccauguguccauuaccucuuaauccucacagcacaccugugaaauagguacuauucucacacuuaggggguaaugcagguuuuguggggccugcaauuuaugcaauuugggugguccucuuaaagaaaaagcaaauacuguguauuaguccguucucacacugcuauaaagaacugcgcgagacuggguaauuuauaaaggaaagagguuuaauugacucacaguuccacauggcuggggagaccucaggaaacuuaacaaucgugguggaaggagaagcaaguaccuucuucacaaggaagcggaaagaauugugagcggaggaacuugccaaacacaaaaccgucagaucgcgugagaauucaguuacuaucacgagaacaacacgggaaaacuguccccauaaucaagucauuucucucccuaacaagugaggauuacaauucaagaugagguuuggguaggaacacaaagccugacccuaucccacagcauguccaggcugcccuagcaccacccaauagaagggaaaauggcagagggaaaguccuaguggaaagagaccucagucucagcuaauuguggugacaauauauugcuuuugcaaauuguacauaaacauaugaccaggugaauguaucgccaaggcuccugccaaggccugggauggaggccuagagaagaugcccgaaaguuuaugcugugugagcuucacagaagaccugccuuccauguauacccauuuuacagguaagaaauuuagggauuugccacagcuucuaaggaacaccacauuccuuacaccauacugagguacaauuugaagaguugcgguauacgcacuguuucgugaggaaaaacggaguuucuguaacaaagcaagagcuuuaaaaauauguuagcaauauuugaccaggccauaacccagcuuggggcaccugacugcugucugugcugucaagaauaaauuuuucuuaucuguuguauaaaaaucugaauuaauccauauggacuccugaaggaauuucagcucaauuucaagucucauggauugagacuauuuuuacuuacuuugucauagaccagucuguguuguaaauucuaauuuauauaauauuuacuuuuugcaauuucaugaaguguugcaaaauaaguaucagaacaagaacguacuuuguuugaugcuuauauugcauaauacaacgagccuuaucuccauaaguguuuguugaauaaauaaaauaaugaaacagaguaagucacaaaacugaaguaaaaguguagguuuugucacaagcuaaaauugaaugggacugaaguagcaaaauguugagcuguaaguacuugcuggauaagcagaauugacuucuuaguuaauuauuuugugcuaaacgucugugaucuucuucccagcuacuggcucuucuuucuguuuuuguuuugauaauuuauuuucuuuuuuguaaaugcuauugcauuugaaaugcaucauuauauaauaauguuuaaaugaaacaaaaaucauagucacaccuguaaugaaaguucuggaaaugaaacgcuuuguuuuuugaacagaucaauuacucacagaaacagcaaccuugaguugauggugguuuuuucauuaaaucaccuacaucuugacccuuaaacaggcuucucuaugugugaucuaauauauauaguguuuaucagucagcaggagaagauauggcuguguuccuggaauaaauuuuggaagcaaaaaaaaaaacauucuacaaauuaagcauaguuuauuaaccggugaauaauugaaaugagugaaacuuuuuuucauuuuaagccugacugauaaauguagacuuaaauugguuuauuuuugagcacaguguuggacaagauucaaaacuuuaauuauaucccuguaacaugaagacauuugagaguaaucagauaauuuucucuagauuuuauguucuuuacccaaagugguuuggaaugcuauuugagagacaugaaaaauaugacaaagaccaucaaaaauaguaucugcucaaaauucuguuuaggauauucucuuuuagaugcaaugauuucagggugcuaugucaaguaauuugauaaauuauaucucuagcuuggccccaacaggauugcauuuuguuuuguuuuguuuuguuuuguuuuuuguuuuuuuuuuuuuaggcagagucuugcucugucguccaggcuggagugcaguggugcaaucucggcucacugcaaccuccgccucccaggugcaagcaauuaucugccucagccuccugaguagcugggauuacagguguccgccaccacgucuggcuaauuuuuuuguauuuuuaguagagacaggguuucaccaucuuggccaggcuggucuugaacuccugaccucauaauccacccaccucggccucccaaaguguugggauuacaugcaugagccaccacgcccagccugucuuuuguuuauuuauaccgugccuucuuccaaaagggacuuaaggugguuuauuuacaaugaaagacaaauauuuuuuaaaaaagaaaaguugaaauucuggcugagacaaacaauaguauuugagcauaaaacugagcccaagcuuccucauagcagugaaauaggggaaaugaagguuugcauagcucucauugucaaguggaaggaguccuacaguuucaucaggagaaagccuuuccugacccagucucugggaagaauuugucuuaaggguacuuaccugagcgauacucacauauccaaguuaagagggacacuacacaacaauuuuggcuaucuuuugguggcauacagagcuaauuuuuuuucuggugauuaacuugaacauugcuauuguugaaaguaaguagugagacucuuacugugguuguuucguuuuuguuuuuguuuucccuagccuuugaagugaagccaaugauguaaaaucaagucuugguuuuccuaguuuccuucucuauaaaaagggcuuauuaaaaguaccuaccucguaggguuguagagaugacaaaaugaguuaauuccuaucaaaccacuuauugcuauaucaaauuuacuguagcuuuccucagccaagguauauauaucuauuuuuuccuccccucuuagaaguugucuuauuguagaccaucugaaaucccuuuuggaaggaugcauguguaugugccugacacaaaguaagcaauaaauauuugcugugaauguuaucguuauuauaauuucuacuaccacuccuaagucuaucaaagcuuugggaguaggagugauggugaggcaguucuagccuccaauuguccuugcaaaguaaagcuuagagaauuaugaggaguaaauugguaucacugagauacccauaaagcagucauuuucccuuugguuccauuguauuguuuaccaucaccuccuguccucuaugacuucacuucauuguuuaauuugaagaacaugaaguaagaacacuuucccccgauacacuaacauuugcuuaacucccugggucuuggagaccucuuauacucuugggaggcuaaauggcacagcuguuaaagccaacucccugagccaaaagccuaguguuggggaucgugggagcaccgcaaaugugaagacagccagugacaggagggagggagacagcccuaccaaacccucucuuucccgagugaacucuguccauccccucugcucugccccucuccauaugguuggucccaauuaacuuccaucugauuggaaucuucguuucagauucuuacucuuccucuccuuaaggaaucuuauuguuucccuucuugccucucccaucuucuuuuccgccuccgucuucacguauaccucacuucuuagccauugagccuccaucccuuuaccucuuccuuuugacuuccugagcauucuccucugucccugcuuuucuuucuguccccuuauucuuauauucuuauucuuagcuguugaccagagucauuuagggaggcaaagcaaaacauuuaaauugaugcuaccuucuuucuuauagcccaucguacauccagaauacugagcuaauauucucaauuaagcuaauggaucccacaaaaaagcaauuuacucccuuuugaguggugauauuaagcccauuauugaauguauuccuaugcuacugcacucagugcguugccagaggcaucuugugcagauggagaaagaagccaaaagauuaagggauugagcugagguccagccaggggugguggagugguucaaaauugaacucaaauuccuuaaauccuugaauauauuauucuaaauauugcacuuaauccaccaccuucaauauuauguacaaaaccaaaaaaccuaaaacugcaggggugaauuuuucuuuccaguuucugacugugaagaauuuucagugguuacacauuugccaauaggcauaauucaaggucucugaaacacuggguagcugaaaaauaacuagucaguuaaauaauuaauuuaaauaacaguaauauccccaggguuuucuucggguaccuaaucuggaacacugccugggucucauauugggaaaacaaaaguggccaucacuauggcagcucuggcaaacagggacauuucuguggaugguguuucuacuggaauuuaagguaacugaggacgccacucucaaagggaaagucugcagcuuggaauuuuuuuucugugacacgcccaagaaaucuuguguuucaggcuauuuuguucccagggucuuggacuugaagggcugacagaaaccuuuccacuacccuaaucaauguaguaucccacucaaaugugaguucacauagaauuccauucuaccuacccaaguagucuugaccuggacuauaccaauuagucuaaccuuacuggguuuuuucuuaacucuagaaaagagaaacauagcugugcaggugacucucagguugggagauuaauauuaauugguuauuaacauaaagaguccccaugcuaggcacuuucucuguguuuuauauauguagauauuagucucacuuuacaggugaagagaccaaagcucaaaggaguaaaauaacaaagauaugaaugcaccagucuguuuaauuccaaagucaucauaauuuauaaugauuuagaagauguuggcuaaaaguggggcucagaauucauaaucacuagaaaacauugaacauuuauuaagcacuuacggcaugccagguacuguguaccaacucagcccauccucccuacaauccugcaaguuacagggagggcugucaucuccauuuacaaaucaggcaaagagguucacuaacuugccaaaggccacacgguuacugacaacagugugauucaaaccauggcagucuggcuccaaagcccacacuccucauuccugaacgcuauguuccacuucagugcuggccacugaaccuucuccugccacuucuaguuucaggagcuucacuaggaucucaccuacaccguagugccgcugugagugaggcuuugacaaaguuggguuuugacugagugcugucaaaggcucuucucaacccaaaggacaugcucugaauucugucucucuuuaguccaaauggcuccuguccuuugucucuguaggguugaaucuaacucuuucucuccugcauuccuguuucagauuguauugcuaguugagauagagacuugcucuuuccuucggguguuguuugagugcagaauugugucucuguaggaucagcccaucccccuuccccacacuacucuucugcuuugagaccccaugauuggauuuuuuuuuuuuuagacuacugcccaggcuagagugcaguggcaccaucacagcucacugcagccuugaccuccuggguucaggugauccucccaccucagccucccaaguagcugggacuacagacacaccaccaugccuggcuaauuuuauuuuuuguagagacagggucucauuauguugccaggcuugucucaaacuccugggcucaaaggauccucccaucucagccucccaaaguguugggauuacaggugugagccaccacacccagucccccaugacuggauucucauacugcuauucaucucugguggguuacuccuuucuucaaccugaaagugauguuauauucaaaaccaccaacagccgggagcaucccuagacacuuccauuggcuuuagagaguguuauuuuugucuccauuggauuuagagaguguuauacauaugcauauguauauauauacacacaauauauauauacacacacacuacacacacacacacacacacacacacacacacacacacacacauauauuuuuuuuuugagucagagucucacuugucacccaggcuggagugcaguggugcaaucucggcucacugcaaccuacaccuucuagguucaagugauucuccugccucagccugccgaguagcugggauuacaggcgccugccaccaugccuggcuaauuuuuuguauuuuuaguagagacaggguuucgccacauuggccaacugaucucaaacuccuggccucaagcaauccauccaccuuggccucccaaagugcugggauuacaggugugagcuuucaucuuuauuuugcacagcaguuuaguaaggaauuuguugaaauuauacuagacuuauauucaguauugagccuuggauguuuaauacuuuaucuuuagaaaauaaaaauuuucaguugaagaacaaagcauaucaguauuccauuaauauaguuuucaguauaacagauauaacagugaaaauuguucaaugaagauuccuuuccugcaagugguagaaauacagcccucacuaauuuaggcaaacaaggaagggggaaauaucaugaaaaagaauauuaagucccaaauggcagcauagcuauugccuaacuaauuuaggcaaaaagggaagggagaaaggccacguaaaagaauauaaagucccggauggugacauagcuauugggggaagguaaauuccuacaugaaggaaggugggaagggcagacagugccuucauauguccacaaaacauaugaaaugagaugauguauaugagaaagcaucaaguggauaaaauauaccucugucaugauuguugauuuuuuuuuuuuuuuuuuuagacggaguuucgcucuuguugcccaggcuggaguacaauggcgcagucucggcucacugcagcccccaccucccggguucaagugauucuccugccucagccucccaaguagcugggacuucaggcaugcacugccaugccuggcuaauuuuguauuuuuaguagagacaggguuucuccauguuaggcuggucucgaacuccagaccucaggugaucccccacaccucggcaucccaaagugcugggauuacaggcgugagccacugcucccagccccauuguugauuuuuaaaacuuaguguucaacaaauauuuauugaguacuuaauacauaugcaugcuaaggaaacaacagugagugagacaaagcccuuugucuuaugaagacucugaugaagcuuacguauuaagacucucaaaacauggucagaauguccuugauuagccugaguugccaaaaaagaaaagaaaaaaagaaacuauuuuaaaauuaauuuuuauugcuuucugucuuucauuuuuucuuccuaucauagcacuagaugaaguuuuagauauaagcuuaaaagccugaguauuugauuucucaaugaccgaagguuaauuacagcucauaaaaauauuagaauuaacauauaauauucagccuaaaagauauaggaaauauauuguuccuuugauuuuaaaucccuuucaguggcucaaaguuaaaauaaaguuugcagacguaucaguugguuuaaaaucaauauuuucuucauuuuaggcauuuucuauuugccauucaagggagaggaaaacauuaagaaucuuuuuucccccagccacuaacacagcaauagaucuacauauaaauuguuaguucccuucuuuuguauuaauaucucuauacucuuguucacuauuuuccaaaggcauugagaaguuaaucagaaguuuaugaaaaaggagacuuucuaaucacagaagguuggauaacacugaguuaaacagcuuuauaagucacaggccuuuuuagaacccuuaguucauuguggauccucaauuauaacauaauguaauguaauaauauaauauaugggaggacgcuucccaacagucaucccuuuuccugguaacaauaucuugauuguccuuuagggaaccuauuccucauucuuagucccugaguucuggugaaucugucccccauuccuggcuuuagaaauguucauaugacaagugauucauugguaaguguuaaaaaccaauucuaaaaaaaaagaagaaaauccuugauuuguagcauuugacauuuuccaugguguaaauacuuuuaccauggccaacuuuaagcuaccaaggugaaaucacuaaacauggaguugggaagagaggcacaucaucagcuccugggaaccugcagcgcacagugucagagaugacccagucuaagugaaucagaccauuuaucccucugggccuaggacucaagccagaccagcuccuuagguccaauuccuuugauuuuuuuaaagaacuguuguggaagaggcaccaucuuucacugcguucguugaaaggaaggaauuggaaccaauucuggugaucuacuuuccauguggucuguuuggaaagagccuggcugagaaugcagacccucagagaagugacuagcagagcugagagauggagacagaccaaauucugggaucacuguuggaguccuuggaucuuguccagccugaaccucuggacauugcuguuacaugagccaauaaauccccuucguuucucugucucucauucuguuucucuucaucucccucuuauccauuauuuguuuauuaauuuuucuuuuauuaaagcuguuugguuuuuauuucauugaaggaauaugaccauucuguauuuauuuauuuauuuauuuauuuauuuauuuauuuauuuauuuauuuugaagacugagucucacucuguugcccaggcuggagugcaguggcaugaucuggcucacuggaaccuccgccucuuggguucaagcaauucuccuaccucagccucccaaauagcugggacuacaggggcaugccaccaugcccagcuaauuuuuguauuuuuaguagagccgagguuuugccauguuggccaggcuggucucgaacuccugaccacaggugaucugcccaccucaaccucccaaagugcugggauuauaggcaugagccaccaccuggcccaaccauucuguauuucaaagagccugccaugagguuaauauucccccagagcaacuuaggaacugccauucuagcucauucucucccuacaccucacagagacuggguacuaugaguaacugucuucuaaacaucugaucugacugcuuuguuguaaaggcuguucagauucaaccuauucaaaauugaacugauauuuucugcugaaaacacacuucuccuaugacucucauuuucauuaacuuauguacaaauuaugugccugaccagggauauaacagugaagaugauaaaguucuugccuucauggagcucucauucuagagagagaaagagaccaugcauaaacacauagguaaauaauguaccaauggcaacuugaaauaagugcuuuggaaaaaaauuaaguggguuuaaacggauagagaaugacagggguuucuaugcuaaauggaguaguuggaggaggccuucuugagaaggaauuuuugagcagagagggcuaaaugaaaugagacaagggccuaugggaguuucugggggaccaacaggcacaugguuggcauguuccagaacugcaaggaggucaguguggcuggaguccagaagcauggggagguuggagagguaucuggggggccaauuaggugggauguuguaggcaggauaaaggacucuugaauuucuucugcacaugauggcaagauuuggagcaugaaucccucugccacaugugugaggaguagauuauaggggucaagaagagacacugcacugaggggcugaguagggagugaccaugcuggcuaagaccacccuccuagcuaugcugguugggcaucaucuaugacuuuuucuucuccuucauuugcuacauucgugcauacaugcccaacuggggguuuuguuuuuauaaugcaccuuacagccaucagaagcagguugagcgucccaggauacagacucuaggacagagauuagugugggagagguuuauugggagugcucuugagacaguaguuugucaaagagaaggaaagaaagcacaacugggcagagaaagaaguucaacuacaauguggugaguucugaggcugagauggcccuucagagcuguccugagcuguggugagagguaggggccuuuauauccccagugaugaucagucauugaugccaccaucccaggaagaggucaugaccuuggccgaaggcccucuuuuggcagcauucccagugacuuggauaaucugaucauuauuacugaaggggaggucugggcaccauaucgcaacacccugguaccacaucacccauuuuuacacuuguuacugaaacugccuugauuuaauuucucauucuucuugcucagauuauagcccaccauucuaucucgaguuauacuccaaaguaaaagucaaauuagucuuuauugccuacacaaugacauuuagacucagcacagcauugagacucuucaagagccagaugucauccccuacugcaggguucacuggacuguggccuguuaggaacccugcucagcaggaggugagaagcaggaggcugcucagcaggaggugagaagcaggcaagcgagcauuaccaccugagcuccaccuccugucagaucagcagcagcauuagauuaucauagcagugugaacccuauuaugaacugcacauguaagggaucuagguugcauacuccuuaugagaaucuaaugcccgaugugaucugagguggaacaguuucauccugaaaccaucaucuccacaaccccaguccguggagacauuuucucccauggaaacuggucccuggugccagaaaguuuggggaccgcugcccuacugugugucuuacaaucugggcagacaagccuaauuggcacacccuaaaaucgcacuguugcuugaaucugaaauguugucuuuccacucuaucuauuaaaauccuauucuucaaggcuauaucaaauucuaccuccucuuuccgaagaaucuuuauucuaauauucauuucauucugccuagaguauguugcuuauuuguuagcuggguaagugcaguaaugaggcccucaucauuuuauucccccuuaguucuuuacagcauuuaauaugguggacucccgauaaguguuaguugacuuaguuuguuucagccuucgucaauagcuagaugauauccugaguggcaguauagcagagggguuaccagcagagauucuggacccauacuaucuugauuccucaccauuuaauagguccauaacaguuagauaauuaagcaugcuauaccuuaacuugcccgucuguaaaaugaagauaauaaucccacccaguucuuagggcuaugguuaggauuaaaugaauuugucuaaguagagcauuuagaacaguggcugcuauuuaauaaguacauguaaguguuggcuuauaaugguaccuaaagauuauuaggggaccugcccaagucaccaguucccaagguagcccauguucaucaagauugucccagaagagaguguuguucuugcugagauucuguggagaggacuucauacaguucuucuguaggaaaauauaauagaguucuuguuuuccucuuaugagcauaccuuuaaugagugaggauuuucuugcaaaacauguuggaauucugugcuuuccugaggcuuuuucggucuggacuuagacuggguuuuagaaugaacauuaugcacuuucccgguguugcaagaaaaaaaaaguacaaagcaucauauuuauaagugaauagauucauggacacuuuagaacuuagaguucaccuaucgcaggagacaagaaaacaaagagauucagugacuugccuaauuaaaggacaaaguuacuuaauaacguuagccaauuugugucugaagaugccauuuuuucagcauguauaauucagacaaaaguagaucuaacuugcuaaaucuccacagaacaaaaaaagaacucuuguuuaauuuuaaggcuauuguguuauuuaaaauuuauccuagauuuggcacaauacuuacucuucuuauaauuaauuaccuuuucucaugagcaaaaauaguuaccauaauuauucauucguuuguguauucauucauuacucaaaagccauuugugagccucuuuuauguacgaagcacugaacuaaaaauuggaaacuuugaaaaugaauaagcccuaguguucugugacuggcucacaucuguagaaucugugugucuccugaguaguccaaauuuaagcaacuucaaaauguggguguaggcugcaacuugaucuucaucagccaaagguuaaauauuguuagccacaacgucagugaucagauucagagccaaggugcugcuauauacaaccaguuaucauuaagugagcaucuuucacuagaaacgaacaaauaguaugcacuagucggcugggcacaguggcucaugccuguaagcccagcacuuugggaggcugaggcgggcggaucacuugaagucaggaguucgagaccagccuggccaauauggugaaacccugucucuacuaaaaauacaaaaacaauuaguugggggucguggugggugucuguagucccagcuacuuaagaggcuggggcaggagagucaccugaauccgggaagcagagguugcagugagccaagauugugccacugcauuccagcucaaaaaaaaaaaaaaaaaaaaaagcacuagccuccuucuccuccucuccuuugcuccuacugauugagcuguacaaaagccagaagaaaaaagaugacaugacauuaccaauuuuguagcacaaugucuuguuaucauaaugcaauauuaaugcaggcauuauguuucuaugagauguuaagcauaaagugaaaaaauaucccauggucaaugaauuuggaaacuucugguuaaacaaccuuaaaaaugugucuuuuagugugcuucccuuucugaacuuuuagcaugcuaauaugcaucaugaaccucuaagagaggccuaaaacauuugaccuaagucaaacuaacuugccuguggaaucuuuuguuugcagggagggcauuacccaugaguacuuucaaaccgaaggucaauuuuguaaguuucugugguucaucauccauuagguauugcuuuuuucuaauaaauaggauuguuuuuacuauagcuuaagcccacuuuaucuuugaauauuauuauggagaaaaacgauucaaaaucgucuguauaagaaucuugucuuuacuuguauauuagucuguucucacauuacuauaaagaaauaccugagacuggguaauuuauaaagaaaagaggcuuaauuggcucacaauucugcaggcuauacaggaagcauagcagcuucugcuuuuggggugaccuuaggaagcuuccaaacaugcagaaggcaaagaaggagcaggugucuuacauggcaggagcaggaacaagauauauagagugaggggaaggugcuacacacuuuuuaaacaaccagaucuugcaagaacucacucacugucaugagaacagcaccaaggggagaguguuaaaucauucaugagaaaccuacucccaugauucauucauaucccaccaggccccacugcaacauuagggauuauaauucaacaugagguuugggugggggcacagauccaaacuauugauuugaaaauccuuauaaagcaccccucaacauuugugcuaccaccuguuuauccagagcuuaugacagacaucuccagucuauccuagugcuccuucugugcgggccugaaggggggucagaauaucuuuccaacgcuaugcuucaggcagucauuuccaauccaugaaauguaaccugcuggauugaaaugaauuugccaugguuguuaacaauagcuaccccuuaauagcacaccuacuacaugccaagcacuuugugcagccuuuuacuuagaaucuguuauuucaucuccauuuuaacuaccaucauagucaucuaagucaccaucaucucucacccaaacuguugugaucacauccuaaccaaucauacuccuucccuacacacuacgaaacaguucaaacugugugcauggucuauauaaccugcaagauguggccgcugcaacuuuccccaucuuuguuucugucacucuccuguguucuaaccauugauccacagcuggauugcagguuuggaaauucagccuuauuaguucacuagaagggagcaaaacccuagagagucaagucacacuaaucagcucacaagagcuuaauguguaaugcacaauaccaauuuacuaauuuaaaaugagaaaugcaacaauuaaaccaaccagauauuuguguugcuugucugugacuucuuucuggaagcuagaaguagccauuaggagcuuuugagcuggaaucagacugccugagugcaaaucuugacucucugcuuacuaacuaggugaucucaggccagugggucagugugccuuucgaugucuacuucaccaucaguaaagcaggggauaauaaugaauccuaccugucugcguuguugugguuaggagugaaugagaaaacauaccuguuacauauuaccauauuacuuagaacagaaguugaugcauaguaagcauucaacaaauauuagcgacuguuccuagaaugaaaaucuacugaaagaacuaacuuaauaucagagcaaaugaaauuaaauaauuuuaaacagaauuucuuuugccagcguguugaccuuguaaguuacuguuuaugcauucaucccauucaguaguuauugacacccaaauaauuucagacaugaucagaugcacuugguagucccucaucgcauaaauauaaaugaaugacuggaugaauacugaaauguaaauuuacaaaucagcauauauuuuugcacuuuccugauuuugucaccacucccacccuauuucccaguccucuuuuugccuucaguuuaaaaggcuuaaaaagcaaucaaggggcugggugcgguggcucacaccuguaaucucagcauuuugggagccugagggguauagaucacuugaggcugaggcagaccagccuggccaacauggugaaaccccgucucuacuaaaaauacaaaaauuagucgagcaugguggcauaugccuguagucccaaauuacuugggaggcugaggcaggagaauugcuugaaccugggaggcagagguugcagugagccgagauggcaccacugcuuuccagccugggcaacagagugagacuccaucucaaaaaaacacaacaaaacaaaaaaaaagcaaucaagguaagccaaccacuuaaaagcccggccugccacugcaucuggucuucacucuccccucugcuuacuccugucagccacacucacugucucuuuuccuuacacaugccaggcuccuucccucuauagacuucccucaugcuauuucaucugccugaaauuugucaccccaauucuuggccuggcucaugucuacuugccucagacacuccucccagaccccccggacugguuagauuccgugauugcaauuuucauaauugucauuacauggccauuguuuaccauggguauuccuucccaguaaaaucaaugaggacaaggacacuuuuuuguuuccugcuggaucuccagucuucagcacauggguagguagucaaucaaucauuguugaaugaaugaauuuaaucuucucaacaauuuucuguaagggaaagucaaggcuuugagcugucaagugacacaccucaguuacacagucaaacugagagcaaguucgaacucaggucuuucaacgaaagcccuuuacuacccagcacugcugccacuugguuucugcaaguuaccuaacuaucuacacacaccaucauuuuccuuagcuuagacuauacucuacuuugcaugcugacggucacagucuuuuccuaagcucuggacuuuugcuuucauucuugagccuauccaaaccuucccuguaauaucuauacacauuguuuuaccucuauagcuagaauauguuauauuucauccuaucaagacaucuuuuguuccccugcaacccugcaauuccacaccuacguauauacucaacaggaacuugugcauguuuucaccaaaaggcaugcacugaaauugucacagcauacuauucauaauaacuccaaacuggaaacuauccacaugcccauccaagcagaacagaucaacuguuuuguauucauaugucauauuauauaacagcaaaaauaaauggucuaaacuuaacaacacagaugaaucucacaaaugugauguuggaggaaauaagucaagaacauucuauuugauuccacuuagaaaaaguucaaaaacuggcaaaacuaauuuacaguauuaaaagucaggaauggcagcuacucuuggaagaguagugauuggaaggggauggugggggccccaggguacugauaauguucuuaguguuuagcuuauaaaaauucaccaauauauacauuuaugauauaugcacuuauauuuauguauauuauacuuuaagagguuuuauaaaacaacuuuguaucuguuuguuucugauuacuucaauuuacggagacaaguuugcaaucugaugccguugucugaugugcugguuacccaccguuugcccagagagagcuuccuauacaugaaaagagaccacucugaauuguuuaaagucuaaauugugacaauugugaagaacacagggcugccugccauagacugucagaaauccacuaauggcugugcugaguccaugggcagcugugguuuggggcacaaauuaacaaacacacauuacacaguccgcugauccagaaaaugugcuggacugguuucccaccucucauaucucuucuccauccucuguaggacccagaggccccccaccuauaggcucaucccugcucuggguucugggaccaaucuuguccuuagggggaaauuuaaagagacagauuuggguaacugaggugacccgggcucaagucgguuuagcucagauacuuggaaugguaggccuggaaaggaaccuugugaagauugcucuuucuaggauuuauuccugugucacugguuuugcauuuuguuugagaaagagauacagaggaaggugaugggggaagggcaucauaaugcuguggaaagaccauggcuuugaaaucagacugcugggcccacauacuaaugccgugguuuaaucagccacguggccugguuauauuccucccugagccucuguuuccucaucucuaugguagggauaaaagaaccaaauuuaaaguugugaaccucaaaaaccaccuugcuggucuaagucacuaucaucucuugucuguuauugcaauaaucugcuaacaguccucucugcuuccugcuugcuccacugccaucuguggucaacaucauauccagaacaauccuguuuaaaaauguaacuuggaugauucuuccuuuugcuuaaaaccugaucaugccuuucaauuucuuacagguaagagccagaguuccuaugauuaucuaaaacaggcauaaccuugcucaaccuuggcacucuugacauccagagccagauaauuuuugguuaaagaggguuguccugugcauuauaggccuagcuuuccaugacagacuugccagcauuuucuugguuccacuugacuauaaugcgagccagcgcugggacucauagaaacgugacaccauccgauaagcaaacaacuacaaaugccaagagugaaagaaggcuuagaggcuuggcugguugucauuuuuaauguguuaacgugacauuagacaguuucuuuggcagguaucacaauagugucagcagggaaucaucugguuacaguaguuaguugccugugauaaaggaucaaguaaucaaguacguauuauuucuaucucagauuuucuucaugccuguuauagggagggauucggggcaauauucagacacauucaaagcacagaguugugaaaauuagucaagcaacacugaaacuaaauuuuuaaguagaaauggaucggacacaauccuaaagugcucacauaagcaaaaccauugauugaaccauacugcauuugucugagauaaaauuggaaaucauuuaucaagcugucaguggaaucgauuugaacugacacugaugacacaaacagauauugaagguuauaagaauuucuugaaaagcuuaagacauucaaagacaccaguuaaaaagauuuuuaugauuugguuucuaaacaucuggucaugguauucagccaacucauucuccucccucuccuuucuucucauccugacuuaaugucugaguaugaagcuaacaauggaggaggauguagugcugauugauggaaagaagcagauauuugaagcuacguuuugaguaucuagaucuaauuguaaauggagcccugauuucagcugacugacaccucucgcucugccuacccaccuacuccuuccuuucugauuauucccuacccagcucucaggacuuccauuuaccacaccugggcaaaucuccccggugccagucaucugccuagacugccccuucaccuuuucccacacuguccagauagugccuugccugccuagucuuccucccacaagaaccugcacacccuccucuuccugcccacugacugauagcauccccaccucccagacaccuucccagagugcuucucuccaguuuugacauguccugcccugucaaccaagaacuucauccucucaaaaaccauggacguuuuagcucuguaaccaauguuuguuuugcuuaacacaguuugaauuaaguuucugucacuugcaacugaaauagcccuugaucuucauugguaacagaacuuaaucuuuuuaaagcagauugguuuugguuuuauuuuuuugaaagagcuaagggucacuuagaaucaggcuuuuugaacaacauaggcauuuaagcaugaaaguaucauuugugcauaaaauauuuugcacuaaaauguaaugaauauaaacucaaaugugauaaaacugauuucauacaugcuuccaggaauuccaaggaggacccuccauggugccuucuuaaauugaaaugacauuuauuuaaaugcauguuaucacaugacuguuaaucaaacaguggcuuuagaguggcauuuuuccaaggugugguuaacagacaagcugcauugguaacaucuaguuuaaaauucagauuccuaggacccauccaaggcccauuaaaucagaaucucugagaauugagccugagaauauucuuuuauuuuccuuuuucuuuucuuuucuuuuucuuuuucuuuuuuuuuuuuuuuugagacagaguuuugcucuuguugcccaggcuggagugcaauggugugaucucggcucaccgcaacgucugccucccgguuucaagugauuccccugccucagccuccugaguagcugguauuacaggcauggaccaccacacccagcuaauuuuguauuuuuaguagagacgggguuucuccauguuggucaggcuggucucgaacucccaacuucaggugacccgccugccuuggccucccgaagugcucagauuauaggcaugagacaccacgcccaaccaagacuacucauuuuugauaaaauuccagguaacuacuagacacuauuucuuuuuuuuuuagacagucucacucugucgcccaggcuguaguguguaguguaguggugcgauccuggcucacugcaaacucugccucccggguucaagugauucucaugucucagccuccugaguagcugagauuacagguguccaccaccacacccagcuaacuuuuuaaaaauauuuuuaguagagacaggguuucaccauguuggauaggcuggucucaaacuccugaccucugaugaucugccugccucagccucccaaagugcugggauuacaggcgugagccaccacgcgcagccuagacaccauuucuuuaagacacguuucauauauauuuuuuuuaguucaccuucaaguguacuguccuaaccuaaagaauaauuccaagaacacuuccucauuuagacaaucaauacagaaugaguacaccugugaaaagugguaaagguucagauaauuuagaaauacuuagaaguagaaggcauuagucaccuuaggcucaguuggcugugguaacaaaugaugcaaaauauuaauggcuuacaauuucaaagacuuauguuuuaugcauuuacauuuccauucuaggacucuccagaacucuaagaugucagaacaaacuuugggacauagcuggucuuguagcaaaggauacaaagaauagaugaacuacaccuggcucuucgagugucugauagaagaaacacaccuuacccacagccauguuacauuggccaaaacaggucacguggccacacuuggggccagugaaguagagaaggauaauauuucuacagaaaagggauaccacagggaggagcagccaacauuuugaacagaaauauaaucugcuauauaggacauuucauaaaguaggucaaauauuuuuggaaaaaaaaaagaggggagucuauguauggucaguuaaguuuaggaacuccuacauaauacccaucucuagagcuaugcaauguaaaccagcacaccgaaggcucucagaaguccugcaauagaaaaauaaaaucaagauuguuuaaccccaaguuuccaagcuuuguuuccauggaacauuuuccaaacaccaucucaacauaccucaauaauuugagguauacucaccaagaaagucaauuauguuauagacaaaauacugcaacacuuucuucuacuauaaagcauucauuugagcuauuccuaauagaauguugcauaauaaacucuguguagcuuugagcuauucguguguuuuuaaaaaugugauauucuacuaggucauccaaaaaccuggggaauucuaugcaaauaucuuaauauucaacaguuacaggcuguugaaauuuaauaguguuaauggagaacacauaagaggugacucuaauaagcuagcucuuccagguagaagaguguucccaaaaggauuuuaauuuuaaauccuucucauuacuauguuuggaauuaggcaauuccuguaaauugaagcaaugcacuuuuuuccccauuuaugggaaucugucauuuuagaaguucauaaauaaguucugcaguuauaaauuaguauaaaaguacuuaauucuaugagagucaucaucagggaagcucauuuucuacuuuuucuccaccuccacccaaaugcauccuuguaccuccuccacugggauacucauaaggugcaaugugauuuaugcugcuguggaaguggagguucuuguuucucaaagucacuauggcuggagugugccacaaacagagguggcugugguugccuccuaauuccuccaguuuuaagucauuguggugaucaucauuuugaaaacccauccucucuucucucccugccaccuuccuuucccuuaucacugccucccagucaaaguuucucuggcucuuccuccuagaucuacuccuuaaaucaugggguuccuccaaauucuucccuugacacucuuuucaagucacuuucuacaucugccagggugaauuaaucugcuaccuggccuucugccccaccuagaucugucuccaccccacauugcuccuagcuucggucccguauucuaacugccaguaggucaucuccaccuaaccucacaucugccucaaaauuaauguaucccaagcaaaacucgucauuuuccuuuccuaaaccugcucuuuuuuucccucguuccaauucauugcuucagcaccaauugagccucuucaguaaagaaugaggcauuaucuguggcuccuccaucucugucaccccuaagcuucaccucaugcccaccuucagccucugcagccccauaaauaugagacucgagauguucuucucuaucuccgugugcuucagaugcuuauuaccacuuucuaggcuucugagagugggauauggauucuggcacccagacugcuugggauggaacucuaaugcuacaaugucuuuggagugacuuagccaaguuauucaaccucucugugccucaguuuccucaucuauaaaaaaaggaucauuacaaugucuaccccagggggugguuguauuacuuugguaaauaggugcaaaaugccucacacaugguaugugcacaauaaauaguggugguuaggauuauaaaaacgcuuuagcugauuucccugguacuagcaucauuccccuccuauuagaaucaucuuucuaagaaaaaaaaaaacuuaucaggucacuccuuagcuucugcuggcuuucuacuauuuaaagacuaaaacucaacuuuccuagcaggacguuuaagacccuuugaaaaucuguucccaggcuaccuuucuggaguauuucuggcugucuuucucuaaacgcggagucuacacucucagccaaucugaacuucucaccauuccgcaaccacuccaugcccuuucauaguccugugccuuuucagugacuauuuuuguguuaaucagcuuuccuaagguacgcugcuguaaccagcaucccaugucuuggagguuuucaacagcaaggucuauuucuugcuuguauauuacacauuggcugcagguuggccucagcuuuauuccaagagucuucuuuuuucugggacugaagugaaaugagcagguccuuucuggaaaugguuuucucacaugucagagggagaagaguaauacuggaaugucacgaugaauuuugcucauaagugacacaaaucacuucuguucacauuuuauugagcugagcaagucacauggccaaaauugaccuuaaauggggcagggaaauauaaaccugucacagggagauggaacaaguaauuggaaacaauaaugugaucucgcacaguauccuauauuugaaaugccaccacacauuccuccuuuuccccauucuucaaaccuucaaagcugcauuaucacuuccuuugugaagcguuucuuuugccaccagguagaguuagcucacuucuccgcauucuugcaagccucacuucuaagaaugugcuuauuacacuggacaaaugaccacuucuuuuuuuuuccuuuuuuuuuuuucuuuuuuuagagaugguguccucucuguugcccaggcugaagugcagucucaugaucauagaucacugcagccucgaacuccugggcucaagugaucccugcuccucagccucccaaguagcacgugacaccaugccuggcuacagccuuuucuugauuucucugucuccaguuccaagcaucucagaacauacugacagaaugaauaaaucaggcaguuuguugcuuggcaauuuauuagacaggauugggaacuaauaugcagagguaggugaccaaguaaauccuucaaucaggcagaaaggaguuggaaggaucagugagacucaguuugguuuuuucuccauguucacuaaauacuuacaucguuuucuuauuuugcccucagucuguugcuaugcaagaacaaauaccuuagagauaugcuauuuaugcaaacagccuugggcauuuauauauauauaauauucaaauuaaaauaaauuaugcacauauaguguuuguuaaaacuuugcuucacaucaagugaucuauuaaaaagacaaggccagcaaaauuaucuccaugaaccaccaguaagcuucaucuuuaguaaccuuuuuggacaauacuaaaucaaauugcuagguuuucaguguuaccuccaaaguacugcagauucauccccugccagcauuucacuggcacugucuuaguuucgguucucaucacuguuaaucugcacuuuuaucacaaugcuuacuugguuuccuucugcccagggaauucccugcugccacuuccucagcacccuucaaucaagaagcuauucaucaggcauugccuuccuucugaaaccucucugacgcccuaucuucaccguccuccaacagaguuaaauccggucucuguguaacuuuuuaucauuguguuugaucgcauugcauuguaauuauuuguuuauuugucuguuuccucuugauggaauaagagucguuugagaacaggcacugcaguaugcuaauuccucccuauacucagagcagagugccuugcacauacguaacguguucaauugaugcuugcuuguuacguagagcugcuguugaacugaaggccaaaauuaugaguuauaaauuucaugaucaguaauaugguacaacuuauaacacuuuuuugaucuugcauucuaacauaugcuaauauuuucaugauacauggagaauggaguguuucuaguauuaaucauaugcuuuauguuaaguaauguagauuuucacuuucauauauaagcaccaugcaaggcuuuuuggaaacgaaccaauucucaugagaacuuauuaguguauuaagaaaacacugacaccaaaaguucaggcuaaaaaagcaaaaauaaauaaaugagacuacaacaaacuauaaagcuucugcacugcaaaggaaacagucaacaaaaagaaaaggcaaccuacagacugggaaaaaguacuugcaaaacacguaucugauaagggguuaauacccaaaauuuauaaagaacauuuauaacucaauagcagaaaaauaaauaaccugauuuaaaaagggguaaagaagcuaaacagacauuucuccagagaagacauaaaaugaucaacagguauaugaaaaggguacucaacaucacuaaacaccauugauaugguuugacuguguccccacccaaaucucaucuugaauugugacucccauaauuccuauguguugugggagggauccagugggagauaauugaaucaugggguugguuucccccauauuguucucaugguagugaauaagucucaugacaucugauggcuuuauaagggguuucccuuuuccauuggcucucauucugucuugccugcugccauguaagauguaacuuuugccuuucaccaugugaggccuccccagccauguggaacugugaguccauuaaaucucucucuuuuuuuuuuaauuaauuacccagucucggguaugucuuuaucagcagcaugaaaauggauuaauacaaccauggagaugcaaauuaaagccacugugagacaccaucucauacucauuagauaccauuucacacccuuuugauaauaggacuauuauugaaaagucaagaaauaacaaauauuggugagaugguagagaaaagagaaugcuuguacaauguuggugggaauuuagauugauacagccaugagggaaaacaguauggaggcuccuaaagaaauuuaaaaauggaacuaccauaugacccagcaaucccucuucuggguauacacacaaagaugaaaucacccacucauaaagauaccugcacucucauguucauugugguacuguuccauagccaagacauggaaacaaccuaagugucaacaaaugaauggauaaagaaaaugugguauauaugcauauacacacauacacaaacacacacacuggaauauuauuuagccuuaaaaaagaaagagauccuaaugcuugccacaacauaaauggaccuguacacuaugcuccgugaguaagccagacacagaaaaaaaaaauagugcaagaccuaacuuauauguggaaucuuaaaacagaaaaucaaauagacaaggagaaugaaacagugguuaugggucaguggggagaaaauagggagauguaggucaaaggauaaaaaguagcagauaaguaggaugaacacaccuagagaucucauguaaaaaauggggacuauagguaguaaaauuguauugcauuagggauuuuuguuaaauaaguagaguucagcagcuuuugucacacacacacacaaaagugacuaugugagaggauagaugcgugaauuugcuucauuauagcaaccguuuuacuaucuauuaauacaugcaucucaucacaucauguuguaagccucaaauauacacaguaaaauuuacuuuuuaaaaaagaagaaaaugcuuuccaaagaaauauucuucauaggauauuguaugauggcuaaagaaaaauuagaugaugccauaaguguuuuuauuaucuuuguaauagaauacaaaagcuaaaguuuuacuuaaaucaaaaauuaaagaaauaaagagaauuuaaguugcgugcuuuagaaaaacaguacaacauacugacuuaaccagcucuucuaaaagaaaagaagucaaguacaaauuacauccauuuaauuagcucaaagaugaaaauuucaguuuuaguaacuguaauacauguuauguaagagaccaugaggaacagaucaaaagggguuguaauuaaagugaaucuucccagaaccuuggguuacaucaggaaccuggccagaacaagcaaggcuacugacuuuugccagggucauguuuggaggucgcuuuaacauagcucuuugcuuaaaaaacauaauuugggcauaaaagggcucccaacguucaaugaucuccaugugcuucccauuaggguuagaagaagaaaugcugugguaguuucuucaaauaaaauggaaugggauuuucagaacucuuuccaacuuggcaaaacaggaugugugucaaccuggacaucaggaaggcccagauauuucuaaaauagagggacacacagucauucagagucacauaugaaccauuguaaaugguaaccuaguugcucauuuuuuuuuucauggaggaaagcaucuaggucagcucauauggcuaucuacuuuacucuaaauaacauaauaauuuuaaaaaauauaagucaauggcaaaauauuguccguaaguucccuugcuagcuaggcuauuauagacuuggaaguugccagaaaugaccugucacaucuucucuucuucauccacuccccaccaagagagcaugauugaugacccagagcagucaauccccuucuguuucccaucugcaacugggcuaauaggaagcaacuaagccgaguguagcaucacuuuugguuacuuauccgguauccgcuuccccuuuuccccacuuccccagccacugagacauaaguagauauuugccugggguucugguaaaagcuuuugguuuccuuuuuucuuuucuuucuuuuuguugagacagaguuucacucuugucacccgggugucaaugaaaagcccccauuuuaaaacaucggcucugacccaugacauagcaacauuauggccucguuccuuuaacucacaguuucuuccagugcuaagaauuaugacaaacuguccuaccuauguuaaauuuucagcaaaguuuauaacuuaagagaccuggucaguuggaaauaaaagaagucucacacuuauaauguuuaaauaaaagaagauacaagucuguuacaccaagcuguacauaacaugguccucauuaugaaaauccuaccucagaauucuaacuguaguuagaguguucaccuuucauuauucauguagaagccucagauguaagacuuucauguggauuccauaauuaucuuuugcaaauuuuguuuuuaugugauacucacuguagucauuuuccaagugcuaacauguagauuccuauaggcaccacucauauuucuguuuaaaaaacaacagaaacguucaaacugguaacaucugauugauagacuggguuagggaugcuuacaccuggaguguagccagacccgaggcccuugcaaacacacaauuauacuagauccaucacaucaaagccauuuucuguguugcuuccaauuuuaggucuggcacauuguuucaacucguucugcuuuaaaacucucaaauaguuuucagaugaaugggugcaaaauggcagcuugcauaucuuccuuuaacucuccuuuuuggaaaaguguccaccaaagaauuuagaaaugaaagaaauccaucaauuaagcauuuguguuauuaauaauagccaccauugacugagacacugugugccaagaauugugcugaucuacauuacccuucaccagucuauaagguagacugauguuggucucucgauauuaaauccuucacucauccauuuggagaguuuuaugaacagccacaggacuacacccugggaauacaguacugaaaaaaguagaccuccugccccuuaccccuccccaccccagcccucuacaaacacacaaacaucccauggagucuaauggggaacagacaucccaaugcagugagugucaagaaagagggaaacugaggagcauauaccagggguccuaaccuagacagggaugggaagaaaaaccucacggauaaaaaagauguuuaagccuggacauuaaaaguuauuccggcaaacagggaggcguuacuggugcuggaggugaaaaucacuccaggcagaugagacaagaugcuguuggacaagacggcccaggagcaagaaagagucagguagcacuuccgaaggacugaaaaaaaaaaaaaggccacuauugcuugagcuaacagaacuagcaagagaagacuggugagauaggcagggaccagaugcugugggccacauuuggaacuuuauccuaaaggcagugaaaagcuauuaaagaugguggugguggugguuguuacuguuuuaaaagaguguacgggaugggggacaaauagggagaagaaugaucagauuuaaacccagaaucugagaaauaacauugcccaaagucacuuuaaagcuggaguuugaacccagcgggcuagauucccaccuuuugcuccuaacccaugaaucucuauugccuucuaguuuuaccagcuucauucuagucggggcaacuuaucaaaauccaucaaaagacccuucaaaagcacauguaucuagugcuuaccaugugccugggccuacauuagguguagggauucaaaggcccuggccuggagauaugcccugccuucuguuccuucucaguugcuacuguagaauuuggaaucuguauuucugacucuauccauuaauacauaucacaaggccuguuuuauuuuugaccuagagcaacauuauaucaaagcauaaguuagcugcaauuggagguugugagggaaaccauucucucauuagcaaaauccccaauauucaauauaaugccaacauuaacaugugacauggauacccaguugcagaugaguagacugagguucugaagguuaagccacuagcccaaggucacacagguggaaaguucuagguugagaggccuagaacuguccucugggaaaccaaacucucagggcuacacagucaagcagguuuucucugaucaggugcucagucugaaaaggaaggaaggggagaagaaagggcuugaggaagaauuuuaauaugaaggacacuguaugcaggaugaugagacugucuaaucauuccccguggcuuuaaauacuuuuauugaccucauuguuaaaaauccucacagaagucaguauuacagagaaaagaaauuaauuuucaauuuuaacuaaaccucauuuuucuucccuacuuguuuuuuaaguuaaauguuacaugugguuggaguugcuaguaaguuaugcaauuuugcucagacaaauaaguaaagaauaaaauauuuauaaaaaucagaagguauauuugcuuaggucuuugaaugucuuuuucaaaaggccuuaaaucccuauggauuaaucaagcacaucucagauauuguccuuacaaugcucaggaaagaaaugaccccuaauaggauaaaaggcacauuacgaucugaacuugagaauuugccuggaaauuuuucuuuagaacuggaauuacucuagaaaguguaugaaacacucugagcuuuucauuauuuccccaaaucaucuaucuauagguuagcaaugcauuuauacauuuuacccauaaaaauaaaguagauccaauuaugcauauguuuauugguauuuauuguacuucuacuuugaagagcucuauguuauuucuuuuuuuuuuuuuuuugagauggagucucacucuguugccgaggcugaagugcaguggcgcgaucuuggcucacugcuagcuuggccuccuggguucaugccauucuccugccucagccucccaacuagcugggacuacaggcuccugccaccacgcccagcuaauuuuuauuuuuuuuuuguauuuuuaguagagaugguguuucacuguguuagccaggaugaagagcucuauguuacugaucucauuuuaaaaaucauauucuuugggauacugccuccuuuaaguguagggcuaacuccuuuccccauguuuuuuuacaacuuagcuacugaucauguuuaaacaagaaauaguaaugcuuauguuauacuuuagaggacuaugaauaucaaagugaauguuccuuaacuauuaaaaaaauaaaauggaugaaaguaauuuugcuuauuaaaaauaauucaacuuuacaacagcuaguucucaagugaaauugaaucccaaauuaaucccaagugauucuugaaaaugcuauaaaauucaaaucuaguaccaucaaauuuaaaaaaaugggaaaaggguuaaggauaagauuugauaaccuuauuccauuaaauaauaguauauggaaaguacggaaaugggauuuuagaauuauuaaaauuuaauucccaaauuagaguugcaauagcaaagggucagaaggcagagaagaaaauguguguguguguguguguguguguguguguguccucccuccuucuuuguccucgagcagaaaguagcuccaccacuuguaaagggagucccuagagaaaggaaaagcccuuagcuacauuucccagauuuggaaaccuggaaaugcuagaauugugagggcaggguguggcaaaauuucuacuuuucacuguuuagaaacucucuuaucuaauuggaaccaaaccaucuauguaguuaacucauuuaauucuuacaaacccgggacacggaucccauuuugauuauuccuaccaaaccaaugguuuuucuaagacauaauuuaccaaguaauuuaucagaggugacuuaguaaaugcaggaccuagaguuagccucaagucuuuucuauuauuuucucuuccucuccugaauacagaaauauaggcuuugaucauuuacauucucugaacaaauuauuuccacaugagaacagauuacauccuuugacuaugaugaguagagacagauccucuggggaggcugauuugcaagcuggguacuugaaaauccccagggaggacuggucaaaaagccagaagaccauacaagcauggggggaagggacugggaaguaagagggagaugaaaguagggaggugggaaaauacuugguaacuuuuccuuggacccuagagacccguguaccauuguaaacaucauuuggguaucuccuuugacacugccucuguugucugugccuggcauaacauggaaagguaaagcagugguccugugauauuuuagguaacuaaggaccaccuaugacugauaaucaagaggcaaauacuguuucaaugaugaccgugaauaacaauuagaagaagagcuauuauuuaugaagagcuuauugcauguccaccgccaccaucaucaucaucaaaauucauuagcauguauugaguccucacuauguaccagacacuguuccaagcucuuugcaaguauuaucccacuaaauuuguacaacuauucagucaaguagauaccauuauuaucuccccuuuauagaaagcaggaacuaagacaaaggcagaaacauuacuuguccaagcacacagcauucaaacccggggaucugacaccagugacugcaaaugacuuacacauuucauucaaaagauuguuguugacucccuuuuauaugccagguucuaugaggagguggugaagcaauguugagaaaaaguugacauaaauccuguccuuauggaauguacagucagcugagggacaguagucaaaugaugauauaaauaaauguagaacuguaauggugccaaggauucugaaggaagggcuugcagcacuguaauaguaucuguccagaagaccugcccuaguuucauuuaaucuucacaacaacccuaucccuauuuuguacauuggaacugcagaagcaagguuuagggagagacaggaaagcccucuaggcacuugccuaagggcaaucuagucaaaccuucccaaguuaugaaucaauuuuuucacucugggccaugucacauuuuaguugccauuagcaaaucauuucgcuuagaagccuaagugguaauuaugugcacauuaagggauccagaauacugauuuuacuuuaguacaacucacacuuuuuuguaugcaaagauuucccacugcucauauaacagacaccaggcauuuaacugacugcucacaugggcaugcaggcaagagguauucagcugaggacuccacacuaauguuuuggacuuaacguuaugcuuuaacuuuucaucuguuuuguagaauguagaauuuggcuuaaugacuauguuuauuucuguucaaagcacuggaaauaaaagguuugugcagauguuugaaggacaccauauagacuauucacaaacuuuuguggucaguuuagccaccauggucaggcccagugacucacucuaaacugaguuuuguuguuucuuaaaauauuguuuugcucuuguccucaggaaaguugguguauucgucacaaacauugcuaggugggagaagggggugacaggaggugggauaaugugaaacagucugugugacgaaaguuuguuucaacuuuccuaguuauuccuaagacuguguuugaccuaaagagcauuuugaucuagaagacaccuuaaauuggagggucuagugaaaaccugcaugcugugaagcagagagcugagucucugagagauucagugauaucaccaaugcccuggacugguugguggcacagacaugcuuaccacuaacuccagccucccaagaaccacaauccauaguuccuuaacuccacuccaugcugacucuuggacuuaaacucuuaauuucuuuugguguuauuauuucuucccuucucuccuuuucaugccuuaaagguggugccacaaucaucugaacugacauauauuagcccacuaacuauggccuuguaguuuuugccaaauaaagcauuaguuauguaacucuacucuguuuucugggaguauagaguuuuaaacagaaaauuuuaaagaaauuggaaauuucuuuaagaaaaaaaaagaggaaagaauuaaaagguauagacaagcaacaucaacuagcuucauaaauuaaagaaauuuuaaguacauuauguaaggcugggcacaguggcucacgccuguaauccuagcacuuugggagccugaggugggcagaucagcugaggccaggaguuugagaccagccuggccaacaugacaaaacccugucucuacuaaaaacaaaaaauuagccaggugugguggcacaugccuguaaucucagcuacucaggaggcugaggcacaagaaaugcuugaaccugggagguggagauugcagcgagcugagauugcgccacugcgcuccagccugggcgacagagcgagacuccgucucaaaaaaaaaaaaaaaaaaaguuacgugagacggcaccauaugugcacauuuuuucuauuuuuuuagaaaaaacuaauaguuuaauuaaauuaaacuaauacuuuuaaaacuauuuuuaguuuguauggauauauaaugguuguacauauauuugcaaauuuaaugguaauaaaugugacggacauaguagcugacuauuucagcaauggggucaggaacaauuguaucuuuccugauuagccaggaaagaaucaaggagaaggagcagcugggcgugguggcucacgccuguaaucccagcacuuugggagaccgaggcggauagaucacgaggccaggaguucaagaccagccugaccaacauggucaaacccugucucuacuaaaauuacaaaaauuagccaggcaugguggugcacgccuguaaucccagcuacucaggaggcugaggcgggagaaucccuugaacccaggaggcggagguugcggugagccgaggucgagccacugcacuccagccugggugacagagcuagacucugucucaaaaccaaaaaacaaaacaaaacaaaacaaacaaacaaaaaacauaaaaaaggcaggggaggggaagauguccaguaugaaacugggggggauguuaaugaauucuguuagaauggggaaucuggcauagguaaaaacuuaaaccuaugcugucuaauacaauuguugcuugccacauggaguuaaguuuaaauuauucaaaugaaauguaacuuaaaaauucaguucugucacaugagacacauuucaagugcucaauagccacaugcagcuaguggcuauuauauuggaccacacagguguagaauauucucaucauugcagaaaaugcuuucagacagggcugacauagaagaugcaucagagaagaggagggggauagacggguggguagaugagaggggcacauaagguaauugcaacagaaugaauguuuaugucucccccaaauucauauguuaaaauccuaacccuuaaugugauggcauuagcagguggggccuuggggaagugauuagauugugaggguagaggccucaugagugagauuagugcccuuauaaaagggaccccagacagcucccuugucccuuuugcuaugugaagacaugauaagaaaacgguccucuaagaacgaggaagugggugcucaccaggcucugauucugccuggugccuugaucugggaauuaccagccuacagaucugugagaaauaaaugauuuuuguuuaagcuacccagacuaucguauuuuuguuacagcagccuaaacagaaaaaaauagaaacguuuaccaggaaaaguauaugcuagauggauaaggggaaacaagagagacaggacacacggacgugauccagggaaaggucuugaauuggguuagagcuuggauucaaggcauuggcuggcugcgauaaaaccuuugcgcauguuuuuuuaaaugguguuccucugggcagaagcauccugugguuuuggcuaguagacaguucuuugugcaaagaaaaaaguguacuuuccucaaaacgauggagaugguuaaaagaucagugguugucagggccuggagaaggcagggaagaaaagaaggaugaacagauggagcacagcagaguuuuagcaauagcaaugaagcuauuguaagauacuauaacggugcauauaugucaucacacguuugucaaaacccauagaaugcacaacacgaagaguauacauaguauacauaguaauguauaccaugaacuuugguucauacuaaucuauuaauauugauucaucaauugcaacaaauguaccacacuaacauaagauguuacuaacaggggagacugggagugggguggacagggugggcagggguauaugaagcucucuguacuuugugcucuggcuuuuuauaaaccuaaaacugcucuaagaaauaaggucuaguaaugaaaaauaaaaagggaagcuauuuaacuauuucucauaaaauauuuucaggcacucuaaaagucuucauguucacauacacaaugacaugacaauaaaacacacuaaucugguuuuagcugauaaucuaauguaguuauaugugauucuaucaauaucugacauggaaaaaaagcgaaacaauguaccuuccucuagguuuccacagagcagcuucaggcauucaucuuggugagcagugugcaagcuggauuuuccuaaccacuugcucucuuccucaggugucugugcggugcagaaacuguacaacuguauacagugaccauuucuacucugggucucuaaacaagggcugguaucguuacagagacugaagacugaggaagaccaucucuguaggaugccaaggauugacuggagaaagucuggguaaguacaggucacaggaaaccacacaagaaauacacuuuuguaggacaaagagguaaggucagagcccugagagacccucacaacugguauuaaagcagagugaaaagaaaucuaaaggggggacaggucuaaggggacaugggacacaaagccaggaaggaaggaagcaaaccccagcagugcuguaccuggagggcgaugaaugagucgcagaggcucccuuucugagcugggauuaggaguugauaauggucuugcaagugcaguucugcagagcgaaagggcccggugccuugcagcagagacacguucugggagagaggguuagg

SEQ ID NO: 17728 - RNA, 7703 nt, Homo sapiens
aacugguagguguuucuacucuuuuacugaagagcuuuuacuauaucaggacaaaaggacacaggcuucuuuacugaagacugaggaccuaaagaacccuccuuuacauauaauuugcacagaacuuaagagaaacaguuggaaauaaaauugucuuaaguagaaacugcuuauuaugcuaaguuauuaauugauuaagauaggaaauaaaaaaguuaaaaaccaucauucuggaagaucacaacacuucuaauauggaacaggaguccaaaagucacaggagaaagauguagauucuuauuagacaucuauaacaauugcuuggcauaaaacucauuucccaaguuuucaauuaauauuuagaaugacagauuagaaguugggaaaaggaaaugccacaaauuauugauauucccuauagggcaggcacacauuccuccugugagaauaaaaguaccuacauauauuuuaucuacucauuagucugucaucuggcccaaagaauuaaaacauucaauacacacacccacacacaaaaggcaucuuugaacucuuacacuuauacaaauggcuauuccacggaaauaaaagauaaaaaugcucaccuuucugaaaaucucucauaaaucacuauaauuuacugaaaagguuuguuuuuaagguuuuacacuugaauuucauggaagagcagucaaguguaauugacuuaaagcaacaguuugacaaaagugauaauuugaaagaaaagugauaacaguauaaccgauuggcugaugucaaaggccagagccaagcuggaaaacuaaaagacucccgaaucuaaguauuuugaccaaaagcagguaagauuauuucguaaauucucuaauuauucauuuacucaauaacuauucauagcccacuaugugaugaaggugguuccuggugcugcaaaugcaauggguaacaagcagauguguugcuagcccccuggagcuuccagccuauagaggaacuccaccacucacaucuuucccacgucuguaaacauuucuugacaugcaacacauaugggcaccaaccccagcccacucuucuucugccugcagcucucuccuuuccuuucaccaacuccagccacagaggugguccucugucccucagguaugcaaggcucaguccugcuccagggccuuugcacuugcccuucccucugccuaagccacucuucuuucagaucuccaaaaucauaggcuucuucccccucauucaacucucagcucagaccccuccaccccagagaggcuucucaggccacuugauguaaaacagcagcccacauccugucccauucugccaugcaacccugauugcuuucuuucacagcacuuagcacuaucuagucaccaucacuuauuguaucuuugcuucuuauccaucuccuucgcugagauuauagcagggucugucuguccugugcagugccauaauuuagucccuagaaaguugucuggaauauuaacagaugcccaauaaacaccuauuucagaaaaaauacagacaacguuagcaguuuuguaucacaacaguaccaaauaaaaggcaagagaaugccuuaaauucuaagaggaguuuggaccauuuaaacuauauauauauauauauauauauauauauauauauauauauauauauauauuauauguauguauauauuuuaaaagauuaugauagcuuacacuaguccuaaaagcccucaaaaauaagcauaaugaaaauacugaagcucaacauuggcuaauguucaagcuuuauaauguauuaggcucaauuucuagcauuagcauuacuuuuacaauuuauucuuuuucaagagcaugcugacgagaccccaauuuuuuuguuuuaaagaaaagcaagagcuaaguauguuuuaaaagcauccauccccuuaaaaguuauuaaccccaucauaaacuguaaaaucuguaaccauauuauacuaacauuaaaauauaagauacuggugauaaucuacagaaggcagggauuugagugccuaauggcaaccgaauuuuaugaaacauaaacuacccucaucuucaauuuaaucaaagguacaagcugccucucuacguucaaaaauauuuaaacacuuaagaauuuuuccucagauuauucuuuaaaauguguaucuguuccuucuuuucuuuuguuaaaacaaagagccaaguuguuacccaaggaauaaugacuuuaguuacugaccaucauggcucccacuucacagcaaagaugccaaagacucuuauggauuacugugaaguuauauagaagcaaacaguguaugcuggggagaaggcacacuuauuuccuggaaggugauauaaagaaacaaaugacuacugccuuuaggccuuugggaauaaccaaauccacuuaaaaaccucaaaaacuaaugcuuuacaauuucauagcaaauuauuagaaacaaccuacauauaucacaaugaagagauuaaauaaauuaugguccaucccuaauggaguacucagcagcuguuagagaaugaggcagauucucuuagauaccaauggagacugccaugauuuaguacucuggggagggaagcggggcagggggagcuggugcacaguauacaauggguccucaucuuuaggaauacaaacaaaaagaacacguacagaauguuuacaugagcauaggcuaugucuggaaagacauacacaaggagccaguagcuguggaacaugaugggagagagguauacuccguaucuuuuauaucuauugaaucuucuccagugugaauagauuaccugcugcacaauuaauguaagaaaaaugcacacuauuaccaacauauuugucaaggaugaccauucagaagcaaauuuuucaaaaaucacaaaaguuuugcuccuucaacagcagagucccugauucucauuccccagaagagaauacaagucuccacuaaucaagaggcuugcuagugaucucacucaccuauuacaaagcaaagaagucucaauucaauucuugaagaggaaauagcugcuccgaucaccuugggaacacaucauauauuuaaauugagcuugcaacuaacucccuaaugaaguuuccaaaugaacaguugcccccgacuauaaagcauaaagucaacguagaagacaacuaaaagaauggucucguguuuuuaaaaaacacauuauacuuaggcuuccuuuucucugccaggcuuagacaagaaacucucugguaacagugaaauguaauuucagaucugugacaaaauaaucauguaaggggaagggcaaguagcauucgcgcugaaaaaacuccuugguuuuuccacuugugaaaaggaaagguuugccuuaaauuuaauuucuguaccauuucuggaccccugccuaaacgauacuacuauaucacauuaaucuuacuucaagcaaauacuuuuuaaaauuaaaaacuaaucugaaacugaacaggaaucggaagacaaacuuuaaacugaaacuuuucuguugaaagaauguaucuuuuaaagacacauaaaaagaaaugcaaagaaccgauuuccauauaaaugccacucaauaacaauacagguuauaacaauauuugacugcauuaaacauucaaaaaggaacacaaagauacccaacugcaaauaaaagaccucauauauuuuugguagcggaaugugggggguggggggcaaaaaucacauuaauucagauuaaucauguaaauucagaacacgugaugugcaguuuugugucgcucagaacuccugaauccagcuuugugcuuuuacacaacauaacagaaauggcaucuuucacaaagccuaacuuugaccuccaacacuuuaacuuuggguuuaaccaguacaccaccuucggaaguuagcacauaaaaauacagguaagucaaaugcacuacggauacagaaaggacgaggaacagguuuaaaggggaguugaagcagaggggcacgaaaucaccuggcaggucaccucuccgaaggaaaaacauuucaagcucccucccaucccccagguaaccucuggccucagaacucacugcccugcguggggcagaaguucugggcgcuggaguccgcgucccccaggacacgagggugacccaagggcgcgcggagagcggcgggacccggagcggcgcucuccggggucacuccccuaggacgcuccgcagagcugggagcgcugccccaccccgcccgggccgccccuggggaccccgcucggggcuccgcggcuccccugcuccgcgccgcgcccacccgcccccaggacucacgguacgcucccgcgccgcuaucuugccauccccugccgccggcucuguagccucggccgccgccccggggcugcccagaucccacagccgcccgggggcaggagccgccaaggagggggccgggcacaaugcgccgccgccuccgcagccgccgucucgccuccccugugucggcgcgaggcugcuugaggcggccacgggcgaagggcggcccgcugcgcuccgcgaaccccgcgggccgccgccgccgccagagccucccagaggcaacgguaacggccaccgccacggccgagucgcuccagccgggacugcggcgcgcgggggcggcgccugcacgccgcucggcugggggcgcagcgggcccggccccgccccugacccgccccugcccccggccccggccccgccccaacccgcgcgcccccgccgauccccggccgcgcgcccgcgcgcgcgggugcuccaaggagucggaggaacgcggccgcgcgacgggccccggacgccgaggguggugcuuccuccgagccuccgguggugaggccgcucucagaaggucauggaagcgcaggggagagcgaggcggccgagcccaggcaaauccucgagaaaggccgagugcgcgacggcucugcggggaggaccgcgccuccccgaaugcggccgcugcugccgcugcaaacagugccuugaggagaggaaagcggggaaccguguuuucgccgccucuguaaccacugcacacaagaaaaccagcuucugggagagggggaugauuguugggacuuugcgaauuaccuaaacagcccagggccgaggcgccgccgcucgcguccugguccuccugccggguguggggcuccccugcccgagauggccagcgggcgcgccgagaguauccuggagccaucuagucuugccucggaggcggggugggcuuauuugugcggagaagaaacggaucucuuaauggggugagauuuuuccuccguacauuguucccauuuccgcaguuucacuuggccucgguuuucuagcagaguaaucaccaaaugaaauuagcuggagagcguuugauggcgcagaaucacggucugaagauguuuacgcuguaugccggacgcguuugaugguguucucuucggcacaauuaauuuugcaaaguucagaaaugugccagacagagccccuggcacgcagucaggacucuacagacacaccuugaguaggaaacaggcuuguuuguuucaucugugauuuaugugaugcaccagcaccaaggccaacguguuuuuuaaagaccuuucgaugaaacuccaaagcaauuuauaaauuggcaaaaugaagcuuguuuuguaaaauaacucuuccuuguugaucauguaauuaaaugggcaacaaaacaccugaaaggacauuuacugaaaaguagacucccaaaacaaaaauauguauuucacagcuagauacggucgcuauuagcguccuaauggccaacuccauccaugugcguauuuugaacacuaaaaacgccuccuguuaccccuaagaccuuguuuggauaacauuuuucuauuauaaguacucgaaaccaaccccauuuaagauguuuacccuuauucuugaguccuugaugguuugggaaauuuaucauuauucauauugcacaauccugucacugucuuuuccauuaggcacagugccuaagguccacaauauuuuuagaggcccacaaaaaauauuuuaauuucuuuucaaaucagaaggaaaaaaaauuuagguuuaagaaaguauuuuaauauauauuaauauauuuguuuuugugcuaauacaaucuuaaaauguauguauauauguguguguguauauguauauauauuuuaauggaguaaggggcucaacgaaggcaaaaaggccuagagcccaagaaaaacaugauguggcccuguugccugggguugaaaaaucccauuccaugagaagaauuuaguuuuaagaauauuacauaaaaugcucauuucuguggccuugcuauaauagaaagauggagauucagaguagugauaauggcuaacauccaccugauacacaccauguguccauuaccucuuaauccucacagcacaccugugaaauagguacuauucucacacuuaggggguaaugcagguuuuguggggccugcaauuuaugcaauuugggugguccucuuaaagaaaaagcaaauacuguguauuaguccguucucacacugcuauaaagaacugcgcgagacuggguaauuuauaaaggaaagagguuuaauugacucacaguuccacauggcuggggagaccucaggaaacuuaacaaucgugguggaaggagaagcaaguaccuucuucacaaggaagcggaaagaauugugagcggaggaacuugccaaacacaaaaccgucagaucgcgugagaauucaguuacuaucacgagaacaacacgggaaaacuguccccauaaucaagucauuucucucccuaacaagugaggauuacaauucaagaugagguuuggguaggaacacaaagccugacccuaucccacagcauguccaggcugcccuagcaccacccaauagaagggaaaauggcagagggaaaguccuaguggaaagagaccucagucucagcuaauuguggugacaauauauugcuuuugcaaauuguacauaaacauaugaccaggugaauguaucgccaaggcuccugccaaggccugggauggaggccuagagaagaugcccgaaaguuuaugcugugugagcuucacagaagaccugccuuccauguauacccauuuuacagguaagaaauuuagggauuugccacagcuucuaaggaacaccacauuccuuacaccauacugagguacaauuugaagaguugcgguauacgcacuguuucgugaggaaaaacggaguuucuguaacaaagcaagagcuuuaaaaauauguuagcaauauuugaccaggccauaacccagcuuggggcaccugacugcugucugugcugucaagaauaaauuuuucuuaucuguuguauaaaaaucugaauuaauccauauggacuccugaaggaauuucagcucaauuucaagucucauggauugagacuauuuuuacuuacuuugucauagaccagucuguguuguaaauucuaauuuauauaauauuuacuuuuugcaauuucaugaaguguugcaaaauaaguaucagaacaagaacguacuuuguuugaugcuuauauugcauaauacaacgagccuuaucuccauaaguguuuguugaauaaauaaaauaaugaaacagaguaagucacaaaacuga

SEQ ID NO: 17729 - RNA, 723 nt, Homo sapiens
uuuuuuuuuuuuuuuuuuuuuuuuugcaagcagauaaaggcuuauuuuacuuuaauggcugaucuauguaaucacggaggccaguauguacacacaaaggggcagcuuuuauuucuuggucucuuccuccuuggacaaagucuugaugaucuccuccuucuuggccuggaggugcucuucauagcucuugugugcuuccuuggucuuagaucugcgggccucagccugaucagccaggagcuucuugcgggccuugucugccuucagcuuguggauguguuccaugagaaucugcuuguuuuuuaacacauuccucuucaccuucagguacaggcugugauacaugcggcgaucaaucuucuuagauucacgguaucuucugagcagccggugcagaauccucauucuccucauccacgugaccuucucuggcauucgggcauuggcuguacccuuccgcuuaccuaugcccauaugccugcccuuccggcaggccaagguguuuuuccggcaucaagcgggggaauggaccaucacaggcuugcggaugaucagcccaucuuugaucagcuuccggaucugcugacgggaguuggcauuggugauuucauuggucucauuggggucuaaccagauauucuucuugccacagcagaggacacuagaggcaagccucuucugaagccugagcauacucaaggcugcagccacagcagcgaaagg

SEQ ID NO: 17730 - RNA, 10344 nt, Homo sapiens
uaggagcgagcggcagcgccggaaaggaggccaagagcgcgggcggcgaggcaagauggcggcaaccaagaggaaacggcguggaggcuuugcaguucaggcgaagaagccaaaaagaaacgaaauagaugcggagccgccagcuaagcggcacgccacagcagaggagguggaggaagaagagagggaccggaucccaggccccguuugcaagguaggaggggauguccccgggcuacaccugcggcggcggcucugugcgccuuuucuuggguuacuuacuugacuacagccuugcuuaauuucagaguagcccggguguuaacgguaggucgguuuuagcaauucucccggccagacugggcacggaguuugcagcuaauccuugugcacguggccgucuuccuggaggcggcggguuuuaaaaccuuuacccggcccacggggaagcgacuuacagggugcucagauccagcguucuuucuuacuaguuguucaguuguuuuuuuuuuuuaauguuuuuggagaguagugcuuuuccuugguuauuucucgcuauuauuucuccagugauuaguaugcccauauacugccauagucagccacucucagucagggauccugaaguacguuaggggagccuuuaaaaaguuguugcccuugggacugugacucugacuuguuaaccaggucauuaacucaagagauacugaaaaauagacuagguaguaugagcuuuacuuguauucaacagacauugaaugugccaugcacuguaccaaguuaggcuuccuuuggguuugagauugcaaagaugacuagaaugugaccucuuccuccugaaauguuggaguuuaggaggaaacuuaagaauucaaauaaguugaugguuuuuauucaaaagaagugcacacaaguuguuagaauuagcuuucauucaacuaagaacucuucuuaagcuagacagaauacugugaacaaggauuaucuuugacauuaauuuuugcguccuccgcacuuagcauaguacucuagcgcggaguaggugauaaguaaaugaccccguguggugugauggcaagcucuaagaaagaagugagcucuguggaaugaaagauaaguguaaauucuagccccguuauuaacagcaacauucugugcucuuuucugaccugcagauuggggggcagggggagggaauauuuacuuuuuaugaaaaauaagcuggacuuguacacuuccaguaaauguuaguguucucacucuucccuugagcuagguaguaucuauaaucugagccauacuucgauacauucuauggaagugcaggagauauagauuauuuuuacccuaguauaauaagauaaagaaucaugaaggauuuagcccguaagcugcauaucagaggaaguguagaauuuugacauucaaaaaaugagagggaacacuccaagggagaaaaaaaaaccgaugaaagacuuugaaguagggaaaugcugaaaaauguaaaaaauagagccagauuggauugcauuaggcuucauuuggggcaauaaugauguagacgugaaaaucuauuuuaaaauucagugucaaagcuaugucauuugaacuuuguuuagaaaacucugggaaguaaggaugugauggaaguauuacuuuaaaaaugguccagcgugguggcucacgccuguaaucccagcacuuugggaggccgaggcggguggaucacuaggucaggaguucaagaccagccuggccaagauggugaaaccccgucucuacuaacacuacaaaaaaaaaaaaaucagccaggugcaguggcgggcaccuguaaucccagcuacucgggagucugaggcaggagaaucgcuugaacccgggagguggagguugcagugagccgagaucgcgccacugcacuccagccugggugacagagugagacuccaucucaaacaaacaaacaaaaaaaguaaacuguugaaaaagcuagucaaccauaucuauuggaggugcucaugucugggaagguuagccauuuaggaguuuugcaguuaauauaagacucuaaguaagugcagugugaauaagaaaggauuaagaguugugggaaauuauuaugagacaucugucauggagagcacagaaauaagagggcuaagaaagaacuuuuaggguuggaaggaggaauuggagagauugaaguugaaaaacaaagaaaccaaggagggcauuucuggguggcagauguggucagugaauguuggugagagaugaaauuaaaggagucaggaugguuugacuugguuaugagcuacuuggaagcucauaaaaaacaaacagggccaggugcggugguucuuaccuauaaucccagcgcuuugggaggccaagccacuugagcccagguguuggagaccagccugggcaacauagggagacucccaucucuacaaaaaaaaaaaaaaaaaaaacuagcuggacaugguggcacaugccuguagucuccagcuacuguagaugcuggggugggaggaucacuuacuugagcccaggaacuugaaacugcagugagccgugagcacuucagccugggcaacagugugagacccugucacaaaacaagaucaguucaguauaagauuuuaaaaucuuuuaacauuuucuuuuucuuuagggaaaguggaaaaauaaggaacggauucucaucuuuucuuccagaggaauaaauuuuagaacaagacauuuaaugcaggacuugagaauguugaugccucauucuaaagcaggugccuuuauaucauauacuuuagaaauuucuaucuauaaacuuaccuauuuuuauguuuucacuuauuuuauauauucuucauuuguucaguguucucacgaaaaaaacacaaugccuuuuauccuuucaagugccacaauuuuuccaguuaacauuucguaagaaauucuuuagauuucauuagguagauucuuuacuuuuuaaaacagguguccuaauauuauugaaacauuucuugaagguccaggaaugccuucacuguaaugcuucugaagguccugagauaggugggaugguuuguccuaagugcuaaggacugccacauguugcuuuuugggccuuuuuuuuuuuuuuuuuaacuguuuuuauugaaaaauggaccugggauagaauucaaagcacuuuuuaaguuggagucagagccuauuucuaaaugccagguuauuuauuuauuuuuaagcaguggguuauuuuacaggcaagaacaguauggccgggcaugguagcucaugccuguaaucccagcacuuugggaggccgagguggguggaacacuugaguccaggaguuccagaccauccugggcaacauggugaaacccugucucuacaaaauaaaaaaaaaaaaaaaugaaaaaaguaaaguaaauuagccaagugagggggucacuugccugcagucccagcuacucaggagucucaagcaggaggauggcuugagcccaggaguucaaggcugucaugagccgugauugcgccacuacauuucagccugggcaaggagcaagacccugucucaaaaaaaaaaaaaaaaaaaaaaaaaaguuuggaacaguggaguggcagcgccaucauauggcuguuguugugcuuauguugagaggugcuuugggguuuuuuuguuuuuuguuuuuuauuuuuaaaauuuuaacuuauuuuagauucaaggaguauaugugcagguuuguuacacgggcauaaagucaguuuucuuugacaccuaagauuaaaaagugaaagauauuuucauugaaacugguuuccuuuaacacagucuuugguuugugagaauuuucccauuuuugaaaaggauuccuagaauaccuaaauauugagaaacacugcuuacacuauaauuucuaauucuuacagacuauauuuuacuuauuuucuuuacauuuacaaagagucaagauuuuugagcgauuguuuccagcucuuguuuugaaaauuaguaauaaaaucuccuuuaaacugaagaguguaaaaacacuuuauuuucuggauagcauaugugguuugauugaaauaacuuugaaaucaccuuuaauuuacuugcuuuuucuuuuuuuucuuuuucuagauacuaaaauggaucguaaggauaagcuauuugugauuaacgagguaauuuuggaaaguaauugcaacaaaauauuuuuaaaauguuaacaguggcuuauuucaaaacuaagucauucagugacuuuaaaaauuauuuuguaaaaacuauucagacacauuuuauuaacucuucaauaacuggucuuccaaauuuuuaucucucacaguuuagugcuucauucauuucuguuuguuuugucugaacaagcauauugaaauuuccucaggagaaggauuaugucccauuuuuuaacccuguagugucuaguauuaugcuaaauccauaguagguacucaaaaaauuaucagucaacauauauaaaguaaaauaaguccauuaaacauauauauauauaaaacccacaugguaaaaaguguuuugccaguauuaaaagugauuuguguggaacuggcuauuaagguauuacaaacugaauagguuacauuuucaaaguauuguuuaagauacuacacuuagguauuuuuuuuaaccucuggaagcacagaacauaaauuuacauuuuaaagcaaaauuuucaaaacuuagaagaauuaggaucauuuuuucacuauuagccuucuuuagagcacaaauuuuugaaccucugcuguaauaccacauuauucuaugugcuguagaaacuguucaacagagcaaugucccugucauuauggaacuuacauucuaauggagacaggccauaaacaagguuuauaauuucaaguaaagacaggagaaauaaagcagguuauagguuuuggacagcugaggcuacaccggaaaaaccuguucaaagggaugguguuuaauauuugagcagagacguagugaaggagaaauaugguaaaagaccaucuagcuagagaaaauggcaacuacaaaagcccagaaguggcacaaacuuccuauuuuuguguuuauucuaagaccaguaagaaacaaaaguuuuguuuuuuuuuuuuaaguuguuaggguuuguuuauuuguuuaacugguuuuggagacaaaagucucucucuguuacccaggcuggagugaagugguaugaucucagcucacugcagccucugcuuccuggguuuaagcaauucuccugccucagccucccgaguagcugggacgacaggcacacgccaguaugcccagcuaauuuuuuguauuuuuaguagagauggagcuuugccagguugcucagacaauucaccuaccucggccucccaaagugcugggguuauaggcaugagccaccucauccagccauaaguuguuagguuuaaagucuuaaauaauguggaguuuaagaguacuauauuaauuagaguuuaugaauacuacaguaauacaagccuucacuccuguaauguuuuugugucuucucaagugugacuuuuguaagccuucaagacauugaaguuuaauuugaaauagguuugauauacuuaggcuuuucacccaaucccuuagugauuuuauagaaccaaaucaccagaaaugauaguauaaaugaagaacaacuuaaguuuugugaucuuagaaucaaaaagcuaaaaaguuaaaaaucaaaauaaucauuaaaaaggauguuuuuaguucuauaaguacugcauuuucauaagauuggcuaagaagauugauuaugaaggauuaacauaagaagauuaguugugguaugcuuuauccguagggcaucuauuuuuagucuuuguaguuugucaaugggacuaugggcagaagagguuccuggccaggugagguggcucacaccuguaaucccaccacuuugggaggcugaggcaggcagaucaccugagguugggaguucaagaccagccagaccaacauggagaaaccccaucucuacuaaaaauacaaaauuagcggggugugauggcacaggccuguaauaucccggcuacuccggaggcugaagcaggagaaucauuugaaccugggagguggagguugcggcgagccgagaucgugccauugcacuccagccugggcaacaagagcgaaacugcaucgcaaaaaaaaaaaaaaaaaaaaggagggagguuuccaguaaucagaagugagaccauuuuagaugcuaggcccaaaaauaugauagauaauuucacccaagauaugggcagagcaucuaguuuaccuuggguagaauaccuaagaggaacuuuaaagguuccuucugugaauaaauacauguuuaggccuuuguagccuauuagccugguuagguauuuuugagauaaucuggaugauauuaaucacauauaauuacuuuaguucucauuuauauuaucuacuucauuuuccuauacuuugcuuccuuuagguuugugaaaugaagaacuguaauaaaugcaucuauuuugaagcuaagaaaaaacaggaucucuauaugugguaagagaauguauuaagauuuugguuaaacucauuuaaguggauuuguucuuuguaccuuuuauguuauagacuccuaguguuucauguuaaggguugagaaugaagcaaacuuuugauuucacgaaacuugauaccuuuaaagaaaauuaaauguauaaauauuauaagcauauuauuuauggugaauaggugguaagcauugacuacauuugcuaauuaguugaaaaagcuuacuccauaucuuucaggcuuucaaauucaccucacggaccaucugcuaaauuccuuguucaaaauaguaaguugacucaauaaauuuuuuuagaugaggaaauuaaaaguaaucuuuugaaauaguugugcaaaaguuacaacuauuuuuguuuuuguuguaauuuuucuaguucauacccucgcugaacugaagaugacuggaaacuguuugaaagguucucggccccuuuugucuuuugacccuguaaguuucucauucaguguaugaggucuaauuuucuuaucuggcaugguuguuuuuaguagauauaguuguguuauucaauuuaguuucacccccaccuugguuuuauggauuaucaauucuuucagguacauuuauaaugagguuauagccaaguuauagaaacaaaugagcaaacaguuuuaaacaaggcagucuacuguuaaauaauaugcuuaccuuauuuuuauaggcuuuugaugaauuaccacauuaugcuuuguuaaaagaacucuuaauucagguaaauaucuuuaaaauuagcuauccaaaauauacaugauauaucuuggaauaaggaacuaacauacacuuuuuuaacuagaucuuuaguacaccacgguaucaucccaaaagccaaccauuuguggaccacguguuuacuuucaccauuuuggauaauaggauaugguuucggaacuuucagguaagcuuuacuugauuuuuaauuauaccuuuuuuuuaauugaguuuauuuauuuauguuuugagacagagucucgcucuuguugcccaggcuggacugcaguggcacaaucuuggcucacugcaaccuccaccucccggguucaagcuucugcucccucagucuccugaguagcugggauuacaagcacccaucaucacgccuggcuaauuuuuguaguuuuaguagagacgggguuucgccauguuggccaggcuggucucaaacuccugaccucaggccaucugcccgccuuggccucccaaagugcugggauuccaggcgugagccacuacacccggccuaauuuuuuuuuuuagagauagagugucgcaguguugccuagguuggccuugaaccuccuggccucaaaucauuccuccucagcaucuugaguaggugggauugcaguugugagccacugugccuggucaauuuuuaguuaaacuuuuagauaaggauauacaggguuugcauacacaaaaaaugcaaauaauucuuuuguuuuaaauagcuuccuuuucccuaaagagauugcugcaaguaacuauguacugucuuauaucuuaagugagcucuaccuacuucuauucaugacuguuaguugauacagaguauggauuuccuaauaagccauuauauauuuaacuuuauagaaagggaauaacuugaagauccaugagauacuuggguuccuaauuuguagaaagugcuguaaaggauacaguaaaauagaaguuucucucucaaagcuuagaaguuucucucucaaagcaccucaaagguuaagaccuagcaaaauguaauugcucuagaaggcauucaauggcagcgguuagaugaugagucacacagugacucauucaggagaaaagaggaggugacucuagaaaucuugaagcaggaguuuggcacgauaagugcagaaagaugaagagguggaagagaacagcaagaacaaaauuuuagacaguauaugacauaaacugagcucuuuucugcauauuuuauauuggauaccuggcaugugaguugaacacaucauccuaaccucugaggguagacaugccugaacuaauagauaacauaaauauuuguuguucggaaguugccuuuuaauuccauaaucaguagcuauuaaauaaauuugacuacauauccuuuuaaucuaacuugaauuagauuuauaaaaacaauuuagggauugauuuaaguuucaagaguucccccauaaugugcuuuaauacauuuuguuaauagugguuacuguuuuaaaauccuguuuaaccaguuuuucaaggauauaugcauugugacaagcaagaugugaaccaaaaucuaauuacucaauuuuaaaagaacucacugaaaaaacauuuuuccaugacaacuuccuauaaguacuaauagauuucagaaaauauugaugauuugccauuuaccaaguuucacccccaccuugauuuuauggauuaucaauuauuucaggcacauuuauaaugagguuauagccaguauaccuuuugggaauaacguaaccaaaccaaaaugaaauguuuccuuuuuauuaaagaucauagaagaagaugcugcucuuguagaaauaggaccucguuuugucuuaaaucucauaaagauuuuccagggaaguuuuggaggaccaacuuuauaugaaaauccucacuaccagucaccaaacaugguaagcgguugugucauucaguagucuucaauguaccagaacccuuuggccaaaaugauucugugaaguaauugcuguuuuauuaccugugaaacugaauuugguuuuugcugcauagaaacuuggaaauuacucccuuuuuucaugacacuggcugaaaggauauaugguucauaacugaaagucuuugccuuauauaaaauguuuauuuuuauuucaaaagcaucuaaucuuuuuuuuuuuuuuuuagcaucggcgugucauaagauccaucacagcugcaaaauacagagagaaacagcaagugaaagaugugcaaaaacugagaaagaaagagccgaagacucuucuuccacaugaucccacugcagauguuuuuguaacaccagcugaggagaaaccaauagaaauacaguggguaaaaccagagccaaaaguugauuugaaagcaagaaagaaacggauuuacaaaaggcaaagaaaaaugaaacagaggauggacagugggaaaacaaaauaagucaauggaaaccugauuuguuuuucaguuacuuuauauuuauuuuguauucaauguguaaauacuuuuauuaucuaauacuaucuuacgucuaauuaguguagcauuuacaagaaagaaaaauuaagaucuuaaaaucagugauuaucuuuuucuaaauaaaauaucaccagaauucaucaguuaauuucugauuucuuuuugaaguuuguguugcuaaaaauguagcacacuuaauguagccuguucucuuggguuggaauuuuugguuuagcaaagcugaaauucagacauuuauuaggucauauuauuuguaaaagcauucaacacuucaagagcaucgguuguggaugguaaaguaggaguagacugguagaaaggaaggcaucucacugaaguuuacucagucaucaguuaaugaagccauggaagaaccaaccccugaucugucacuucaaaaaagaguauauuaaaauguugagguuuugagaaucaaaugcauuaauggcuguguugaaagcacuuuguaaau

SEQ ID NO: 17731 - RNA, 13122 nt, Homo sapiens
ucugugccgccuccuuccggucucgguggcgcggcacgcgcggcucucuaggccuccuucagcucuguggugacgguggccgagguggagggccggucugaagaguggcgggacuggcuucacuuccuccgcgguuccucggagccgccucgcuccucuucagggacuuugcugagaagggcucucgggcguccagaccccaccgcaaagguaggguuuccgcacucggggaccccgagacuaguaagcgaugcugucccgcgggcgggcuggugaaugggguugucugggacucuuggaggauuaucuggacacuccgggcccgccccgccaucgccuguuuuguuggaggcggggcugguggcgcgggcugcacaaaaccgacuccccgcggauuuguagcuccuguuuggccgggagauaccgugucaguugcgugucuucauucuucacaacuuuucacguuauuguccucuuacggagacgaggaaaccguagcuuagauaauuuuccuccagaauuacaaagauaguuaagugacauaggugggguucggccuggucagccguguucagccucccagccccuuuccaccucucagcgcagguggagcucgccggaccucgccagcacugaugggaguuuuacugucuaaucccuucagguguuuggcgauccgccgagaaguuguuggccccaggagcaucccucggggccgaaugcgcaguggacgaugccccuucugacccaacagauccaagacgaggaugaucaguacagccuuguggccagccuugacaacguuaggaaucucuccacuaucuugaaagcuauucauuuccgagaacaugccacguguuucgcaacuaaaaaugguaucaaaguaacaguggaaaaugcaaagugugugcaagcaaaugcuuuuauucagguauggaaguaggcgccuuuaagccugugccauagauacucuaaauguaauuuaaugaaaucggaagguuucaguagacaaaauaacuuaauagucauaauaacuugucaauagucauaauaaauaacuuaauaaauaaauaauagucuuaaguuagagaacaaaacgucauuacuugaauuuuuuuucucucccgguaacaaauucuuuucccaucuuguuuuacagagauaaugguuaguaaugacuaaaguuuauuaaacuaggcuauuggcuaggcuacagucuucuuauuguuuaacuuauuuaaucuuaacaauaguccuguaagguagguucuguuauuauucccguuuuauauauguggaaacgaggcacaauuuuaagugauuugccaacagucccacagcugguaaguggcugaauugggauaagaacgcugaauauuuguuuccagaauauaugcucuuuuuuccacugcgauaugcuauuacuaaagaguauuuuuuuccuuuacugguuguaauagaauuuuuguucuuccaaaguaauauuugugugguucagauaggauugcaaguucaacuaagcguuuuuuaacacguaagugcacagcaugaucucagggauagagagguaaauaagacacgguucuuguccucaugcaggggcaugguaugguggcucacaccuguauuuccagcugcucaggagaccgaggcugaagcacgaagaucgcuugagcucaggcauuaaagaccagccuggguaaucauagugagacccccguaucaauaaaaaaucauaauaaaaguugaaacuaauguugcucaugcauuaucaagucauucgucuauuuuccaagugaccuuagcaguagugauaggcacaaaaacgagacaagggagagucacagagggauaguuuuagauccaggaauggagauaaggaugcuucaaaggaugucucuaagauguuuugauugcuaaucagaaauuauucucaugggauuagcacaguauuguauuuuuuaaacguauaaagugaaaucuaggaccuuauauuauuaguuuuuauucuuuuauguaacaauuuucauuuuuacucuuuucauaggcuggaauauuucaggaguuuaaaguucaggaagagucuguuacuuuucgaauuaauuuaacuguccuuuuagacuguuuaucuauuuuuggaucaaguccuaugccagguaaacuaugaucaguauaaagacauaaaaguguuauacauaguggucagaaaaauacaggaaguuauuuggaacauaaacauugguucagaaagcuaaugccaauucauuuuucaguggccacagucauggguucuaacauuucacaauguuaauugcaaguguguuuauaauucuuuucauauuuguaaaaguauuugcauuuuuuuuuuaauuuacaaggcuuugagggauuguaaauucgaacuggccaaaagaauacuuuggacaugucuuaaauauuuuuagcauugugaaauguuuuaauugcuucuuuuuccuaacuuguccagaauuacuccgcuaguuaguggcagagaaaaacaaaagccaguucugacuccuaguuuacuauguucaaaauuuguuucuuuuaagccauauuuuauaaguuaugucuauuuugccaaaugauuuugugguguuuuugagacagaguuucucucuuguugcccaagcugcaguacaauggcacagucucagcucacugcaaccucugccucccggguucaagugauucuucugccucagccucccgaguagcugggauuacaggcacgugccaccacgcccggcuaauuuuuuguauuuuuaguagagaugggguuucaccauauuagccaggcuggucucaaacuccugaccucaggugaucugcccgccucagucucucuaaguucugggauuacaggcauaagccaccgcaaccgguugccgaaugauuuucuuuaaaauauauauuuuuuuauuuguuaagggaauuuuuaagaauggugaaauugaauugcuguggguauaaaacuaaggaauccccagaagaaugauuuuauuucauaggaaagcaaccuggagauuagcuaggaaaaauucaauauaguucuccagaaaaauguauuuuacguuuccacagacaauuccacuauuauuaauuauacauuuucuaauacaguguucuccagcuaguuuuucacagaagcaucugucaucuuccauuccucacuguggcucucaauccaguaaggagaaggaguuugaauauccugucauauuccuccuucccucuagugguuugcagaguuaaaauuuacaccaccauuaacaacccucuuuuucucucaauuugauuuuuaaauucgaggaaauauaaagaauaucucccaguuggaaaaguuggaaggauccuugucauagugaguacacugacguuacaguacagaugacagcaauccacuguuacacacauugaaccuucaaggaauagcauacccuguucugcagcaauuuaguuacuugcuguguugauccauauagauucucuacccugaaauuguacauauauaaaaucaacaagcuauuucugagguguguaugacaaccugaaaaugauuccaaagaauuauguuacauuuuguucugguucccaauuuucuuguaguuuuggaauucucuacacacaacugucaucagggaagaugucaucccuuuuuaugaggagauacauauaugugagaaauugggcggaauaaauuauucuugagaaauuuuauguaucauuucgaggagaagcugaacccagaacuauaaagcuaaggccaaguaugacuucuuuccauugcagggacuuuaacugcacuucgaauguguuaccaagguuaugguuacccuuugaugcuguuccuggaagaaggaggaguggugacagucugcaaaaucaauacacaggaaccugaggagacccuggacuuugauuucugcagcaccaauguuauuaauaaaauuauucugcagucagaggggcuccgugaagcauuuucugaauuggauaugacgagugaaguccuacaaauuaccaugucuccugacaagccuuauuucagguacuugagagcagugcaguuauaguuaauguggucuguacuccaucuucccacuuagacauuugcuuaggaugcaaaauuuuuauuauccacauuuuuagaguuuucacaacuuuagacagcuuguacucuuaccucauaauuuuauggaucaagaaacuuaagacccaggaagauuaacucacuauuucauauuuagguggugguggcaucuagaugagaagcccaguccucuaauuuauaaacuggugguguuuucauuguacuacuccuuacuuucauagaucagguuacaucaugaggaaaauuggguuuaaguguuuggaaaggguguuuguauuaugguaucuuuuucaaguuaguucaggaugcagaagaagauguuuucuacacguggcucauucauucacuaaguaucuguugaucaccuaccgugugcuuauucaucuuauuaagcauugugggaagaacagcuuaaaaccaaggugaagccaagaaaaugugaaacagcaaaccauuaaguaccaagauagcacacacagauaccugggaaaugcuguauaaggauuuagggaggauugcucaaggcuggcuucccaagggagggcaguuuucagcaggaguacaaugucaaaaaagcuguucuugauaguuuaacacaagucucuuuucaggauuagacucagagauucuagcaauuuagagagaggaucuaaauauucucuuuuugaaauauuucagaauauuaaagccccuaaauacauauggaauaaaaggaauaagguauucuuuuuguaacuacuuuagaagaauuacaggcccggcuguaaaagugcuguggcagacaccuguaaucccagcacuuugggaggccgaagugggcagaucacuugaggucaggaguucaagaccagccuggccaauguggugaaacccugucucuacuaaaaauagaaaaauuaguugggcgugguggcacgugccuauaaucccagcuacuugggaggcugaggugggagaaucacuugaacccaggaaguggagguugcggugagcugagauugcgccacugcacuccagccugggugacagagugagaaucugucucaaaaaaaaaaaaagaaaagaaaaagaaucacaggcccuugucaugacuuuggggaguuaaaaauuuggcucaaggucugagaaaguuaaccaaaauggaaauuggaaaccuuacuuuagcaguggaaugaaguaaaaaauucagguacuuaaaacaguauuucaggggaucuccucagugaucucucucagccuggguaacgagauggaccaugguaucuuucaucuccaggaugggaaacaauuuggugguagggagguaggaguugaaauuuuuuccuggauauguuaaauuuuaaguaccugcgacacuagggaguggcuggauauguaguuauggugcucaggagauccauuuagacuggaaauuuagauuugggaaccaucaucauggcuggguauggaugagacgggucagagagagagauuauauuagaagaaagaaaagauggaccccaggaaaaccacaccuggaagaugggaggcagaaauggagcuuagggaaaaccaaccuggaucuuaucgccaugcucauauaauacuuagcaacgugcuaauccugcagcaaauguuccaggaguucuugcaaauuaaaucagcauguuaacacuuauaaauugucuacaaauaacuucugguauuaccaagugaggaaaaccaugcaauagccuuaagagcagucuaagauacagaaaagcuguaauuccuagguguaggauugggaacagaccuaaggguugcaguagacuuagaucaaggucuuccaugaguccucaauucucucgccuguuauauauuucugacuuaaggaugaggaaaagucauuuucagaguaggauuaggguaaugaaauuaaaguguccccuacccuuuuccuuuuacaauugauuuucuucaaacccauugauuaguuguccugaacuccagugggagcuuuauuaugguacuuguuaucguguguuauaagcauuuguguacaugucuguuucacccacuaguaugaauuucuuaaggaaguguuuucuuuauuuggauccuaaugugguuuauuuuuggaugaaugaauaaaugagguaaucauuuucuauagguuaucuacuuuuggaaaugcaggaaguucccaccuugacuaucccaaagauucugauuugauggaagcauuucauuguaaucagacccaagucaacaggucaguucuuaauauagagguugucauuggugauaaagaggagguuaaauaccagauuucuguuaaauaaaaacacuuucaaucuguuaauuaaaaugcacagcauuuuauaaaaaugaauaguagagugcuggacuuacuaggggauguaggguucuaacagugaaugaauuuuaaaacagaaaauauuagcaaauuggauaaguacuugauuuuauucuuagauuugcuacuuuuuauccuuuacuugggaguucugagcaguguucacuguguugauauaacagcguuuuauuuuuucuucuacagauacaagauuuccuuacugaaacccucuacaaaggcauuaguccuaucuuguaagguaucuauucggacagauaacagaggcuuccuuucauuacaguauaugauuagaaaugaagauggacaaauauguuuuguggaauauuacugcugcccugaugaagaaguuccugaaucugagucuugaguaugacaauucacugauauuuauguguacauuuaugauagaugaaguucuuauucugaguacaguacucuuugucauuucauauuggauuuucuauagagaagaagcacaauggggaagauaggagcaaggucauguacccuaauaguuacuauguuuuguaaauccauuuuguagagggcauguaaauaaauguuuuccuguagucauagauuauucaggacuguccuuuaguucugucuuuugaacucaugggaauaauugugagucagcguaacauuucaagagucuaaagguggccgggugugguggcuuuaaucccagcacuuugggaagccgaggugggcggaucaccugaggucaggaguucgagaccagccugaccaacguggagaaaccccaucucuacuaaaaauacaaaaaauuagccggacgugguggcacaugccuguaaugccagcuacucgggaggcugaggcaggagaauugcuugaacccgggaggcggagguuguggugagcugagaugacgccauugcacuccagccuaggcaauaagagcaaaacucugccucaaaaaaaaaaaaaaaaaaagucuaaaggcuuaaaguuugaugcagcuaccugaaaugaucuuuuauuuauuuauuauuagaaaaagcaaaggcauaugggcauugcuuauuaguuugaauucuagagacuagaucuuaaaguagugguucucaaaguguugugcccgcaccaacaucagaauggccugcaaacuuguagcaaacucuggggaggaggccagcauucuguauuuuaacaagcuucccucaggagauucugaugccugcuaaauuuugggaaccacuguuuuaaaggaaacuuuuuuuuucuuuaauagcauuuaauuguaugagaugauugcuuuuacaugugauuuccuugcaaauguucugaaguugaggcaucaccaaacaagucugaacaauucuuuaugugauuuauuuuuaaaguagaccuuuugaagagaucuaugaaugggauauaaagcaauuuucaguguuacagguuuucuucuucuucucaaaacuguuugcuguaaguaacugcaaucaguacuuacuacuuuccauuugcuuaugaguuucuugacaaaucaagguguagaaaaccaguuauuaagugauuuuguacuuuccugguaguugucacuaaaauaauuuuuguggcauauaaauauauuuaauaaaaugcaaaaauuaucuuccugucuaguagaaaaaauuacaugaguaaagugaagcuucugucuuuguuacuguaccaggugacaacagcugagugucccuccauggacagucacuauuggccuuuugagugagacaguucuuuaggauaaaaaccugucaucccauugcaggauucauuuagccuuucuggcccuuacccacugaugcuagucauugugaccaccccaccucccccaaauaaaagugugccaaacuauucauuguugagaaccauucaauuguauucaccaaaauuggaggauauauuggaaugcccuaccuuaauauaggucacauagcauuagagaaaauugguuuggagaguauuacagcaaagugugcugcaaggaggcuacuccagcacaauggcaggcacugcuucccaggcauauggacaauucugggagguggccagggucagcaccugauaacuaguaagugucucaaucucagcauacaaaauuuagcagugacuacaaaagaaguuggaauuuucuaaaauguuuguauucaagaaggaaacaaaugaauuuacuaaauguugucagaguauuuuuuguuuagauaaccaccaagaacagaacaaaccuaaaagauacuugggaaaauaucuaaucagucaacauucuaaggacuguuaaaugugaaauagcauaguuauuuuuugucuuuuguuacuagugugaacaaagaacggcgccuaacauauaaugggcauuuaguaacucuguuagaugaaagacucuccaauuucagauuuucuuuuagcaucuuauuagucacuacuuaauucugaugauuuagcucuaaauuuauuuugaucucaguuuuuuuauuuuuauuuuuggagacaagaucuugcucuguugcccaggcuggaguacaguuguaggauuacaguucacuccagccucaaucuccuaggcucaagcaauccucccaucucagcuucccaaauagcuacgacuacaggugcaugccuccaugcccugcuaauuuuuguauuuuuuguagagaugggguuuuacuauguucccuaggcuaaucuugaacuccugagcucaagcaauccacccgccucggccucccaaagggcugggauuacaggcgugagcuaucaugccuggccuaauguauuuuuuaaaaguugaaucuaaaaagaauuuaaaacaaauauaaaucagcucaguaaggauggauauuuuuguacauuuaaaacuauuauuuuaggccgggagugguggcucacaccuguaaucccagcauuuugggaagccgaggcagggggaucaucugaggucaggaaguucgagaucagccuggccaacauggugaaaccccuaccucuacuaaaaauacaaaaauuagcugggugugguggugggugucuguaaucccagcuacuugagaggcugaggcaagagaaucacuugaaacuggaaggcggggguugcagugagccgagauugcaccauugcacuccagccugggugacagagcaagacuccgucucaaaaacaaaaaaaauuaaaauaaaaauuauuguuuuagcugcaugucuucagcuauuuagaauucaaagacuaaugaauuguuucuaagucacccuaacaucaagguacuuauuuuauaaagaauuuccuccuuauuuguguucuaauugacccaggaauuuuuacuuuaauaaaaguuuaacuuuauuuccuauggaaaaucacuagggggagugcucccucaggcagagcaggcgacacuuuggugccacuacaaauugauguguaguauauagaagaauacagucuuauauuuaaagacuuuuaguucugucuuuuugaaguuuaucucucuuucuaguaaaauggugcuuacugugaauggauaaucuuuuuuuucauuuuucauuuguugauuucccauucgaugauguagugcuuccaccgagaauugaugaaaugcuucaaaauaauaaaaguauuuguuaaauuccacuuuaauaaaaauaaggcauguaacacagucauuuuaacaggaagccacaggguuucugugguguuaccaaaguccuaguaaaaauuaauuaaaauugcuaaaagggcagaauguggcacucucaacagugggguaggcaguccuucagaacauagagacuuccuucuuuccuucccugucuucacauugcuugucccuuauccccaccugaaauaaaaucuauuggguccugagaaaucggaguguauaguauuuuuucuuuucccaauuauguuuguaauuugcuuucauucucuuuggaauaggcagugcugcuuuuauacuagaaucagguuacaagcaccccaggaggagucauuagcuuuaacagaauuucccucucaggaguggacagcuaguguucuaaacagaaacaccaaaagcagcgguuucaagugcuuuucguaucuguaucucagucacguccagagauuucgauaaucagcagaguaaaugugugaaauauauuuuugaaauucauagcuuguugaucauuauaauagauacuaguaguggcucucacuggcaaaacuagagguauucaggauaugugaacuuacuaaauuauuucagaguauuuccucauacuaaaguaaaaaggaaguaacaaucuaguaaacccuguggccuguacccuuaggcauggugccugacacuugauuccaaaauggucuugcuuccugccauuuuguccaaggauuuugguugccguggcugacuacguuaggacaguacuauuucuggaauauugucaagccugccuuaaguggaccuuuaaugcaguggugggugaacuuaccaaaucagcagguaguacgucauugaacauacagaacagguuacauaaacuuuuuuuuuuuuuuuugagauggagucccacucuguugccaggcuggagugcaguggugcgaucucaguucacugcaaccuccaccucccagguucaagcgguucuccugccucagccucccgaguaguugggacuacaggugcaugccaccacaucgagcuaauaauuguauuuuuaguagagaugggguuucaccauguuggccaggauggucucgaucuuuugaccuugugauccuccugccucagccucccaaagugcugggauuacaggugugagccaccacacccagccguuuacauaaacuuuuuuguuugcuugcuaaaaaauguuuauugagcuaggugugguggcucucaccuguagucccagcacuuugggaggccgaggcaggaggaccauuuuagcccaggaguuuugagacuagucuggccaacauagcaagacuccaucucuaaaaaaaauuuuuuuuuuuuaauuagccagguguggaguaugcauguagucccagcuacuccagaggcuaaggcgggaggauugcuugagcccaggaguucaaggcugcagugagcuauggucaugccacugcacuccagucuggcaggagagugggacccugucucaacaaaaaauaaaauaaaaauaacaauauuuauugaaaucuguaugugagacagcuugaucugggcuugaauuauuuuuuuuucuaacuugguacagagauuguuggaaaauagcuaauccucauccaccucaaaaaugucagugcuuguuagcuaauucagaagaauuguaagagcucuguauguuagcucagaucuguuagaaaugucagguguuugauuggauuggguuauccagauugguugaauuuagaaaguagcuucugugguuuugcagugagaaugcaacuuuauauuucuaauguggcuuguuaagacuuugggauuucaccaaaauaguaaaauuuuaaaacuuuugggcagagcacagaggauuuuuagggcagugaaacuaauauguaugauacuauaaugguggauauaugucauuauaauuuuuccaaacccacagaauguauaccaccaagagugaacccucauguaaacuauggacuuggguaauaaugcugugucaguguggguucaucaguugucacaaauguaccgcucuggugggagauguugauaagggagaagcuaggcaugugugcagguaggggguaaaugggaaaucucuagcuuucccuuaauuuuuuuuaugaaccuaaaacugcucuaaaaaugccuuugggaaaaacuuuggggaccaacauaggugccaacuuauuuuacuagguauaaggauguuaaaauuauaugauucaguaucaccaccauuuuauaaaacauuuuaauaucaaaaccucagacaauggcaaccuuacacugacaauaaagaaaaacuuuaaacauuaaaaacaauccaaaugcaggaacagguacaccauaaaauuuuauuucacaguguuaugcuacuguuuauugauauagguuugucaguuuggagaucuuaggauugcaaaauaguaacauuuuauaaauuuuggugccacccaaaauggagucugaauggccauuucuuucugguauuuuuuuuuuuuuaaugucagucauuguugaagagcuauuuucaacuacguaugugaaaauggaagcaacucuucugaugcuacuguaaucaauucagaauauucuggggaagaacagcagccccaucuccagaaagggcuaaaaugaacaaugauaggccaagugaccaguuaauaagcaccacagagaagggcaauggaauauauagcugcuuucagccaggucugcaaugugggaccuugauccugagugccaacccuaaagcauccugggaguuagucggcaacugccaggagaaggccuaccagucaguggacaaggcuuuggcuuaguuaguauaugugugcuucugccacagcagaacacaacucacuauaccuuggguacugguugauucuuagauuuuacaggcugaacaaaugacugaaauaauuuccugaaugaagaaccaaaaugugguucuguaagcacug

SEQ ID NO: 17732 - RNA, 1244 nt, Homo sapiens
uggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaag

SEQ ID NO: 17733 - RNA, 952 nt, Homo sapiens
uuuuaacacauuuucaauguauuuaaaugugcgggacuuaauugucagaauucucccgcccaguguagcccguucacauugcaaaugacuuggcugcaguaggcacagaagguccaguuccauuuugacccgccccgccgcgcggcggacucccgcgaugcuccucuggucacggacuucuccagagccgcuucccuccggucuccaccgcugcuguggcuauggccagugggaggacugggucuccgaggcaggaccuuucuuggagucgcggaaccccagcacagugccucgagcgcuccagagaaggagcgguuggaucuuugagcacucagguuggaggggagcgugugucguacccgggggaccuaccgggaacguuuugggaaagacagucccuuuauuuagguaccugguuuagcaaacaaagccccgaggacgcuuuggggaugcuuuccaagcuuugugacaccuccagaaguugaaccauucccucgccuuugggagcaacaaguuucacuuuccugcucucagugcgcugacagaggguccgugagcugggacacugugaccucggcaccgcugcgauuccagcgcaaaccugcguggcccagggggagggggcuggcgcggggcugaggaaggcgggguguaggugacgcccgggccagccgggcacaccagguccgcgauggagccaucugcacugggaccuugguccuuguucccugaccuugcgccgagggaccaggaaggucaggugcucgccccgcgucggugcuucaggagggaauguggccagaacgagaaaggugagagcaagcggcaccuaaggauuuuugcaccgaaaccacaauuucuagaaccaucccuuucccccaguccugguuuuuuuuuuuuuuugcacgguguguguguguauauguguguguguguguguguguguaugugu

SEQ ID NO: 17734 - RNA, 19063 nt, Homo sapiens
aaaccgggauaacacaaagggcacauuucuuacuuuuauuucaacauuuaaaauauucacagauggaguauuauauucagacaucuccauggaagauguacgaaaacaaagcauacaagcauuccacaauuacagaauuacauauuugugauuaugugaauguucacccuacaguuuaucuggaaaaacacuuuuaaaaaaaaaaaaacuuuugaguguuucacuggauuaacugccauaaaaaaugaacugcaaagaauuucaggagagauaccuaaauuuaaguacuuuuacuuuuuaaaaauuucaaacuuuuauaguauucugcuaacauaucuccugugaggaacacuuaauacugaauuuuccccucaauagccaagucagaauauacuuauuucauuuuucacccaagucuuuguuucuaaacgcauuauguagaauagauuugaucgucacagcaucuugaguagcuaaugagguaggaguauucuuaaguucuuaggcauuaaugaagcaaagcaaaagacaaucaaauuacaaagauuuucuuuuguagugguuguucuuuaaguaaaaugcuaagagcacuggaaauuggucaaaugcuacucacauuuuaaaaacgaagaggaaaaacccauuagaaagcccugauacacauagagucuguuaaagggaaaaaccugaguacuggaauuaaauucauuuuggcauuguaagguaagguaucuacgccuaaaaaugccaaguuuucugcccaggaaaaaaaaaucuuuaccaaggagauaaaauuuaaacagaaaacaaaauuaaucuauacuuucuuuucagaacaaguuaauuugcuuuuaacccaguucucuuuuccuauacacaaacugauuaauaauuucaguauacugcauauccaguaacacauuuaaaugaaguuagcagucaacuuaccaacugugccagagaaacacuccuuauauggaggcuucauuaacauaaugcugaacaacuagaaaacauguagguaauagauuucagcaccaucuguuaguagauuguuucaaaaugcauacacccccuaaauucacauaaaccuaggaaauuuacccaucauucccucugcaucuacaccaaaaaucaaaguucuguacucgaacuacccuuuccgugugccaaaaauaagaaauauuuaaaaaucuauccaauuaaguuaauaggacacaaacauguuccccaaaaaaggagggaaguuaccaaucaagcaugaugugucuaaaguacaaacuuugggaguuucucugaaccuacucugguucaaggggcugcaaaaaauacacauuuuuaauacacugguaccuauuauucgaugaaggcuaaauuacaagagauuuaccaauuugaaccucauaagguuacugcuaaauauacuuuaaaaagucaucuaaaaaauguuuuagaaauacaacagaauagcugauagaaaaaaaaauugauaacuauguggccuggcaaaugauuuucaaauuaaguccuugacaaguaacuacaaaauguuuuagauguaugaaucaaacuugguagcaaaauagugcaaaacucuaauauggcagaccuuaauagcagguaaccauuugagauuugcuaccaaaaauaauuugucaacaagaaucuuuuauaugucuuuaaaacuuuccuuuuucuacucuaccuagaauuguguuccacugcuguuauaaaaaucucaaaauaucauauguauaucauuuagauagaagagaauuauuuccucuucacugccgccuccuuuaauuucaguuauaauucccuuuauaaacauucuuuuccuaaggcacaccaugcccuauuuauugccacaaagccacuaaaaucugugccucaaucugucugcuucaucaguaugguuaaauacaaaccacuuacuagugucugcuaaaacuuaguaucaucaagucuagaaugccauuggucuguucuacuggggcaaaggccaaaauacacaagcaugugcucauaugcucuuuucccuacaaacuaaccauauuaccuacuauaacaguaaagcuuaaugacaucucuggcuacauauaauucauacccaauauuauaaaauaaaauguuaggccaguaagcuuucacaauuuuuauuaaauccuagucuaguugaacaauaucugauguuacagacaucaucccauggugaacauguuuaauaagugaaagcaagucagacaucucaucuaagucauuauuuucugcagacuaagcaauaacuacacagaacacuauggguaaacaaacaccugcucaguuuucacacaagccauguuguuuaucaaauuagaucugcuaauauugaauacaguagauucggugauuguaguucucauauaaguaucuuauugagauaacauuuugacaguuucacugacuuuccaaauaagcauaccauaaucaaagaaaagaauaaagagugaaguaaaaacugaacaugaagagauuaaguuauuaaaggaaaaugaaguaaauaaaaagagugaaaaaccauuggggguggaagucaaacaagccuagacauuugauuggaagagaaaagaucaaauaugaaguucacaaaccaaaaguuuauaaacucaaugcaauacaaauccuuuuuauuguaaaagcugaguugaaacuaaaagaucuauaaaaacuguuacuuuuggccuuaaacaguaccaacucuuaugaucaaaaaaggccacaacaguuaagauuguauuacuugauuuuauuuuacacuagguggugggcagacaaaguaauccuuaauaaaguugacaauuagcuucacucaauauuuuuaauaaugcacauuaaaaaaaaguauucaucuuacaaauucuucugcaauccaaacauacaauagcuuggagaacauuuagaaaacaaaagccaauguaaaaagacagauuaaaacaacuagaacaguacagguuuuauuuauauggcucgaauuuuacaguuuucuuacugcaucaucaaugucagaaaucuguuccuucagcuggcuccauuguucuggauuuaaagaaauaccuaaaacaaaguuuaaaaauucaaaggugaaaaucuauuuaagcguugaggauuuucauacuuccaacuagaauacuguuuuaucaaaauugccacuuuaggcugggcgcgguggcucacaccuguaaucccagcacuuugggaggccaaggcggguggaucacuugaggucaggaguucaagaccagccuggcccaacauggugaaaccccaucucuacuaaaaauacaaaaauuagccgggcaugguggugggcaccuguaaucccagcuacucaagaggcugagacaggagaauugcucgaaccugggagguggaaguuacagugagccaagaucaugccacugcacuccagccugggcaagagagcaagacuccaucuaaaaaaaaaaaaaaaauugccacuuggacacaaugcuacaauacugaaaaucauaucucuuacauuuguuaauuacauaucaucacaauuuacugagcauuaucaaucucauauccagucuuacuuuccacagugcauccugcauaguaccuauuguaaccaaugagaauaaauaaggguuugaagacacaucuuacuaauacccgucaacuaucaggcuaaaauggucagguccagauuuggcaugugauaccccauuacuauauuuccagcugguuccaauauuugcccaaaauuuccacaggaauucaagccaauugugcugaguucuuccagaagcauucauuucacuuuggaaaaauucccaggacgugauucauacaggacuccucagagaguauacccggguaacugcacucuagggucacccuaucaggguuaaaauuccagccucacuuucacuaaguguaugacccuuaaaaaagaacuacaucaccuuguaagccuuaguuuccucaccaguaaaauggcaucuauacgccaaagaguuguuguaaaugauuaaguaacaugaauaaugaacuuagcauaucaccuaacacauaaaugguuaaaaaaugugagauaugucuuuccaguuuaagauguaaaaguaugaacagaaauuuuauauuuucuauauuuuguacuuuaacguucuagcauuccaauaccgacgcauauaaacagagaaguaaacaagaacuggcagaaaguauucccagaaaacugcuggaaggccaugaaauugaaaaaaaagaauaaacaagaaauauggcaucggccacucugguacgugaauuaccaauccagaagugacuugaagaaaauaugaaagcauauaaacacauauagaggcugaguuuaaccaaaaaaaaaaaaacugcaugaagcaaacaagugguaccuuucaaacuaacaggcaggcagaauaaaacuaaauaaggaagcauuuuucuuuagcugagggucaaccuagagcagcaauccaaauauacaaauuuagguuggcucaccuucucuagcuguuuggugaauuauacaaaauauguuucuacaaugcuaagaggcuugggacuggaugaagcacaaauggaaggaaagcagagauccgcuugaagaguaaugcccuaaagaauagcuuuuaggagcugaaucaaaaggaagcauuguaaaccaagauuuuccauuccugauuuuacaaguucccagauagugccuaaucugcuucagaauugcauaaaccuuuuuaaaaauuguucaaguaaauuagcagccaacugaagugauauuagggguguuacuuuucuggguuuuauucccaaaagcuguauuaagacaucucauuaaaaaaauguuaaguaucauguccaaaauaacuacagaagauagagaaucaauugaguaagacucuuccuugccccguguguccugccaacauuucaaguaagcuacucagaaaaguugucguuuaguccuaacacuguaauaaaauucaaguaauuagaccucaccuuuucuuccugguuucauuucaccuucaggauccauccaauauucucuaauaucaauuagcacuuugccuuuaaaaucgcgaacacuaacguaccucauuuucccaaucugcaaaagaaacaaacauaaaaagaggugcuccuuucaagagugguaucuguuucaauuguauucauauucacaacuugcugcaugcucacucuacaucuaaucaugaaaaugacuacugcugacccuugaacaacauggcucugaacugugcaggucccacuuauaugcauauuuuuuucaauaaauauacuggaaaaauuuuugcagacuugacaauuugaaaaaacucacagaacaacugcauagccuagaaauaacgaaaacauuaagaaaaaguuagguaugucaugaaugcauaaaacauaccuagauaugagguuauuuuaucacuuacuaucauaaaacauacaaaucuauuauaugaaguuagagagaaauguaaacaaagauggaguauuaauucauaacugcauaaaauuaacuacaguaguguacuaguguuaacuucauagccacuuccuguuaucucaguguacucaaauguuacaaguaucugcuuaaaacaccuuguguaaaacaccaugugaugcuaaucaucucugcugagcaguucaugucuccaacaaauugcguauugcaguaaaaagugaucucucacgguuuucacauuauuuuucaucaugauuacugcaauaccauaaacuuuaaauaacaccaugaguccuauacaaagugccccuagugaugcugaaagugcucccaagaagcagagagaaggcaugacaucacaagaaaaaaacugccagaagcaguggugcaugccuaugaucccagcuacucaggaggcugaggccggaggaucacuugagcccaggagcuugaauccaaucugggcaacacagcaagauccugucuuuaauuuuaaaaugcaaaaaaauaaaaauaaaaauaaaaauaaaaaaguugaauugcuugauauguaccacggacugaaaucugcagcugugguugccuacaauuucuaacagaugacauauuuuauuaacagaugacauaucuuauaaacagacaacguaaacuaauguuauugauaaacaccauacaguacaguaaaauguaauuuuucucccuuaugauuuucuuaguaauauuuucuuuucucuagcuuacuuuauuguaagaauacaguauauaauacauauaacauacaaauauauguuaacuguuuauguuacuguuaaggcuaccagucaacaguaggcuauacuuagcaguuuugacaaagucaaaaguuauaaccagauuuucaacugcacagggguuggugccuugcauuuugacccugcauuguucaagggucaacuguacuacucucaguaucaaaacugcaaccaaaggaaauugcuguuuaaacuaucauaugauccagcaauccuacuucugaauauauaucccaaaaaauugaaagcacagacuccaagagacaucugcacacccauguucauagcagcauuauucacaagagccaagaaguggaaacaacacaaauauccacccagagaugaacugauaaacaaaaugggagaggggggguggaauagacacacaauggaauaucaauuagcuuuuaaaaaaggaaauccuguuacauacuacgucaaugaaauaagccagucauaaaaaggaaaaagguaauacuuuaugauuccacuuacaugaugucaaguucacaggaacaaaaaguagaauggugguuaccagggcugggagaaggggaacuguuguuuaauggccacagagguucaguuuugcaagaugaaacaguuucggcaaucuguuucacaacaaugugaauauacuuuuaugguuuuuaccagcaaaaaaaaaaaucauuaggaagcaauauuuugcaguacaaacuacaaccaagaggaauccacagaugcaacuagcuacacugcuucaccaaccauucugaauauacgaauccagaguuccagucaauaacaaccaaguuuuuccuuuucauguucacuucaaauaacaucuuuaaugcaccucacucacagucagauugagaacuuaaaaauauucacagaaaauuauuuuucaaaaaucuuauauaucugcuuaccacaaauuacaaauuccagagaaaagaacaggcuuuccucaacaaagugucucuuagcacuuuccaagacucacuauaauauaguaagggaagacaaugcaguacuggaguaaagacagacauaagaggucaguggaacacaacggagucaaaaaauacacacgcauuggauauauucacugauuuuuuuggggggaggggguaaaauccaagguaauucaaaggaauaagaauacucuuuucaacaaaugguguugaaacaacaggcuaucugcauuugggguggggaagacucuaaaucucuaucuuacaucauacacagagaaauuaauucuacaugaauuauagaccuaaaugugaaaacuaaaacuauaaaacuucuaggaaaaaacacuggcaaaaauuuuuguggccaugguaggcaaaauacgucuuggacagaaaauaagcauuaagcaaaaaaggagaaaaaucgauagaauagacaaucacacuaaagccuuuuuuaaaaagaugcuucagaaaauaaaaagguaaaccagaaaccuaaagaaaauauucacucaaguuggagccacaggggucuuggccuucgaggagagccugaggaagaagcagaaccguggacgugaagaaaaugaugaacugaccagaauccgugaggaccucauuuccaagagagagaagaucugucacagacgccccugaccaacugccaguccccccuuauucugucuguuugauucucucugguuucauauuuuccucucuguuaaccuccacucauuuuugaacuagauugcuuugaaaacuaaaguuucccugaagucuaaaaaaaauauuaauuauacuuacaucugacaaaauauauaaaguguuacaacucaaaugaccuggcauuuuaaguggccaaaagauacucuucacaaaagauauaaaaauaaccaauaaacacacuaaagauguacaaugaauuaagacauguacaugagggaaauggaaaguaaaaccaccaugagcuaccauuauacauucaauguaacuaaaaagaaaaaaacuuaaaagacugacaauaucuagcgaggauguggagcaacuggaaucuccuaaguaguaccgauggcuguguaaaaugcuacagcuacuauggaaaaugguuugacagugucuuauacaguuacacauuuacccuacgacucagcaaauguaucugguauuuacccaaaagggaaaaaauguccacaaaaugacuuguacaagaauauucacagcaguuguauuccuaauagcccaagacuugauacaaucccaauguccacccaaggugaauggauuuacaaguuguaguauuaucauacaaaauacuacucagcaauaaaauuacugauauaugcaacaagaacuaaucucaacacauuauacugagcaaaagccagacacaaaaaauagacugcauguauccauuuauacaaaguucuagaagagacaacauaaaucuauagugguagaaauaagaucagugauuaccuaggacaugagcaaugacuguaaagccaagaggaacuuccuggggugaugaaaauggucuggccacaaaggcguguacauuuaccacagccuaucaagguaugcuuuuaaaugugugcguuuuauuggacauaaacuauaccucaaaaacauuuuuuuuuuuaaaaaaaaaaggaaucugcccaacagcugccucucccuuggggggaaaaaaagaguaaaacugacaaauucuuauuagcaaaaauuaaacaagugaugagauaguaguauagggauauauuacuuaaagauagaaaaaauaaagaucacugaaaucacauuuuauuggaaaaaaauaaaaucagaugacaauauauuuuauauccacaaaaucuggagauuagcagcaaaaaauagcauauacaucauaaagaacugugauucuuauacgaauuugauucccuguccccucugaagaucugauaaagcagugguuccuaaccuuuuuggcaccagggaccagucucacggaagacaauuuuuccacagcagguagggaaggggaaaggugaucguuucaggauaaaaauuaucccaccaucaggcauuagauucucauaaggaauaaggaacgcacaaccuagaucccuugcaugcgcaguucacaauaggguucgcgcuccuaugagaaucuaaugccgcugcugaucugacaggaggcagagcucgggcugcaauguucacucacacaccgcucaccuccugugcaggagggaccccugugauaaagguuaugaauaauuccuucaaacacaaaaaagaaaacucaaauuaaaaaacaauucuauggacuccugccccagauuaaaaugaccaguuauaaucauuuuaaauuaaauaauuuaaaaguaucaaguauccuuaaaucaucaaauaaacuaaagcaguauuacugacccuuugugccuaacucugaagaaaaauauggauuaaaguuuccugccucaacuauucugaccuuucaagacacagguacuaaauaauuaugagauaauucuccagucucuuuacuaucacagaugucaccucagguagacuacaucccuauggaagaaaguucuucaaaaucagagcugaaggaaccaggaaguaagcaucucuaguaucuucucucuagucacgauucugccccaaucacuucagacuuuaaaagauaagucuauugauuuuucuuugguacaacucuuuaauacauuuagagaacugcuuauguauugauguuugauguacaucaagcuguaauggcaaugaaauuaaguaucauauuauuucauaaugccuacacuacuagauccaugaaagccacucugaaaauaaggccuaggcugggcgccguggcucacaccuguaaucccagcacuuugggaggccaaggcaggcagauggcgaggucaagagaucgagaccauccuggccaaccaggugaaaucccgucucuacuaaaaauacaaaaauuggcugggggugguggcgcaugccuguagucccagcuacucaggagacugaggcaggagaaucucuugaacccaggaggcggagguugcagugagccgagauucgugcuacugcacuccagccuggugacagagcgagacuccgucucaaaaaaaaaaaaaagaaaagaugaccuauguuccuccuagaggcaggcuuucaaaaggugcaaugucagccuuaggaggcuuaggaaucuuuccagaugaggguuuaagaaaugaagcuccguuuuucuggugagaaaauuccuaaaauuagaucuaguuuucacaaaacuccucuuaacagaacagaaucucuaaaauguguguucugaacuaaauaguucaucugcacuuugucuaucuuuuuuaccuagaaguauaacaaggcaaaaauaagcaauaggaaaaaaaaaacuuaaauuuucccauucucaccuuaaucuuggcacuccaccuuucaaaguuaucaacaggucaaaauauacauguguuagccuuacuuucuagucauauaaaugucuacagucuuggccagucacgguggcucacgccuguaaucccagcacuuucagaagccaaggugggcgcaucacuugagcucaggaguucaagaccagccugggcaauacuguuucuaccaacaacaaagaaaauuugccaggcgucauggagcauugccuguagucccaguuacucaggaggcugaggcaggaggaucauuugagcccaggaagcggaaguugcagugagcagagaucacaccacugcacuccagccugggugacagagcagagacccugucucaaaaaaaaaauuguagucucguuccacccaacuuuuugguuucaacuaauacuuauagcuccuggaaacacucauccuuuucuugcucccauuacugcacucuucuaauuuuccuucacccucucucuuaaccuacauccucuuuuuccuuccauucucuaucugaauauaacccaagacauccccucaucugcuuccuguucuuccucuguuuaauacuucaguaggcagcuuuagucaaccaugcugauaaucccacaugaacauuucccaacuaagcccuucaggugcuacagaagcaacaccauuuuuuuuuucaaucacauccacaaucaaguccacaucuucacugacugccuaauuccucugguccauucuuccuaaccuguaucuuguaauuggcauaauuucuucuuuaggaaaaaccaucuaagcccuuaucaccucacauacagauuaaagccuacaauuaccuaagcaaucucaccugcauucauuuauuccccaacaucccuuccucacaaauccuucuuguacaaagaugccagugucaagucucccuaaaacaagacaggaaacccaagagaaaaagcuauacgaguccucucuaggugauuucaucaagucccucuaaugaacuuccuucacuuuaucuauucaacccauuccccuuuucuguugcucaucaggccaaaauuaggcaugucacauugcugcuuccugucccauaauaaucuauucauacuuuacugucccaacacuugaccugccuccuccaaguugcuuucaaaaugugcaguucucaauuaaauuugcauugguuuaaauacagcaaaacuagacuuuagagacuuuaacaauaauccagcaucguacaaaauacuuuuacuaguuuguucuauuuuaauaaaugucccuaguuaagaagauuguaacauacauauuaggcaauuaucagaucauaguacuuuuaacauucuucagaucaagccagauaauaauuccucugaaucuaaagaaacagccaacuuuggcaaggcaugguggcucacaccuguaaacccagcacuuuuggaggcugaggcaguuggaucacaaggucaggaguucaagaccagccuggccaagauggugaaaccccaucucuacuaaaaauacaaaaauuagccaggucugguggcggaugccuguaauccuagcuacucgggaggcugaggcagagaacugcuugaacucaggaggcugagguugcagugagccgagauggcgccacugcacuccagccugggugacagagcaugacuccaugucaaaaaaaaaaaaaaaaaaaauagccaacuuuaccugaaacauguuaucaucucugcugcugcugcucuguuuagaagaugacagggcucucgaagucucaccugucuuuuguuucuuuacagguuuuucuggagcaacuugcuuuuuccucuuuaacuagaaaagaauaugguuaaaauuugcacacauaaaaauaaaacauaccccagugucaaaagaucccauuacuuuuuaagauuuaaacaaucaaaagacuacauccaaaauaucauaaauauauacauaagcaaguuucacucaacaacaaaacuaugaaucuaaccaauccuucugucuaguaauguuuucaaacucuguucucaggaucccaaaagacacuucaggcauuauaguaguauuaaccacaggaacgguuauuuugugguuugggaucccacauacgauuucuuugguagaaaaaaaaauggagggaucuugcuacuucugaauaaaccuggaaaccacagucuacuaaggcuagucaguuacuuauuuuacgaagcagauauacuaauuaaaaagaauauaaccaacuuauuccauuuccaggauauguuuauuuauguccugccuauuccaaaaggaauuuaugcuggcuuaaggaauuuaugggccgggcgcgguagcucacaccuguaaucccagcacuuugggaguccgaggcgggaggaucacuugaggucaggaguucgagaccagccuggccacauggugaaaccccaucuccacuaaaaauacaaaaaaaguuagccaggcgugguggugggcaccuauaaucccagcuacuagggaggcugaggcagagaacugcuugaauccaggaggcugagguugcagugagccgagaucgugccauugcacuccagccugggcaacagagcgauacuccaucucaaaaaaaaaaaaaaaaaaaaaaauuagccaggcgugguggcacacgccuguaaucccagcuacucggaaggcugaggcaggagaaucgcuugaacccgggacgcgaagguugcagugagccgagaucgcgccauuacacuccagccugggcaacaaaagcaaaacuucaucucaaaauaaaaaauuaaaaaaaaaggaauuuacaauuaggcaaaucuuuagagagcuauuuugcacugggcacugacagccagcaacucaagaacuuccucauuacaaaaaaaaaaaaaaucauuguagacagcuauguguuagacuagcuuucaaaaaucacaacguuguuuuaaaaacagcauuauuuuaaaagcuuauuagaaagucgcauucucaaaaagagcuaacccauaaaaaccacuacaauacccaacccaaacagaagagggcagucauguuccuucuugauggaauaguauaaauauuuuaauguuacuaaauuaauugaauguuaccaaauuagaugaagcuaggaaaaauauuauauacauguaaaacaugaaaugaaaaaugugguauacaagguuaaguguuuacaagaguaauauuacuauuugggacaaacaaaaaguuagcucaauaugcagaaagcaauuauucuauaaaucaggcucuaaguauucccuguggaauagugcaugucuggcaaauaaaagcucaauacacauguguuacaucaacauacucaaauacuauauagggugcaaauuuuaaaauuaagaaauuuacucaaguauagucuuugaagccuuauuuuacccuuccauguguuguuauauucuauauuuauacuuuaagguugcaacuucuccaaucucccauacgcucuccccuuuucuuuuagcuaaaauugcuaagcuucaggaggaaaaaaaaaagauagggagccugcuucuuuugaauaaacuuucggaaaucacaggucuaccagugcuagucauuacuuacuauuuuacaaaggauauauacuaauuaggaaaaacacgaccaacuuauucuauuucuaggauauaaauaucucuucagauauguaaaguucuaugcgauaaaagacaauucugcacggaagacuugaccgcagagugagacgcucaguuaugcuccacugagaugcucaauuuagcgaaauucaccaauuacggugcagcugucaucuaaugcagaaaaagccuaucuugucaauggguuucaaguuagcuuuacugcgugcugauuuaauuaaauggaagggaccagagcacaaacuuaguacaaacuuaaaaauguaccaagucuaaaauucagaaaaccuuaugugcagaauaaacaccaguaacuaagagaacugucaaaauuaacauuuuauggccacucaugauggcucacaccuguaaucccagcacuuugggagucugaggcagaagaauugccugaggccaggaguuugagaccagccuuagcaacacagcaauaccuggucccuacaaaaacauuuuuuuuuuaauuaaccaggcaugaugccuguagucccagcuacucuggaggcagaggugggaggacugcuugagaccaggaggucgaggcugcagugagccaugauggugccaccacacuccagccucggcaagagaguaagacccugucuuuaaaaaaaaaaauuaacauuuuacaaaaaaaaaucugguaaauuucuaaauaacggcaaauagugacuuuggccuacuuagaauucuaugacccuaggaugcaaggcaguguuucugcaacuuuaggguuccuaaugaugcucaacagaagacuuguuaagucugauuuagggccuaugaguaugaaugugcaaaaagcauccuaggcacuucuagucaagugguccagagaccaaccguaccuccagaaauacccauucacauucuuauuuuuuauuuuuuauuuauuuauuuuuuuaaagagacagguucuugcuauguuagccugguuggucuugaacucuuggccucaagcaauccugccaccucggccucccaaagaaguaggauaacaggcaugagccaccgcgcccagcuagauccucauuuuaagauguuaauacaccuuuuacuauccuucagaaugggauauggacaauauuguugaguaucaccaaaaugacuuggugcagcaguagucaccuuuuugucaaccucacugucagaaucacugccagaagagcuugaagaaacaaguuccuuugauuuaggcauccugaaagaaaaauacauuacaaaaauaauuaauaagguacucuacuacuuucaacuuagcucucccccaaucaaagaaaaaaaucaaggacaaguuccacgguucauucuaccauuuuugugguacugaguuguuacacugagcacaaguuuuaaucuauacccuuuuaaguugcaaauaacacgcagggugcaaugugcugaacccaguaagaacaaugaacuaaaugucauacacuccuacaccucuaaccuuucuccaggccaauggaucuuucuauacuucguuuuaauggcauuacacacuauggguaggguaaacugcaagaaggcagcagacaacaauuacuauuaaaaccagaagaaauguaauucuacuauuacugcuuuagacuucucaucaacgagauuggaacuaacguaaaauuauucacuauggggaacugaccccaacauuuacacaacagggaacuagcuguacuaugcaaaugugacaucuaauuaauuuuuacauaauauuuuauucauauuuugacuuuuuggccguaucaccaaaauaacgacagguacuaauucaagaguacacaaaauuauacgcaauucaggccgggaacgaugguucacgccuguaaucccaaaacuuuaggaggccaaagcaggcggaucaccugaggucaggaguucgagaccagccuggccaacauggugaaacccuaucuccacuaaaaauacaaaaauuaacagggcacgguggcacaccuguagucccagcaauucgggagacugaggcaggagaaucgcuucaacaccggaggcagagguugcagugacacaaggucacaucauugcacuccggccugggcaacaaagcaagacuccaucucaaaaaaaaaaaaaaaucuuacacaauucacagcaauucauuacauuuuacacagauuuuucuacucuggaacauaauuaaaauuugaagaaccuauuuaugggaggugcaaaaccuauuuaugggaggugcaaaaccuucccgcaaauuccuaccaugcugguaacuucccagguccccccagagacauagauaacuuagugccuugcuuacaaguggguguuuacugagugccugagugcaaguuugcagaaagcaaacuaucaguaagccuaagccccaaauuucaaggaauuccaagauacguggauaccucuauucaaggcacuuauaacaccaggucauaaaacgcugauuaucaaaauaucuuuugcucuccccaucucagaagagauuagguccuauuaacccauuuaugccagagguugcaauuuuuugaauuuaugcaagcagaccuuggcgaugaucuugagcaguagcacauaaauaacucccacaugcuuagcguuccaauaauggaacacuaggcauaaauuagcuaauuucuguaugcguuaaagggccuaauaaacacaucacacacuguauuuguuuaauacaagaaaaaaagacuuaaaauuccuccuuaaaaaaaaaucauaaauaaucuagcucucuagaugaaacuugcauuagcacugacauugcauauguuccaaaauaggaggucaaggaaaaagaagugggccaccccaauccuagccauuaaauucaaaaagcucaaucugauuuuaacugguaaugucuucaaggguaaauucagaagggaaaagcaauguucaugaccacguuuuauccguuuuuccuguuucugcuccauuuugcaaccucaucucuaaaaucaauuuaguuaaguuuuuuaugcuaauuaauacgacaaaaagauauuuuuuaaaaagguaauuaaauugaacauaauuuuucacuuugaaacugucgaucauaacuaccgucuguuaucaaaaacugccugggggccuaagaauuuuucaaagaaccaccugguacucaacccaaagaaguccacuggagaagaaagguaacgguaacuaaaaccagccucuaaacuuuuaacaaauauauauuuaccuuaaugagccuguuccaauguggggguggggggagaagcagcuuguaauucaaguaacugauacugaaaccacuauuguagaauuuauacaaaacgcaacuuuaaaaagagaaacgaaaucuucagccuuugcugauugagggaaagaucagaaaaaaacgaggugaaaaugaaccaggacugaagggcacacgacuucgguauaacaggaaggugacaagcacaagaccagggaaggggucgcgcggccccagcaagccgcuagaaccccguggcuagcagccgcucgggcgaggggagacagguuggucggagggggcgugggaggcggcgaagugcggagaagacggcgugggaaggggcgggauuugcaccaagcgccauuuucuucucucgaagcguucccucccccugcacaucagccguucuucccccggcccccucccgcccgcauccgcucucccagucuccagagcgccccgcucagggcgaggggcgggggaagaguagguaaccgcacgcgccccaccuaggcaggccgccgccgcauugucccggggacgccgcgacucucuccccgcgacuccucacuccccggccgcccucaaucuaccgccccgggccgcagcgcccgccgccucgacucggcuccccggggacaggagucuaccgcggaagggcccacagcgcgucaggcguggagucagaaacggagaagggggccggggacgccgaggggaagggggagguaaggcagagccgccauuucccgcggccauugccggcgagaggaguggagggccgaaggcagcucacggcccggcugggagggugggggccccgaggaguagggguagggggucccgcgcacucacgcuucgcucggcucuagcagucgaacacccucuuggucguucgcucgcgacugacagagaaccggaagugacggcagccaggagacgccggccccgccgcgcuggggcugcggucacgugauggggcguggccuccccacagaaaccaacacuuagacccuuuccagggccuuaaagggaccgcgucucuuccuaaaugggugacgcgaaagucagauguuggaagauuacaucugacccuugagagaaugaaagagcuaauauccuuccuguaggagauagcuuaaaaaaaaauuaaaaaaaaggaaaacgccaauaaaacaugagugacaagcgccaagcuuugcguuuguucaauaaauguuuacucuaaugaagcgaaggggucauaaugaaaaagaucaauacucuggcccauuuucccagaaauggucuuccuaccccacuucacccaccucaauacaugccucugccuccuaaaauccaaaggaaggaagcuaaagucacagcguuuaauuccagaaagugcaagaaaucuuuggaguacuccuuauuccuguauugaaguccuggagauguaagggaguu

SEQ ID NO: 17735 - RNA, 1166 nt, Homo sapiens
uggcaugaaacgcugcagguuuauugucucuauaaaaagaucguuaaggucgagcgugcuaacgugugcgguacuaacuguacucacuacgcccuggucacuuuauagcacaaguccgaggcaaggaaagaaguuuuacaaacaaaacuggucaacuguucuaucuucuuacuccuggaaaacaauaaagguccacuuucaaaccauuuggacgcacuugcuccuucuaaaggguuagggagucccggcagauagcguaccccuccccgcccagcagcagagagcaaaguccuuccugccgauccugcagaccccggaguccaaaugggaccccguccacacgaccgcggagucgccuccgaagacggcggugucuggggcguggagggcacggcuggaggcugagugggguccaccuucgcguggcccaggcucuuccauucacggggggccccgccagguucaggcuccagcccuggguagugaaggggaaacggggaacggaaggagggagggcacgucacgggagcaggacugcaggaccgcgggucagggggcgcaggaacgccaaagaaaagacaagcaccgagggccgggaaggguguaggcugcaguggcagcggauccccggccgccgcuuccggcgccucccggcccagcucucccgcgccgacucugccacauccuccggugacgucagccggggccgccauauuggaaaggcgccgccgccgccuccgccuuggagcucgggguguuucggggacugcggccacaggcaggaaggcgcuccucuccugccccgccgacgcccggccagcccgcuucgcccugaccuguuuccucaugacugcccccggcccugcugccgacggacgucgccccggcguccggauuuaacacggaaacccggaucggaggccgcgcggggaggaggagggcgacccggucgguccugcgacccucucggcccggcucggcgccucggcgggagccaugaccucgcugacccagcgcagcuccggccuggugcagcggcgcaccgaggccucccgcaacgccgccgacaaggagcgggcggcgggcggcggcgccggcagcagcgaggacgacgcgcagagccgccgcgacgagcaggacgacgacgacaagggcgacuccaagga

SEQ ID NO: 17736 - RNA, 1681 nt, Homo sapiens
uaugccccacucccacccccucacuguaucacucaucuuauuucuguuucuggauuuuccuacucuuccucucuccuucaaaccauauuuuucagcuuggaacuaucuauauauuuauuuaguaauuuacacugacuuauguauguucuugguacucauuucuauccauacacagauuuugaccuuuuacacugaccacugagauauuguuucucaaacuguuugaucauaauaauaacuuaauaauacauagugaacaggaaucccuauaaauucaaaacuuuucaccaaaaauacagaauucucuaaaaaucacuggcuuuacuuuucaaauuuaugguaaaguuuuuauuucacucugugauauguugacuacaugaaacaaaauucuaaauugcuuagcugauauugugaaaugcaaauuuucuuaaaccaggacaggcacagugguucacucuuguagucccaacacugggagaccaaggagggcagauagcuugagcccaggaguuugaaagcagcuugagcaacaugaugacacccuaucucuacaugucuauagucccagcacucaggagguugaggagggaggauaaccuaagcccagggaggccgaggcuucagugagcugugaucacaccacugcacuucagccugggugacagagaggagacacugucucaaaaaaaaaaaaaaaaaaucuaaaauccagauaauuuuuuugauuugaaaacacaaaagcagaugaauugguaugaaguaucuguaguguucauuuucucuguuuacaugaauauugguguuuuauugcauauauaugauguguuuguuuagcuauauacuacacuagacuacauaguauaugcaucaaauuggauuuugaaaaaacaaacauuuaauuugaaacacauuugccugcaugaauuucuauguaaugcggaccagaaccagcuaaauugcauaauaauccuuuccuuguauuugcaaguauaauuauggcuuuaggguuucuucugguuaauuagcucauauguggaggucagagugagggcuaaauucuauuuggagaagaaaugaucuacaucuuacaaauguauuaugagugcagguguuaacucuucuuugcaaaugcggagacugagaaaaggaaagaugagauagcuugccuaagaucauauuaccaggucaccacugaaucacagcaaagcaccuuccucaaugauuauauuauugcuuuccucucucucaucuauaauuccugcaguauucuucucugagauaggauucuuagucucagaaaugaauguaagcucgauauuacuaggugacaauaguuagaaaacaucaauauuuuaucugaagcuuucaguugccuguaauauggcauuauggcaagccccaaggaagagagacauagauuuuuaaaugugguuguauuguugauacuuacggaagaucagcaugagcucaaaaucugauucuuguguuuagugaaaaucaagguuaggugaauuuagggugcuacuauuucugggaaaaaguaauugcgugauuaauugauucauuauuguuaaauagucuugucuuuuuauguccaugcuaguuuauacuuuaagauuucuauacagaaguauuuucaagaaauugaagcacuauugaguuaaaggcaauaaaaaauguc

SEQ ID NO: 17737 - RNA, 976 nt, Homo sapiens
aggaucacagugaagccccuuucccugaguucagcucucucauuagcuugucuuuuccccaaauggaaaacaaacaaacaaacaaacaaacaaaacagagaaacagauggaauaaguccauuugcauucauugaagucuauacucuauguaucaauacauacauagaguguagacucaucugaugguuuauccaaaauucuucagagaaaacaaucuagcauucacauagaaggccuucugcaagauuuuauuuguauuacucucugauccaaucaaaauaauuaaaaauuauaaaaacacauuuuacguuuugauaacccaaauuugaauauaaaccuuguuuuccuuguucuuugacaucaaguaauuaaaaacuaaaaauuaacuuauuuugaauggaaagauagaguaaggaaaauuaaaaaguuuguuuuauuuuuuucccucaggaaaccuuuuaucuuccauagcucaauccuugccucuuggaaaagccaaauguccucaccucuuucaguaaggcauuaauaccuguugugaaaaacccuuaccaaugcuaauuguuccagcaagcagugaaaggggaacagcaggccuagagguuauaugugaagaccuacaauacaaagaaguucuauucuucaugggccucuaagcaugcagcuaagccuccugauuauaaaagguacagagugccauuaaaaggcaucaagaucuccugaagacaauuauaacgcauauaacaucuguucucaaucaugggcgacaggagagaaaaugugcaccgcaugauacguuacauaugacaaagaaguccagcugugggaagaaaggcaugugaaaaggcaauggcuaagaaagaauagugcagagugagcauuguaugacagugacccauggugaucucuuugaguagcucuguggugccaaaaucuguuuguucucuuuuaaaaaagggccaccugugauaucguc

SEQ ID NO: 17738 - RNA, 15490 nt, Homo sapiens
ggcggguuuccuguccaguugugaauaacuuccgacgugugccggaaguuuccucagugacaaucaggaagucggcgugucgaguggcucuuccuggcugcugaggcggguuaaggucugagggucuuguggggccacggcgcugaucaccagguguuuggcuuggucgguucuuauuucucgccuggcaauggcgacguacaccugcauaacuugccggguggcguuccgcgacgcggacaugcagcgggcccacuauaagacggacuggcaccgcuacaaccugcggcggaagguggccagcauggccccagugaccgccgagggcuuccaggagcgagugcgggcgcagcgggccgucgcggaggaggagagcaagggcucggccaccuacugcaccguuugcaguaagaaguuugccucuuucaacgccuacgagaaccaccucaagucccggcgucacguugagcuggagaagaaggccgugcaggcagugaaucggaaaguggagaugaugaaugaaaagaacuuggagaaaggacugggcguggacaguguggacaaggaugccaugaacgcggccauccagcaggccaucaaggcccagccguccaugucucccaagaaggcgcccccagcgccugcaaaggaggccaggaaugucguggccguggguacugguggccgugggacccacgaccgagacccgagugagaaaccaccccggcuccagugguuugaacagcaggcgaagaaguuggcaaagcagcaggaggaggacagcgaggaggaggaagaggaccuggauggagacggugauggcccugucugggcggggaggguaaagaggaacuuggcccacccuuaaguuuccagauuuauacucgagauggguguguguguguguuugagagcuuuuaaguaaaaaugaugagggaaggugguuuagacgcuuucugaagugccuuaucuggccagcagguuuggcuguuuaguucacucaauucauucuccaaggccuaaaaccuugucuggaaaaagaagugcuuaaugcauauuuggagaaugaauugaugccuucuguguuuuggaugaagaggcuuuuaacauaugcacaggaggacaugcuaucgucauaccagcugccguguaauuugcgauucuaguggguuuccaguuaugaugguuuugcacuuaauuuaguugaguaaaacagaaugaggggaucaaaaccaacucagccagaaauuuggagcuggagccagcacccucaccucuuugccuuuaugagcuauuuauuccuuacuucccucaucccacauccuauuaacagugcugguguagguguucaugucuuagucuguccacucugcuauaaggaaguacuagagacugggugauuuaugaacaacauaaauguauuuucccauaguucuggaaauugggaaguccaaaaucaaggugcuggcagagucagugucuggugagggccuguucuauagaugaaguuuucucauggugucaucaugugguggaagaagcagaaggcaaaaaaggggcuagccaguucccucgcacuaauccauuuauucaggauuagugcuugccuaaccuaaucacccacuaaaggccccaccucuuaaugccauuucauugaugauuaaguuucaacauuugaauuuugggagggaaacaugcauucaaaccauagccguucauagagcacccuaccagcacauacacacaccccauaguacuuuugugaaauaguagauagaggcauuguuuuagaaguuuauaaaaauauccaggcagguaggagacuuccuaacuauauuuucagcacugggcuaggugcuguaaggcauaggaaagaaacaaagaaaagauuccuguuuccuggaaaagaaagacuaaggaguuucauggccauucagaugagucugugguaaacaaauagcuaaaauugagaucuugaaagaggaguuguccuugggaguugggguguggcuguuucuccaaauauaggacuguaucaccucgugaauuuuugugauaucuuugcuugcuacuacuuuucuuaaacuuuauauuucaaaauucuggcuugcagauugggaagauauugauucugaugaagaauuggaaugugaggauacugaagcaauggacgaugugguggagcaggaugcagaggaggaagaggcugaggaaggcccaccccuuggugccaucccuaucacggacugcuuauuuuguucccaucauuccagcucgcugaugaagaauguggcucacaugaccaaagaccacaguuucuuuauuccugauauagaauaucuuucagauauuaagggacugauuaaauacuuggguaaguacaauaguuuuccuuuuaaugaggaaauaaucacauuauugggggacuggucucaagggaacauuaguuuugcauuuuucaucaaucuuugauauaauugcuugguuauuuugugaaugauuuuugaguuuuggugacaaauagugagauuuaaucugguugcaaaaagcuuuuuucauauuuuuuccuuaaauuauuuuucuaggagagaaaguugguguuggcaagauuugcuuguggugcaacgagaaagggaaguccuucuacuccacagaagcuguacaggcacauaugaaugacaaaagccacuguaagcucuucacagauggcgaugcugcuuuggaauuugcagacuucuaugauuuuagguaagcauaguuuguaauaugaaguaaagugaggucauauuugcuuugaagugauuauuaggugugccagugcuggauauguuuggcacuguacaacauauccuuaauaacacuuauaacaccucuguauuagguaguucuuucuuuguaguugagaaacucaguuuaacagaguuuaacacaucuagugaagagaagaccuuagacccagacugaaguuugacuuguuuuuguuuuuguucugguuaaaacaucaagaguucaguuuugccaguuaccccuugaacagagguacagaaauuagguuucacauauuggguuccuggagaguccuugcaucaccagcugucuccugaaggaguugagacaguugcuaaaccaggcccaaaccaggcaucugauggugagauuaccccauuggugguucaccccuaacuagaaucuuuuuuuuucucugagaaagauuuuugcugucacccaggcuggaggacaguggcacaaucauggccuacugcagccucagcuucccugagcucagaugauccucccaccacagccuccccagcagcuagugugcaccaauaugcccugcuaauuuuuguacuuuuuguagagaugggguuucgccauguuacccaggcuggucuugaacuccuagacccaagugauccacccaccucagucucccaaagugcugggauuacaggugugagauaccaugcccggcccuaacuagaaucuugaauuuuuuuguaugucauuuagcaaauguauguuaaguacuugugaacaacuaguugucaaaauuccugugagcuagcacaggagauaagcagauguguauaauuaccaugccaggcaugcauagaccaagugauaccauguucagaaaagucucagucuuuuaagucuuccuuuugcauuuucucccugauuucucauuuugcagcuggagacuugcaguugguggacaugacuggguggagguagaggggaggauuagaggcuguggcaguagagaagacaaugaaugucugcugguggugggaagcauccucuuucaguauuuaucccucucaaguuuccuuuuagacagcaguguuuaugaccuuuugacugauguuguaaucagaguggucaaagcaaauaccauggauaguuaagcagcugccaucagcaguaggcuuggaaugcccagcacucagucucucauccugugguuauauucagaauccuacccagucucauagauuucaauaucuucuguaggcccgugacccccacauuuauaucucuaguauagccuuccccucagcuguaaacugaagauauccagcugccuccuugauauuucuacuuguguccaaaaggaaucauuaacuuaaccuguccaaaaucaacuccugcuaugcauccuagucugcucucuguaaguaaauggcaucucuguccuucuaguuacuuaagccaaaugccaugcagucuuccuuuauucuucuauuuucuuucaugcuuacauuagaaucgaucaccaaauucugcuuuaucugcuuuugcacuaucuaucuucagaggcugacugcuucucacuacuucuauggcuacuacccagguccagggcaccaucaucuuucgccugacuuccuacaguagccuccugcugccuggucuccauauuuacauccuuacuacccacuauguucuauucucaaaacuguaacuagggggauccuuuuaaaacauuaagugaggucaaacucugcucagauucuuucaaagacuaccuaucuuacucaaaguaaaagccaaaguauaauggccugcaaggcccugcacauaguguggagcaucugugguucugugguuuuguauuaguugcucucuggauuccuaacuauuccucuaaugcaucaaguguguuucucaagaccuuugcauuugcugcuguauuuguuuauaguauucgcuuagauauucacuugacuugucccucacuucuugcaggccuugacauaaauuucaccuucucaguguggccuuuuuugaccaccuuccauaaaauaacaccuacccaauccuuuuuauccuguuuuauuuuuccuuauauccccuacugccauuguguguauuguauauuauuuauugucuccuccuucuagaaucuaagcuucaagcccuagccuuuuguuguuguuacucuuguucuuuacuggguguugcuuaaaccguuaguuugaauuaaaauauguaacugauggaaacgguucucccuuaguccagaugauguauuuuucauuccauuuacaguuuuauucuguuggugccuagaaaugagaaauuauaugaacuuuucuuccuaaaaaugaauauuaaaugauuuguuugucuuaaaaaaauaaaagucagccaagugugguggcaugagccuguaguaccagcugcuuaggaggcugagguaagaggaucaccagaggccaggaguuucaggccagccuaggugacacagugagacccugucucuaggggaaaaaaaggaaaaaaaaaaaaguugauaaugcuuaauaaagaaaacuuggaaaauagaaagccuuuacauacaaagcuaguguuuauggagugcuuaccugccagacacuguucuaauaagcauuuuauguggauucacucagcuaaaaaaugacaaauuaccuaaauuucacuccccuucacaagguaacuuguuuacuuauuuuggaccugaaacuuuuuauugaagaauaaacuuacagaaaagugcauauauguauacagcuggcccucuguagucauagauucuccaucugugcauccaaacuaaaguauucgaaaaaaauuuuguccauacugaacaugcacagacuuauuuuucuugucauuauucccuaaacguuuaguacuguguaacaacuauuuacauagcauuuacaauguauuagguauuaauaaguaauauagagaugauuuaaaguaugcaaugauuuagguuauaugcaaauguuauaccauuuuauaucagggacuggaacaucugcaaauuuuaguauccuagggagguccuggaagcaaucccccauggauaccaagggaugaccguacuugugauaucaugauucaguguagugaaauuuuaaauauaacuagcaccuagaucaagaaacagcauguuaauaauacccugacauuucccuuguguguccuuccagaaacuaccccuccuuucuccaagaguaacuacuauucugacuuauagcugcauagauugguuuugccuguuuuuauacuuuauauaaauggaaucacaaagaauguacucuuggguguggcuucuuuugcucaacuuuauguuugggagacccauucauacuauuuuauauagcuguggagaguucuuacuguuacagaguguucuguucagugcuccacaacaucuagucuacuguugauacacauuugagugguuucuaauuuggggcuauuacaaacaaugcugccacaucauucuaaugugucuuuggcaaauguuuauagguuaucuguuguguguauauguaggaguugggccagaggauauacauauguuccauuuuagaaaauacugucaaauugguuuccaaagugguuuucuauacucccacuuguagugagggagaguuuuucaucuuagcaacuuugguggguguguaguggcuuuaauuugcaucucccugaugaugauuacugcaaucaagaggcuuuuugcauauucauuggccauuuggauaucuuuuugugagguaucugaucaagcauuuugucuauuuucuuauuagguugucugguuuacuguuaauaauuuaauguacacuuuuccaauuauuuuuucauguguaucuaugaauagccuuugucaacauuuuuaggaauauagagauucuuguggaacugcacuguccaauauaguaauuacuggguauacccauauagcuauuuaaauaaauuggaaguuuaauuaaaaauuuaaacauucaguucuucagucagacuaccugcauuucaaaguucugugcuggaaagcucaugugauugcaguuacuguaucagacacaaagacauauugauagaacguuuucugucaucacagaguucuguuggacagcacuguucuauaauuuguuuuuauagugguuaaauugaguauagcugcauguccagcuguacauucuccuucuucucuguuagacagccuuucuagggaaaaacaaauagaauucuguuauaugucauuugcucauuucuacuacagacaaaaugcuaacgaguuguuuucucccaaaaccuuuuagcugguaguuccuacagcugcuuccuccccucucccuuuuagguagcuuaggaaguuugccacauuugcaaaugaguuuaugucuuuuaguucaauuugagauauuagucuauuuauuagugcaauuucucuguuauaggaguagcuauccagaucacaaggaaggggaggaccccaauaaggcugaggaguugcccucagaaaagaacuuggaauaugaugaugaaaccauggaauugauucugccuucugguaagugcauuugucaaaaauaaauagcuuaaugccagugggauugagggagaagcauaucuccaucaauuacuuuccauacugagggaaauagaccauaagcuuaaaguauauguuuggguucucauguacgguguaaacccugaagguugcugcucagcucuaaguugccuguuuuguuuaaauuugaucaguguuucuguucauuucuggguuaugauucagaauguuugaucaggcauuucuuuuuuuuuuuuuuuuagauguagaccuuuucuauucuguucuuuauuuauuuaucuuuuuugguccugucuagguuucuccuguuaauuguaaccuuacuguuauucuuugaacugauuccuguuuccuuuuguugcucagacuuccaaaugguaguuugguguggguguaucugacucaugguggaaauuuagccaccaugagguaugaaaagaugaagaauaaccaugaaugugagaagcauacaugguuguuuauuguguaggaagaaagaaucgugauuaacugauaagaauaggagaagcuacagaagacauguuugagaaaugaaaggggauggaaagguagagaugauaauaagaucuuaaugucugguauuuacugagcaguuagcacauucaggcagauguauuugucuuuauaggccaacgugaguuagauuccagcaucuucauuuuacauaugaagcuuagagaggcugaguaacuuaccaggaucacaugccuaaucagcaaagccuuuuuccaauaucuguauacugccuugggagauuugcaguaacggugcaggcaggaacaacacacccugcugguggagagguccgcaaugaagcagccuugucuuauggcuuuccacauagaaugucacugcuuagguacagaugacuaucuuuagcucagaaugauaacccuguaaggccaagagcagcuuuagaguguggcaauaggaggaaaggucaggcagaaccuauuuugaagaugacaguucuuucuacagugauaagaagguuauaaugcaauauauuauuauggccuaucuaauacacagugguaaaaccuaaaucccagagaaccuuuucuagucuuucucuggugacaguacccauauagaacaucagaaauauguuuaauaacuuauuuuccagaacuguauguuugacuuguugucuccuuagcuucugcuucuuaaacgguagaaucagauaaccauagaccuuaaguaaauugaauaagacaauccuaguacagcagugucugccguguaguaggaucacuauaguguuugcuucauuuugcaucuacuuuagcacaauauauuacaaaccuuagcauaacgugagcauaucuauucaagaaaucuaggauguuucagagaaguuuucaucuagacuuuaaauuuuugaaacuuauaaaaaauaaagaauccucagcuuuguccugggugacugaguuuuuuaagguaucuaaaaagauacccauuuugaccgccaaagccaagcccauuuuuggcuuuggcuagccuuagaaagaucuuagagagaucuuccucucccacauccagauggcuuaguaacuccuaaaugucuuuugaguauuuuugaguauuuuuuuuuuuguauucauuuaucugugucaccauuauacccuccugucuggucaucucuaaucugguuuccacaugaccaccaaaacauucuuucuaaaacaccaguagauuuucuuuacccucuguaguuccuccacugggagccauugccuuuaggguaacuuugaguuucucucgcuucuggucccucagguguguagugcuauuccucuaccccacccacauacaguucucuuccucuggguguuuacauguguggugccucuuuuauuccuacuuuucuuguaagauucaacuuauuuagauucaacccucugggaaggcuuccugaacucaucuucuguccauuuacuggguaacaagagucucuccccugcugcugggacacuaaaucuaguuacucagauuggacuucaguaaaaucaagcaggcuaucucaaagcuaaugacaaaaaguauccacuagagggcacugugagcauuuauuuugaagauuguggucuggcaagguuuuuuuggguuuccuucguugcucuucagcucuuuuggaguaaguugguaugaaaggcccauucaauuggaugucagaaauuguaaggccguuuguuaagaaggaguggacauuagccuggugugauggugugugccuauagucucagcuaaggcaggaggaucacuugagcccaggaagucaagagucacaaggcugcagugagucaugaucacgccacugcacuccagccugggugauagaacaauaugcugucuccuaaaaacaaaaaaagaaaaaaaggaguggauggucuauaaguggcuacugcugugucaaaagcuagauggacaggucgcaugcuucaccaugacuuagacauaaccaaucccuuauuuauugggcagucacccuguguucuagaaaauacuuuuccuugaugagggccuucaaguguagcuguccuuagcccaucauacguggugcuaauaucagguggucacugucauuggcacaggguagggggagcucugaaugcuauuuucaguuccuucuuaccagcuguuggaaaccuuggcauugaguaaugaagccauuucaaagacgcuuuaaaaggccaacgugcuguaggauguguuuccacauguugcuuaagaauauaaguauauugaauucuuauguacuaaugaccaacauuaucaccuugcaaaccuggagcguccagaccuaacguuacaaauagaacaucacagugaacaaugcuggaauuuccuguagacccuccauuuaagcuuguguuuuauccaucaacuacaucucaccuauuuccuguggucuaagagcuuuguuaacucuuaugcugucaaaacagucagguuuagggaaaauguuuuuauccacacuaguauccaaagaccaugucuuugaaucgaaagcuucuuuuugucaucucuugaguaugaugauaaaacaagcaacugaaaguaacuacuuuuccauaucuguguaucaagcaaauuauuuuccaguuauuuuggcagguauagggacuuaaaauaaccaaaauaauuuucuuaugcaaauugaaagucuggauccuaaaagcaaauacagacuuccacaauauuuauaguaucugguucauggucuuuuuacacaaaagauucugaaagaaauggcuuuaccuagguaaauauaaaucuuuccuggaaaccguacacaggguucuaccuagccaacuauccuuuauucauuuucaguggaaauggcuuuuucgugccuuauguauaugcuguuguuaaauaucugcaugguuaugucugucugggaagauauuugauuacuuuuguccuaauuaauauucuugugaaaggauaguguguauuuaguaagcuuuuagguaaugcugaugacacuggcuuugcaaugcugaugaccaccuuuggagagccacugcucugagggagccuggaauuagucaucucuaaacccagcccccuucaggucaucucccuugaacuuaugacacauggguugggacauuuucccuagaaagggccagaggugaucguuuaggcuuugugugcaauucugucucugcagcagcuucccaccucugcuguuguagcaagcaccaaagcaucgagagauaauaccuacacaguugagcguggcuguguggcaguaaaacaaaccaaaacaggcgguuggccagauuugguucucuggcuguaguuugccaccccuagauuaauauaucagaugugccucacccuuaaauaagaaccuugaauuguuccuccaguagauaucuuuacuuaccucagguuuuuauuauuccagcuacagaauuuccaauugguggccaauaccuuugucccauaguuuuuuuuuuuuuuuuuuuuuuggagacggagucuugcuguguugcccaggcuggagugcagugguaugaucuuggcucaccgcaagcuccgccucccggguucacaccauucuccugccucagccucccgaguagcugggacuacaggugcccaccaccacgcccggcuaauuuuuuugugcuuuuaguagagaugggguuucaccguguuagccaggauggucucgaucuccugaccucgugauccguccaccuaggacucccaaagugcugggauuacaggcgugagccaccgcacccggcccugucccauaguuuuuuuauuugaaauauucagagucuauuuucuuuuuucucacucuguuacaaguuagugggccuaugagauaaugagauauacaaucguguuguaauaacaucagcauacuuugaaaauuaaauuuagaaauucauuucugaaagcaugauugacucacauaguuuuaccagauccuacuaaauaagcaaaagcuauagacagaauucaacuuaaucaccuuuuaaaauucauauucaccaggugauuuccaucauuuaggaagcaauaggucaggguuacucagccuuggcacuauugacauuuuggacugaauaauucuuuguuauggggggcuguccugugcauguaaagauguuuaauagcaucucuggccucuacccacuaggugccaguaguaccccucuagcuguaacaaccaaaaauguguucagucagugcccaaugucccuugcuggauaaaauccccauuggagaaucacugcaauagagaguuuaagcaaaggaaagguggauugauuucuauuuuagauccugacuguggcuuguagucccaaacaucagaacugcucucugugcuuaaucuucuucauauauauauauauauauauauauauauauauauauauauauaauuuuuauuuauuuauauauauaaaacgcuaaaaaucucuuaucuccuaggccccuauuaucuguauuaguagggguuucuaugugaauuuuuggggaggcauauuguaugcaaguaaguacacaaugcuaaguuuuucacuuaacagugacuugucauuuucuuuuuaaaaaaucuauuguuugguuuucuuuuuguugcaugcuugcuuucuuucacuuuuuauuuuuauuuuacaugcugcuucaucugucuuuaguagauagaacaacuguuucuucugguacaucgauuuuccaucuagauauacuaaaagaucugauuuggaaagcccuugcuuuauagcucugccuugaaaaaacuauccaacucaguguuucaguauugcucuuuugaaaaacaggugccagagugggucaucgcuccuugaugagauacuacaaacagcgauuuggcuugucaagagcuguggcaguugccaaaaaucggaaggccgugggccgaguacuucagcaguacagagcccugggauggacuggcagcacagguacauugaucuuuacaacuacagaccagucugagaacuuguauuucuagaaggggucuggggaaaguuguuuccauuuauguuguccauguggauucucucuaggggaaacguaacgucuuggcuccagggacuuccauuaccacuugauauguuuaaggcaauaagcccaaagugcuaugacuuagaaauuucauauuccuggcacagugauuuuauauaccauuaacuuuuucagaagauaauaguuacaaaaagaauuauuuaguaaucaccaaagguugaaauuauccuggagguuaugcagaggaauuagauaguauccuagugguuaauagcuugagcuguggagucagacgugacuuaugugauguacuuagagguucuuauaugaugaacaugaguaauuuaauuaauauaagcuucuguuuccucauuuauaaaacagagaugauaguaauaagaccuaccucuuagaguugaguggguugaaugucaugcaugugugauauagugcaugcccauagucgagguuagcuaucaguccccuuuuuuguaauuuucccauagaaaauuuagcaaaaguuagaagaguaaagcaugccacugcaauuguugaguuuugaaaccucaucaguaugguacucuuuacaucuauucugaugugucugcuggaugaagcugguuauauccuuagaucuucagggaaagcaucuauccaacugaggacuguggagaaaauaagaggcgggcugccuucugauggccugggaagcucuaggcaacuaaaauccauuugaaaaggcacuguguuuauaugugguuuccuucacuguggcugcuugugagcuguguggccacuugaaucuggcagagacuugacuucaucuuacucuuaucaggaaguauugucugacucgauauauagcuucugccuuucugauuaauggggcuuuaccuuuugggcuuauaaacucuuccagaugaugaaaacuaaagcuacuaaucccagauaaguguauauauacaaaaguucugguaugcaauucuggaguccacagagaccccugaggcgcauggcuuagagaccccaaguuagcaacucuguuuuaaauacaagaaccuaguuaccccaaacuaaccuuuugaauucucugccaagguuggauuuucucugaucacaaauaacagaacuuugccuaauuucuuaacugccuuccaaucauaggagcggcucuuaugcgagagcgagacaugcaguauguccaaaggaugaaaucaaaauggaugcugaagacaggaaugaagaacaaugccaccaagcagaugcacuuucggguccaagugagauucugagagucugcugggauugagcaaucaucuccugcccaaguuuccuccuugcccugaggaccagugaaagacagaucauaggagagacccuuuugcugcuacuucauucguucugaccuaauaauaaaaguuagaaccauaugaguuuucagaugucguuuuugaauaguguugaaagguuauguuuucacaagguaaguccugugucuacuggacccugggacuugcacugcugccugacaguugcuucaucgccucagcuuuaaaugauuuaugauugucagaguaaugugaggaaucaggaaugacuugugugccccaaacuuaguuuaacuuugagaguaacucaccaugucauggcacugggaccuauguaagggggcuugaaggcuuauguaggggcaaaguugaaugucacucauggaauguaucaugguacaggagguacugaauaucucugggcgcuugcauuaaauccaggcuaaguuaaaaagcacaucaauagcuugcuguaaagguuuuauauuucuaaacaugacugcacagagugacuacuguguagucugaugcaguuuccaguggugcaguuagucuaggaggaaaguaaagguaaaaugcuuagguaucauuuuagaaagacuaccucagggucaaaucuugggagaaauucucagguuagguggcuuagaggaaggcacugauauagugaaaaugaagcuaaacaugaaguucaaauccauugaguuaucuuugugaccuuggaaaagugacuuggcuuuuuaaaucuguaaaauggagguguuuauuaucucacaggcuguugggguuaaauaaaucugcuaaaggacccaacacucauugagucccuggcagaguuagugcuuaaaguucucuuuuacagagcaaauauaccacacugaguaaggcauggugaguuuuagucagugcaguauacugagugguggguucaagcaugccaggagaaugugguugcccucacgguguauuaaccagaccucauuugcuagacauaggucuuuuucuuuaaacuuuggaugcagaguugaauuaauuacaucccauuggugcccagguucccuauuauccaacaaugaggacuccuugguuuuaauuuugcuccuucaauccuguuuucuaccauucuccccacagaaggacccaaucuguuguguuugacacaccuuuaaaucuauagccugagaaaaugguguagugcuuugcaugugguauguuuuuaauuuaugcuuaaccaaauguacaugauacuguguua

SEQ ID NO: 17739 - RNA, 106599 nt, Homo sapiens
ggugacgcgcgcggaagcgcucugcgggcccucggaaaccgccccggcggcugagaggcugcggccacugccuggcaccccgacgggaggggcuccggaucguucggagccggcugaaccccuucggccgcgagcgaccgcaugagucgggggacuaugccccagcccgaagcguggccaggcgcgagcugcgccgagacgccggcgcgggaggcggcggccacggcgcgggacggcgggaaggcggcggccagcgggcagccgcggcccgagaugcagugcccggccgagcagugaguccgcgggggcgcggggcgcgggccgugggcggcgggcucgguccccuccggaagccgggcugggguggggagucgucagcggaggguccugggcgucuucaauucugagugaggccguuggcgacaaggaggaauuggcagacaguuuucccaguguccgagugcagauuuuuaaccccagggccccucacaauucuggucacacagugacuccccucucgucucauuuuugauaucugcaugucugaaguuaaagaaaguuccagaaacuugggaagcaaacccgagaagugauguauuuuauuacugguucccgcuagaucuuuccuucagccuggcacagggaggaagugaggucgacccugcugcagccgccggagaacggcgcugcgcgacuuguucuuggaggcgacgucccaccuguuggacagacuuuggacccaaagagaaucugacccauucucucugacccuuuaacggccugacuaguaugccuucccgcuuuuccuuuugaaaaggaaagucagugcugguuagaucaauuucuuacuguacugugaagacgacgauuugggaagaguuccuaauuucugcaagggucuggggguacgcguggaagcagaauagaaacucgagugaaacuuuucuacacuuucaaguuuuaggcaccuauaaaugcccuuggaauuuaagaaauuaugaaagcacacagacagccaguuugacagauauuuuaacuggcuggaaaguuaaauuuaagauguguuuaaaugcaaaaagcacugcuagaacuuuugaaaaaaaaauuccuaaaaagggguccuuuggaggccuguuagguagauauuguguuauaauaacauauuugcauaguacuuagacauucucauuuguugagagcccccuugggaugguguuauucacacuuaauggguuaauggccacuggaaaauaagauugaaagucagcgggauuaccuuuuagcaugagauuggaggggagaaauauccaaaucauaucagagacuuaaccucagacucugcagaggguuaaauagagggucucuugcccccaagcccugcuccacggcccgugcugguuccuaaucgcugcuuugccugccuucuacccugguggugagaacagugcgcuuaauuuaaugcccugucucacgugcugcaugcaccucggccccagcugugucaugccuccugagcaaugcagaaacuuugaagccagaccauguucucagaaguauauguaguuauuuggcaaguuuucugguggacaugauucucauucagaacaccugugaaaacagacaaugauaggaagagugcucuuucuugaagaguuuuuguggcacaggugccucuucugucugcugcuaguagaacuauauagacuuagagcugaaaggaauguaaaaaaaaaacuagccuagguuugucauuuuacacauucacagauuuuuaaaguguagcuuggcuggagagacccugaugcaucaaugggaaccucccccuaccucuucugggcuuccucagcaaaaccaggcagagagacaugauuuauagugacagccaacuucacuuuuuuuccccccuugguuugcuucccaaguuugcuucccaguagaugucccgguuugugugugugguuuuuagcagcuuaauuuugcuuuuuccuuauuuuuguugcguuugauuaucucauucucuuucaccucucauaagauggggcagaacaagagaggugaguuuaagaugucaccuuuuaaacaucaugucucaaguuuuggacuuucuagccuuuuuccaucuuucugacucggcaguaucuggguagugggcuguuucucuaugguauuuuccucacggccuagagaaacuaguacaguugucauauaaacaaaguuuccaauauaagguauucaugucaauuccugcaugaugauauauacagcuuaauaguugaguaucaauuuaaauaguguaaugugcauuuuuagucuguguuuuuuugucauuggagccaaggccuuucuuuccgcccagauaguuggguuugcuaugcagaggaauuauuuaaaauguuuacacuuagaagugugaacacuguaagacuguagaaguuuugagauauccuauagagucauuuuuaauacauucaguggacaguaauuacaaauacaaaucauagcccaacuucugcagcugaauuagacauucgggaugugacucugaaggcuguggugacgaguagagaaagagauggcuuauuuccuagguagcacacuagguuacucuugauuccuuuccacuaagcucaucgcauuucacacgugagagaagugggggaaaagaaacauuaaccacauggauaagcuacauuguuuucuuguuuugugagacagggucgcucucuguugcccaguuuggagugcagugacaaucauggcucacuguagccucaaccuucugggcucaagcgauccucccaccucagccuccuaaguagcuggggcaacaggugcacgccaccauacccagcuaauuuuuuuuuacuuuuuguagagacagagucucacuauguggcccaggccggucucuaccucuugggcucaagcaauccucuugccgcagcuuccugaaguccugggauuacaggcgugagccacagugcccagugaugaacuacuuuguauaucucauugcaguuuuucuuucccucccucucuuccuuccuuuuuuccauacacccagcagcucauuugagagcugugguuggcucacaucuccuggacaaguccuaaggauggcuugaaacauaacuuagggucauauuugaagaacucuuuugucagaccagauuaguuuaccuucaagcucccucugcugcucuccuaugcucuauccccugcucacuccacccccaauaucugacuccugcugaucugguccugggacaugguugcuggcuaggccagaaaugcuuagggaauugagaagagacuacuccauggcccuucucugccugucugagggugagacaggguuugaaucuguggaggcauacugucggugaaccccucugaaauugaaagcaauuuuauguauguuucugggcuuagguucugaugaaaucugaauucucagaggggcugugaacaaaaaaaguggcacacuguuguucuuguggauguauuuucugccccaccccacccccagaugcugcuacaguucggaguagggauaaaguccacuuucucccaaccucaugaagagccugcuuugaggcccagagcugggaugucucuaagaaucaaaccuuauugagaguggcugcauugaccccggauaccucuggaagucacauggaguagcaugagccagucguggaaaguccacuugcagaagagggguggaauuuuggccugggugccgguacuuuccuguauuugauguguuguucacccaucucugaaccgcaaaguggugaagaaaggcuggguugaguggucuuugcuuuuccugugccugugugggaagguguguuaguguaauauugguugacacugucucaccaacauugccuuaguguugacauuagucucauaggagaggcuaaguuaaguaugaacugcaggguucaaguccagagaguugaauuaaaaaaagccauacuuaguucuuauagacgacuaaggggaacaacuuuuaaaaaguucauaauggugagugauuaaaauucugucuuguuagcuuugcauauacauuagaauugauuuuuuuucuguacguauuuacuugaaucaaaaauugaaaaacuggcuucacagaaaugccuucggcuucacuaaguucugcuuuuaacucacagcuuuugcucuugggaauaguauaauuuugugucuguacaguaagcauguuuaaaauaaguuuucaaaaauugguugguaugcaggucuuugaacagaacaagugguaccaguuauaauuuaguaugcaacguuauauagcuuacucaguuggauauguugccuuaauaucaaaaauaaaauauuuuaucuccagguuaagagaaaauagguaaauaggccgggcgcgguggcucacaccuguaaucccagcacuuuuggaggcugaggcaggcagaucaccucagagucaggaguucacgaccagccuggccaauguggugaaacccugucuccacuaaaaauacaaaaauuagccgggugugguggcagacgccuguaaucccaguuacucaggcgucugaggcaggagaauugcuugaaccugggaggcagagguugcagugagccgagacugcgccguugcacuccagccuaugcaauaagagcgaaacuccgucucaaaaaaagaaaauagguaaauauuguuuaauaggaacuugaaaauauacacuuuaaaauaaugccauagugcaaaacuaaguauuuucuaacuaggaauuguuagcauuugguuuuaaaauuuaggcugagcacgguggcucacaccuguaaucccagcucuuugggagaucaaggugggaggaucucuugagcccaggacuuugagaccauccuggacaacauagugagacccugacucuauaacaaauuuuaaaaauuagccagaugugguggugcaugccuguggucucagcuacuugagccugagaugggaagacugcuugagcccaggaggucgaagcugcagugagcugugguugcacggcuguagucuagucugggcaacagagugagacccuuucucaaaaaacguauauauaauuuuuuaaaucggcuuaauuauuuuuaaguuguacauauuuauggggcacauagugauguuuugguacacauaacuauagugaucaggguaauuagcauguccaucaucucaaacauuuaucauuucuuuguuuugggaacaccuaauauccuucuagcuguuugaaucuauauaguagauuauuaacuguaguuauccuacaaugguauagaacacuagaacuuacuccuucuauccagcuguaguuuuauccuuuauuuguauccuuuaacaaauuuuaacuguggaauugagguugacugccagaaaaucaagucauuuagacuuuggcuuaacuuuucuuuaccacacaaagaaugugugaucuggugaucaccugagucacugagcuucagugguuucuuuugugucagaguggauaccucuccaccaccaccccaacuugacacacaaaagguugccaaaucccuuuuccucauuguuuuauuaucuucccaucccauaacaaaaacguaaacuuaaccucuaccuguuccagauuccuggccuuuaguaucauuucauugugucauuguuuucagcuuuauuauuuuaauacuuaaaaaauuaaagcaaaaguuuauugagugaaguauuuuuaaaauaaaauuauuauuuuuuggcucuguuucuuccucucuuucuguuugcuuaucuuucuauuagacggguaacuauuucauucugccugcgaaauguccuccuuccugaauauauugauugcgcuucauugcucaaaccuaaaacuuauucuucgggauuauuuuuuaaaaauuaauuaacuaauuuuuuuuagugacagggucucacucuauugccugggcaggagugcaguggugugaucauagcucacugcagccuccaacuccuaggcuuaagugauccucucuccucagccuccuuucuaggggggauuacaggugagugccagcauguccaauuaauuuuuuuuuuuuuuuguagaggcggggucuugcuuuaugcccaggcugguauugaacuccuggcuuuaagcaggauuauuuuuauuuuaaugguggccuuuaguaaaggcuguguuacauuuucuguauguccuugguggccaugaaguaagcagauguuugugcacaggaucugagugaaauucaguugugguuaaagcaauuugauuauacucugguucucuuauucuuccauuucugcuuugcuuuuuucauauauccugaaucugugcucuuuauuuccaguaauuucccguucagcuucccuuugcauuuaguucuccuguuuguucugcuguuuguuuccuuuccuuuccuguuggccuuuguaggaauuuguacuugugggauggagaguugcuuguuuagagaaccuccucugggcauugauguuggauuuugguuauuuuguagauuaaaaagaaagagaacaaaaguggagccaaaugugcauguaguauagccacagauuuugcucgaaguacaguuuucguagacuuagacuaaagaacuggaagaggaaccauguagcuuacacggccucuuccagucuucucauuuugaagaugagaaaacugaggccguggggaaguggcuugcccaaagauauaugccucugauaaugauacuaugaaagugcuuugcuuaaaugucuguuuuacaggauuggaauuugucccuuauuuuauaaagccaggaaaggggcugaaagauguuaaauuauugagagaagaacgaacacauuuggucacuuuugauuuuaggccuuugauguaugguccccaugaaucagguuucuguuuguuuuuaccucuggcaugggcucuaaggaugacaucacacuuuuuacuugaaaucucacuggaagcaaaagcacauggaaaguaccuuuuucugauacuuguucccuuacccucacaacguuaaaauacacacaguuacacauuuagagagaaaaaaagaaauaaaaauugauaauuggucagauuguucauuaauacuuugcaacaguggauauaaaaugagaauaagaauagcuuacuuaauuuugagugcuaauuauuuuccauguaucuguuucuuaaaaaagcccuuuaaggugaauacucuuacugcccuuuugacaggugguuaaaucuagaugccgagagguguaguuacucuagucauaguuauacauacagcuaauaaggaccagaaugaggacuaguuaaauaaacccuggcagucuaauuccuggguccccacuccaaucauugcacucugcaugcagagggcuuacccacauggcguguaucgugauguguuuggcagggggcaggucaggaguugugggccguucaggaagagggaacaucugagcaaaucacagauguaugggcacaugauaauguuggucaggcguuuggacugaagugugaguaaugcauagggaaauaaugggaugcaggcuggaguggugggugagguccuaauuuugacauugguucccugagugggaaccauugaaagguuuuaguggggacaugugagacuuccuuccucagucuggcccucccaguaccccuucuucaucugucucuugcugucugacuucuuccucuuucccccagcuguacuaggccauauaccaggagcuggggugaugagggaauuggggguagggauaucucagucauucacugaauauuuuuuuuuuagccuggcaccuccuccuuccuguguuccacugggucugcagccuugugugaggaugggguaugcgcucaugaggcaggaguauggggaaucgggggucugaucauugcuuaugugaaggucagcuagucuccuuguuuucugcucaguguguuacucaugccuccugaaggacuugaugccuccaguuccugagccuuucugggguucugccagguuuucugacuugccugccacggaugcccaucucccagccuuggcuucccuguccugugucauuuaccacuccaucugcuuuccagcucuuuggacuuucaccugucuucugguuucaugaaagauagaauuuggguuucuguuucccuuuauugucauuuuggggugaaucuugggggaaaaggggugcaucuucaaaccagaagucccauucuucaucuuugucuagcaucuaguggauuuuuucccuuuguaguacuuagugggcucuugcuaguuaacuaaaguacuagagacuaggaagcucugaguaagaagucgguaguagcggacagugggaaucuauguaacagcugcauggguggcugguugauuguggggucaggaagcaggaggauuucgaggagguuuuuuagcuuuggcgauuuguaauaacugauggucucuucuuguuuuuaagguagcuauugucagguuugcuugugacacguuacaaaggucggcaauggggccugcauuccuauauaaauauuuuuaucagcacuaucuccauucuuggaacuugacagaaucaguucaggagcuucacuaauaagaugcaugcuaugaugucuagauauauaguugaggcacuaauaggcauuacaauuaaaaugccuucagagcuaccuagcaaaugaagugauguaacuugucuuauuuaaguaagaaauucugaaguagaagaaaguggugagauagaaacauaagcaucuuuauucuuaagauagaagacucauauuuuauuagauuaucaucauguaaagugaaaaaaguuaaacccuuaguauauuaugcauuuguaagcagcuguauaauaggacggaaaaugucagugcaacaaguguuugaaaaugucugcuuugguguaauuucagugaggaggacauguaccgugcugcagaugaaauagaaaaggagaaagaauugcuuauacaugaaagaggggcaucagguauguuuggaauuguuuuauuuauagaguucuuauuguuuauagcagaaaaugcaguuaaauccguauaaccauuuucauaaaauaucaauaaaauauucuuauguauauggucuuaucuacauugauuguuuugcugaaguauguuagagacuguuuccugaggcuuuuaaauuuuaaugcaaacauucucucugcauucuuuacauucauaucguuuuucacaccuaugaggauuguuuuguuuaaucucuugacaccguccucucucaguucuugauuuccuuauauucuuagagggagaguucagauuugaagugcauuuuucauuucaaauggaaagacuuaacugagaaacuggcugugcacaucuuugcaugcagauggccauaugaaugugauuaaguaauaagaaagacagugaugggaucaguagcacagagucucaucguuuugugauuucaugucuguguuuuucuugucuugccugaucuuaccccaaccaggacccauugcugccggagugagguguuacuccuggaccccuccgcugguccguggagacuuggcuggcaaaguugcaugugacguacauccuuaguucccugaguggccucaugcaggagcugcauaggguuacucugauuuugggauaucccgugaauaaucacaaguggcauuuucucuuucauuaccuguguaauguauaaggagacuucaaaacgguuguggaaaaauggaauugaaagauagaaggcugggugugguggaucaugcccguaaucccagcacuuggggaggccgaggcgggcggauugcuugaguccaggaguucgagaccggccugggcaaacaaggagaccuugugucuacaaaaaauacaaaaauuaaucgggcguggugguguacguuuguggugccagcuacucaggaggcggaggugggaggaucgcuugagccugggaguuugaggauguagugagccgugauugcauuacugcacuccaaccuggguaacagugagaccuugucucaaaaaaaaaauaaaaaauaaaaauauaaaccuuauuucucaacauaagcuccaucaguuucaagccacuuuuaaaugaugauaccagccauuuguuggacucaucccuaaagaacugacaggccugggaauuuaacaaugugaaugcagcagucuuuuuugcauuauuagcugaagaaaaauguguguccuuuaaagcuucuuaagauuaggaaacaaaaggaagucagaaggagccagaucaggacuguaagguggaugccuaaugauuucucauugaaauucuugccguuguuugauguuuuuucuugcuuuaauuuuagcagaacucauguugcucuaauaggggcucuuuucaagcugaugucuuauccuucuuagugccuuagacuagauccuguucauacauguuauaacaaguuaguaugaguuuauuauggugccaaaaaaaauugaaauccguccauagcuuuuucauaaaacucauuuuccaugaaccuuagaagacccuugucugugcucuucuguuuugagaacuggcuucuguuuuuggugaacaaaagcauugucaugugugauuaggaacaaaugauacacagugugguuuuuauaauacuucuugagccccccucaagcaauuggugaacucuucacugugguagccacaggagauauucuuuguagugauguguggcggggccgcaccguuccagucuuccaugaaacuugaagaaugcucugucucuacucugugguuguucaaaauuucauguagggugcaguguccucauuagucagauuccuaagaagaaaguguguauucagcugguguuuguuaccgcugacaguauuucacccuguaggcucucgguugugauucucuucugucuggcauuguaccccacacgggcaaucaagcuuuauggugggucuuguaacuccuagcuuuagucugagagugaaauggaucccuuuacacuucucacaucaucucagaccuucuggguucauugucuuucuugaaauaacauuuguuacccucucagagcccaggcugaggcaaaaaguuuucuuauccucucuguuagugaaaauauuuuuuuccaccuugccugagagucagcaaacaaugguuuccaggccaaaucugacuugccaccugguuuugucgauaaagauuuuuugaaacauauuaauuuacauauugucugugguggcuuucgugcauaguaaaguugaguagcugugacagaaaccuuauggcucuccaagccuuaacuuauuuccugucuggcccguuacagacaaagauugagauuccuauccuauuccacccuguuugagagucccugcuuuccggagggguuucaguuuuaacuucccgccuucugagggucugauucuugucuuugucacccauguggugguuaaagaugaagccucuugguuauuucaacuuguggcuuaccacucugguuuucaacuucccuauuuuucuauuuuuuauuuuuuugccauuagaaauguccuuuuuugaaaacagcagcgucuguguaguuugcaacuaaagaaaguugcuuuugaacuccauaagcugcucgaggucagguacugccuuguccugcaucuccagcuccuagccugguaccuggcauguaguagccauuggaguccuccucagaggaccacagcagaaugggaauucagguauuugaugcugccagcugugccaguacccauuuucccaacccucacuacgcuacguaggccucugauucagcacuuggcuguggccuguggcuugaucucuuggccugugugaggcuugugccuccuccccucagucauggggugcugggcuugccccacccuguccaggucuugucuuggugugcacaggaaugaggacugcagggaggagagcaggaagguagauuuccuucccaggagucccuuucugagcuggacaugugcuuucuguucaggcucauaacccuaccuggaggaaaaauguggaccaauaaguguccugacucuggacauucgcauuucuucccuuuugggcaggggaauggaaagacagcuacaugagaaugcuuccauccacuaaguagacaugcaaaaaaauauuucucgaauuaaaaaaaaugaagauucuuuaaggauuggcugugcagcauuggucuuuguggucccuguauauuauaccucaggagucugcuucacuuuuaagugaauccugaugugugccacagauaaauaugucuauguuaucuguauauguauuauuuucucuuguauguaaaaaguuacuuuucuuuguaaaagaauucacagugagauuauuaaaaaucagcaguucuuaagaguuuacuuaaaaaauuuuuuuuuuaaauuuaccuaaacugcaaggaggauuuagggccucuuuugugcuccuaaucauccuggcacccaucacacccugguuuauaagugcuuguugucuuuucuccuccagcaguccauaagccccuugaggauagaauccugucuucaucaccuuuuauccccaguuccuagcucaauauuugguacauuuuagacacucaguaaauauuuguugaauuuaguugaauaaaacauuuuuauuuuauguacaacuugcucaggaguaaauauguuguaagguacuucugcauucuaaaaucauugcuagcaucuacgucuucaguaauuuaaaaaggaagucaagaugugccugaaaauuuaccgccuuuucuuccuaaaacacacacacuaauaugugcaugugcguguauaugcacauaccacaaaaucaaaccccaaaccauauauauuaaacuagggaaaauauaaaggcuauuuuuuuuucacuauaacauuugucugauggugaguuguauuuuuaauuuugggggauguguuguuagagucaggugaggucuguggauuaacaaacauggagaguucuguuaguuucugguuuauuaucgaccacuuuuagguuuuugggaucaggguaggacauaaauacauuaagauaauuaaauguaauuuuuguuauaguagguguuauuucuuuguauaaugguuauaaaaaacugauuacucauuguuagaaguguuuucucauaguucagacugucgcgucuguaauuugauuagaaaaguauucaugagcaccugugugucagugcagcuccagaugcugaggacacaacacaacugagaaacaaaacaaagucccugcccucaaggagcuuguguuuuacuguauuuuuguaugggugugugugggggguggugggugagugguacagaaaaauauuucagguguugaugagugcuaagaagaaaaaccaaaugguauaagaggaauagagagcaaaaguguacgugauacuaugauacaaggugccagcugacucuggagcagaggccugcauggagggagggagcagcucugcaggugcggggaagagcaagccagguguuuuggagaguauugggaggcuguagcuggggcuggagcccacucaguggggaaugguaggagcagagaccagagaggcagagagggggacuauaugaggaauaaggccaugaggcaggagccccuggagcucucugagcgcaggaguaauugauaccaucugauucacguuuagauggaucauccuggcuagcuaucauguggauaauggucuggagaguguggugacaagggacacccauugggagacccccaugguuaucuaggggugaggugaugguggucuggaccagcgguuaggcagugguugaauucuggauuuuuugacgugaagaaagaaaaugaagagugaaggguaacccccaacugaagcaguauucugauuaugcuuugauuuauuauuugcuuuuuuuuuuuuuaaauucuuuaacagaaccgagauuaagcguagcuccugaaauggauaucauggacuacugcaaaaaagaauggagaggaaauacacagaaagcaacguguaugaaaaugguaugacacagaggugcacauauuucaggucuuucaaauagucuaucauaaguuguuuaauaugucauuugauauuuuuagacauuaguuaaaaugacugcuauagacguuguuauugguguucuaauuuuagaguuaaggaaauagacuccaaagauaaggguuuuguuuuaagucacaguauuaauauagaaucagcaucaguuauucagugacgcaauuucuuugaaaaacacguaaaugacugcuguucagaguugggccagcucuugguuguccucuuggggccauuugggaauguccuuuuuggucugguguuauaaaauaaaagccucagggaugccucaggccgauuccacacuucugcuuuccacagcacauugaguuugcuuacacacccucugguccuggggccuagaaccuucuuggacucccuacacaggggaaucaggaacugcucccuucaagauagucuccaaggcugugggaugacauuggagauucauaugaugugguccugcugugacuguuugguccgguucauuacucagcucagacaccauggccuacauacaccacacagcugaucaagcagcagacccugugggcucuacccucagauguauaccaaauccaguauuaucaguagggugaaccaugugaauugcucaaaaacagucaaauagcagauuuaaccuaagacuuccaugaccucuugaaaccucuggguuuaucuuuugcucauuuuucucuugggauuauuuacauuaugaauuugaaugcacuucuuauauauuagagauacugacugucauauuuaauagaaauaucuuuaacuuuuuuugguuaggauuuuaaauuuuuaaauauuugaauauuuaguuuuuuccucagagcucauuuuuauagaaaaugauugcucaucuuucagcauguaccucagcugcccaugggcugaccuuagaaaaaucuagcugccacuuguaaagcucugagagcagaugauaguucucugcaagucugauauguagaugcuuuguguuuuaggcguugguuagagaacucaauuaugaaaaaccuggaauucuuaguuccugccagagguuaagaacauuuauauuuuugcuaaauaugcuguuggucacuugcagauuuuccaaccucuagcccaucaggacccauggcaguaauuagagcaucucagaugccugaaaacagcuuucaccuccauucuauuuuaguccuuauuggcgugauugucuguuuuuguuucgaauauucuuuuggaaguaaguuucuacaaauucagauuuaauuuuauucugaaauagccugaguaauuuaugcauuuggaaagguacagcugcaguuggauuugcauaaguauucugggguaauugagguuuaccauaggcaagaaguacauaauuauuaguaggugugauucugccugauggaaccuuauguguuacagugguuggaccacuaaauaaaaaugcaacccucaaaauguuguuauugggggaaaaaaguacuuuuauauucacuuaaaacaucauccuaugacuugaaccuugaaaacagcuaguaaugagguucuaguaccuggacacacaggacagagguggucugcauugcguccaccccacgaugaggguaacacuucuuucuuucugugagugcaggguaggaagugggucuugagugacugucaaugaaaaguuggaugaguuaaggggcugacucgacccagggucagggagauggugggcaguucagucagucucaaggacugugcaugugucuagcuggagaagccaggcaucaucaugccugcugggggaccagacucacuaggauuuuuuggugucuuuucaggguacguuucagaaugguccauuggauggcuguuuuugagugcccaagcaugucacugaauauuuucauuugcuuguuucacuuccagacugagcaagagugacacuucacuuaagaaaagaaggcggggcacgguggcucacgccuguaaucccugcacuuugggaggcagaagcagguggaucaucugaggucaggaguucaagaccagccuggccaacaugaugaaauccugucacuacuaaaaauacaaaaaauuagcugggcuugguggcacauaccuguaaucccaguuacucaggaggcugaggcaggagaauugcuugaacccgggaggccgagguugcagugagccgagauugcgccacugcacuccagccugggcaacgagagcgaaacugcaucucaaaaaaagaagccuaacagaauuauucagccaucuccuggcauauagacuuuuauguguacaugcacauacacaaagcacccccgccccccuuuguguuuuggaaacuugggguuuuucuauauuuuuuuaguaggaaaauauaaacuuaguuuagcucucuuuuuucuugccuuuuuuuuuuuuaaaagaguuuagggucauuugaaacacagaguaaacccuucaaaauguuguuugccagugaguaaguguuaaaacaauugcuuagaaagggacauaaaacuccaacuuugggcauccucccagugaucccaggccaagcuuuuuccacaggaaugaaacuuucucugcuaucucaagucaguaacgaccauuuugaauucuuucauaccuuuucccagggcuaugaagagguuucucagaaguucaccuccauacggcgaguccguggugauaauuacugugcacugagggccacgcuguuccaggccaugagccaggcuguggggcugccgcccuggcugcaggacccggagcucaugcugguacgcugcugcugcagguuugaguccaaaauguuucaaacaauuuuugugagaaaacuuucccuuucuguccaugcuaccuucuaguaucgucugcaguaugaugucagcaugugcguuuauucaguuuuguguggcuggggugauuucacauaguuaaaugaccaaaaauaauugguguuuccuagaagagaaaaaugauaaaauuuauaugaacaauuuaguugaauuagagagcagauguuuguauaaagcacuuaggaacaguucgauuucaauuuugguguuuauuuuaaguaggcuguauauguuacuauuugagaaccugcuaggguuuuagaauacacauuucuuuaguuuuuagcuauaauucaauaaauuaguacuuuuggcuaagugugaggauuggcuuaguagguggcagaacaggaacacuagaagagacaugauuacugucacauggagaggggcuuccugaggagcugagacucagccugucccaggccuggcccucuuuagcguuuuaaauguaccacauggcagacaugcacuggaaagucaugugucugcauguccugacacggauaaaggcauauagucaggugggugauagacuauccugaaagauuuuuuggucaggaaugauuggucagagacagcaauauacccauauaacaaaucugcacauguaccuucuguaucuaaaauaaaaguugaauugcaaaaaaagaaauggccacagccacccaaucuucaacagccaccacccuguucaguuagcagccaucaacaucaaagcaagacccuccaccagcaaaaagauuacaacuugcugaaggcccagaugaucauuagcauuuuuuuaccaacaaaauauuuuuaaauuaaaaaaaaaaugacaauaugacauuaacuggaagaaaauugaaagucuugugcuuaaauuuaaaaaauccaaaacccagaaaugcuagccgugggagauuggccuuauagcaauuuaugaaaagaaagaaaaagauguuaggauuuuaauuaugcaagcccacugugagccugcaugaaaugcgauggcuagcaaugaucacaaagcccuagcugcauuuuauuuuuauuauuuuuauuuuuauuuuuuuugauauuaagcaaaaagaccaaccuggcugcguuuuaaaaggaaugauucuaagaauuaggcagugacagccccaccuugaacugggcuggucagaggccaucucaagcucggugccugauaaaguauccucagcagauggaaauguggccaggaugcuucuucacauucugggagccauugaaggaacugggguguuuuccuagaauaaagaagacuuuuagaggaacuuguugacuaagcuagaggucuuuuagguggaugagagaucacacgcucagaagggcaaaaccaggauugaugggugaaggauacuccccaucuguuccaugauuguuuaauacaccagcauaaaaucagcacaccuauaucaacugucaaaaugacaucuggagccaagugugguggcgccuguaguguuagcuacucaggaggcuggggugggaggaucacuugagccaggaguucaaguccagccugggcaacauaaggagaccccuuguauuggggagucuauuaaaaaaaaaccaaaaccaacaucugggaaagauauuuucuucuaagcaaagaugcaugccaucuuaagccgauuuuucaguauuagcuuauuucuuucauauagaggcaagagaaauggauauacuaagcuguuuuuucuuuuguaaaugaugccauuuauuaguaaaguauuucagaauugccaguuggcgaaagcauuccuaugguuggauauaagacccaacuagagaagcaaacaaugauuucacuguuuuugcuuugccuuauuuuaacuucugugcuugacaacuguagauauauaugacacaauuucuagauuuuggugguguauaccuauguucuuagcuacucaggaggcugcgcuggcaacuguggcuauauuauauuaaucuacaaaucuguauuucuggauagugacauaauaucuuccucaauuuuaggcaaaauuuuccuuuugaggcuuuaccuuuaaggagcuauuuggauuuauggacuuacuugacacuaaauuuguauuuuuauacuuucugagaaucugggguaaauaguguccuaauuaauuaaauaaaguauaaaauugcuuuuaaaaaaguuaaguacaaugucucccccccuuuuuuuuugcuagcaggauauauuggguaagauuaucugccauauuaaaaauagucuggguagauuacauucaaacucuaaucacuguuacaauauguugcaugugugagugaugggguuuuaaggugguuuuucugacuuaauuugaguaaugugaaaauaguuuuaaaauucuuaaguguucuuuccaguuucuuuccuuuucuauguguaucagcuauuauauuuuucugggagcauaauuuaauuaguuggucacuugguuugguuuuugucaucuaauugaaugccaagaggccucugucagagagggaaaacacaguguaccugccuguggguuugauauuuauguuuauuaaacguuggaucugaauguuagcugaagaacgucuuuguucuuuccuugcugucauccagccagaggacuuguccuuguguugcuguuccagcccucagcaauuuaacauaguuugaaaacuugcuuuacccaguucguuuugugguaucacgucugagacaugauuggaugacaaauucaaauucagcacaugcuuuguguuugaggggccagugaaggaaggaagggacccauaagcuuacucugguugugcaaaucuaccagguggcccgcagacccuccuguggaugccuuuccauuccuguucucacucuggccccccuggccccacagcccuucccuuggaagguccacucugacaagggcuuuguugagugagcguuucuugcagugugacugaaauaaaucagggguggaaccuuuagcuagcuuuaucugcuucuguuugcagauugagagauguucucuguggcauguugcugucuucucugucuuuuagaacaucauuugguuuuaggguauuaaagggagcugggaaagcuagacugagugacccuccccuuaaucuaugcucggugaagaagacccgggcuuccuuucugcugcugcucagcuuugcuggccuugcucuguucccugccugugaggcagagcuuuguccuuauuugccccucugacaguucggcugucccucaccuccugucauccugcccagguguccuguuuguuguucccauuucugcccagaucccagucuccguguuuggcugcagccagaucaucugacccucaccccagcuauggagauggccuagccuggcucucaaaugugggacaacacuuugguuccugaggaggguacccuuuagaguuugguuuccaaguucguuacauuuuauaaugucucugaacugguuagacugugacaguguuugcuuagagugagauagacuguguaucaaaauuuuuuuguaaguuuuggggaugacacauuuuuauuauuugcuuucuguugugguaucaagaauuaccggcauaugcuagagaaaacaggcuguuuuauaguuuagucacaaacaaaaugacaccuaagcuaauuaccuacuuuauucuugaauauuuccaaucacuguuucuuguuuaaaucugguuucuugcuuaaauuuucuuuauucuaauagaaguccaguuugugcuuaguggaaaacaaagguuauuuacguguguuccaugugcugugaccucugaaagcguuugaaguuguauucacuuuuuucuucugaauaaauuugacuucauucuuuucugauggcuuuuuucaugcuucauuuuuuaaaauugucuuaaggauuucugcauuuccuggaagucuacaacccugaacuguuugaccagugugugaagggaaucagaaacaauuguuucucucuguguaguuaggucuucagggucuccugaguaauucaguugaguacuguaccuacuuuuuagauaacuguaucauguccccagaugcucagccggucuucugggcuucccuucaccucauuucccagcucacaucuguguagccaguauuuucugcacauuuguaguucuuugugcccaauuguaauuuuagcuuguugccacuugagggcaugugagguucuugugauaaaucugagagacugaauugaagguuuugcugcagaacugccacauguugccgaaacgcagggcagugugggcacggagugggcuggugcagccuuuagguggguggucauuuguuauucuaauaagaugaggaggagaagucccucuccacccuuagugagugauguaguucgccaucacuguggucacagugaaaaguaauuuacaucccaaucgugguucuguguuuuguagaaaccaccuuaguucacacgauugcucuagguugagaagguaccaccagaauuacuauuuaugaaagggucuuuuagucuuacauuccaguugaauggaagauuuggccucauuuaaaacuguauuuauuuuauuuuauguauuuauuuuuauucauuucuuucuuacuauauaaaguuuuuaauuuuuuggggaugaggucuugcucuguugcucaggcugaagugcaguggugcaguuauagcuaacuguaaccucaaacucccgggcucaagugauccuccugccucagccuccugaguagcugggaauacagguacaugccacugugcccagugaauuuuuaaacuuuuuuuuuuuauagaaauggggucuugcuauguugccuguacuggcagaacuguauuaauaacugcuaaacaaggucagguuccucauaggauauuguaggauuuaauuauucuuuaaugaucuguugacuuggaggugaacuuuuuuuccuuucuaaauuuuauagcagugaagugacacaccugugcccagccuaauucuaggauuuuucuccugacacacccaagacuguuggaagagucuuacuucccaugcugucaucagucaggcugugccucagcuugccuuucaaacugcagauuguguugauaacuagagggaaacaaaguaacaaauacuccaggaauaaaaaaaauggaaacuagcaauguaguucagcugucacuucuuucaugaacuaagugagcacagcucacuuaacccugccucugauuuucaauuguauguuuuaucuuaauagaucgauuagauaguuaaacuagacauaguaucauuucucugaauguuaaaacuugaguauauguguuaacauuauuuaaccaaacuuuuucuaccuuuuuuugguggauuuuuuaaaugccagaaacuagguuuuauuuuucuuauugggaaaggagaagguuuggcuucacccuggaccuucucacaugcucagaagcacugucccgagccauguguuagguggugguugagaggcugcagugagucccauagccugaaggugguuggugugaggacgugcugugggcauggccugcuguggaauguccuggccgugguuggaguccugcaaggcagauugugcuuuggcucaaccaaaagcaccauuucacuccagcagcccuccucagggugguacuuucuaaguuccugacuucuagauuuagguccuccauccuaagcccacaucacagauuugcagaauuaauucuggaaacaaaguuagguuuuauagacuuugugguuucuuacagcuuggauugugugguggauuucuuggaauguuaacacuucuuuaucucuuuguuucucgauguuguaguuaccagaaaaacucauaagcaaauacaacuggaucaagcaauggaaacuuggacugaaauuugaugggaagaaugaggaccugguugauaaaauuaaagagucccuuacucugcugaggaagaagguuuggaaccuguaguguccugucugauaagggugaagcucucguucuugcuugccccagaagaccaguuuuuagucuucacucaguggauuuucaaaugcucuuggcugauuuuuaggcaaaaugguuuuaaaugaauucaaacucuucccacgagggcuuuaguaaaaugggaaguaccaacauuauauauucuuagagcagaugccauguacuaggguaucaaauaaugaaguguuugacuuucuuaaaaggaaaccuuaacaaauauagucuuuguuccaagucauauuuauguuucaagaauauaauuugguuccuauuucuuauaucauuaguaauuuauuaaauucuuuccaauuaugcucauguuuuaagauucugcccauauuuaucagacuuauuuucuuucuccgugauuuuccaguuaguagauuuaguaacuugucuuuagaaaacuguccugagaguuuuucugaaacagaauuguagggagaacuuggucuucugauuccuauugauuuggucuuugaaauucuaccuuucuguggcuuuccacugucuccucuggguuggauguccugccugcacacuggcuuacaugaccccuagcuugcuuucauugagcagcuuggagcccuucucaccaagaacccugauugagggccugucacuugcgccagggugucgguggaggguggucaaguagagaggggucaaacauggacuuuucaagguccuuccuagcacguacuucaaacagugauuucuguacucacacauggucugcugcucccauuagacuuucagcuccacgagagacuguccugugcauuccuugacacccuguguccagcagcaggucuggcacauaauagguguucauuuagugcuuuauugaauuagugaacugagggcccugacuucuuggaaccuaguuuuugcuuagaaagauaagaaauguuuacuggaaaauauacugucaaaggaaguccaguaguuuuaucuuucuuuuacuauaaagaaaugggagcaaaagaagggaagagggaaauuccauucuuguuaccuguuggacuagaaugcaggauuuuuguguuccccaguccuuggguuaguggaaggcugacggcagggcuguagcccugugggagugaacgagagggcccuucagcgcaaccacaggucacaauuucguuuucauuuuuuuaaggucuugugaaauugcuauuucugcuuuauuagguuuuucuacuauaauuagacccucauuuuugggaaugcuugaguggugccaauuugcaauaagguuaaaauuacuaauaaucugagccagcauuacuaacacuucuaugccaggcuccacacuaaaauuucauguguuauuuaauucucacaacuaugaagguggugucgcuguggucaucacuguuuuuuaggugaggaaacuaaggccaggagcucaguuaaaugcccugcaaaaaccaccacagcugcucuguggugaagccuugauuccaucccgacugacuuuagagccauguccaugauuggcaacuuggucuaguuuggaaaauaugagauacagacaagcaaguaccagccuucagcccaaauauuagagggaauuguaugcagucauuaccauugaauucacucuuguauuuaaaauccauaaugguguuugagaggggcacuaguuauuguugauucauaaggaaugguauuuauguuggcgucucuuauucucauucacuguaacuuaaaagcacauauauuuauagguuuucuuuuuuaaagaguuugucuauauucacugaauaccuaacacauuacuuuauucuuaauccggagucaagaguuuccugaauggauuuauucauuugaaguucauauauauuuuugagguuagagggauaaguuuaguaaauuauuauucaggagccccuacgcccuuccuugccucucuuccauuuaggaggguuggcuuuguguuucugggugcuaacccuccuguaagccccuuauaauuguagcugcccuucacagcuucacacacaggcuucacacacauguguuagcucuuccauaagugucucugauuggcugguucaaucucauugccugggaaguuaagggagucaaaauuuccacagccucggugcuucuuauugcauuguauuuuucuuucaaauuaaugggagaaaaagcugaauaaggaguuugugugcuuuaaaguguaccauuuguuaaucuggaaaccugaauguugugagcauugguaagugacccauggucacuuuuaaaaaauaauuuugugcucauaguaugguacuauaccagggauuuuuagaacaaaaauucuaauuauuacauaacuuucuuauuguagugggcaggcuuggcugaaaugagaacugcugaagcaagacagauagcuugugaugaacuauucacaaaugaggcggaggaauauagccucuaugaagcuguaaaauuucuaaugcuaaacagagccauugaacuauauaaugauaaagagaaaggaaaggaaguaccauuuuucucugugcuucuguuugcucgggacacaucaaaugacccaggacagcuucugaggaaccaccucaaccaggugggacacacugguggucuugaacagguaaguugugcuuuugagcauguauuaccccaaaauaaagcagcuuuacugaucaaacuugaugucacaguuuuuguaggucagaaauucagggacagcuuaguuggaugguucuggcucaggaugucaugaggcugcaguuguauguucagggcugcagucaucugaaggcuugacuggggcuggaagaucuacuuccaguguuguucacucauguggcugugggcaggaggcuucaguuccuuacugguaguuaguaggaggguucaguucuucacacauaggccuccacagggcugcuugaguguccuuacaacauggcagcuggcuucucagagugaacuaagcagugagcaagaaagaagccaaaaugccuuuuaugaccuaaucuaggaugucacacacuguuagauuguuuucuacuuuuuagaaacaaguuacuugaugcauuccacucucaagaggaggggaauuuggcuccaccuuuuugaaugagggguaccaaagaauuguggacauacuuuacagucaccaccguuaucucagccugggcuuuauucuucagagggguggaugggauuaguacucuuggcucugggaggcuacaaauaagugaaguacuuggaagagccauucgaagggucuuguuuaaucuuggcaacuguagcugcauuaaaaagagaaauggagucaccuuagccaguagaguucagccugcucuuggaucuuuuacagauuuguuaaguguggaguuuuacacacaaacccagugcaguacuaucucuaagccaauauaguugagucaccacaccuugugcuaucuuugauguguucauuuuccuaaaaagucuuaaugagguuuuuuuuauuggaauagccaaccgcuaaaguagcauuaaggcuguucaucaaagugccacccuccuacuuacauaauugacucuugugccugcuuuuuucuaaaaaggcccaagugccaugacagauacugcaaggauuagagagcugaguuaguuuccauucugagcuguccuggagugugaggucucuucuucuguuauugccaagugcguaggaaggaguguagacugauggucacugcugggucaggcagggcugaugauaguuauuuucaaaaauuaccuguacucauaauguggguuacuuacgucuccugaaccauagcaaguaccuugcagucaaaaggcuuauagaggaugguuugcauauuagacuaaaguuagucuuuuccgagacccuauaaggucugcugugauggugaguccauucuuuuuuuuuuuuuucaauaagaaauuuucaguuucuuuuuugaaauacauauaccauaaaguucacucuuuuaaaguuuugcagccaucacuacagucuaauuuuagagcauuuugucaaaagaaaccucaugcccauuaguaaccacuuugucuucuuucuaacccuaggcagccacuaaucuacuuucugucucaauggauuugccugugcuggacauuucauaugaauggaaucauauaauauguggucuuuuguuuauggcuuauuugauuuagcauaauguuuuuaagauuucauccauauugcaccauguauuaguacuucauuccuuuuuauugauaaguaauaucccauuguauggauggaucacauuuuauucaucuguucaauaguuugauggguauuuggauuguuuccacuuuuuaguucugugaauaacccugcuaugaacauucauguauaauuuuuuuuaugugaacauauguuuguaguucucuuggguauacaccgaggaguggaauugcuuuaacauuuugaggaacugccagacuguuugcaaagcagcugcaccauuuuacauucucaccagcaauguaucaguguccuguuucaccauaucuucaccaacacuucugacuuuuuguauuggggugaaguucauauaauuuaaaauugaccauuuuaaaguguacaucucauugacauuuaguacacugcuggugaccaccaccuauaugaaguucuaaaacaugucacccccaaagaaaauccugugcucauuaagcagccauuccccauuaucaucuuuuugguuauagucauucuagugggugugaaguacuaucucauuguaguuggauuuggauuuugauuucccuaaugacucacaacguugagcaucuuuucaugugcuuucuuggucacuuguauaucuucuuuggagagaggugucuguucagauccuuugccuaauuuuuaagcugguuauuugguuuuuuguuuuguuaauuguuguaaaaguucuuuauucuggauacaggauccuuaucagacauaugauccauucuugauuaucugcuuuuuuuuuuuuuuuauuuaaaucgaaaaggauuggggcugggcccaaagcaggaggaaaaaacguuguggcuucaccauugcugugcacugugggauaauggauggaacaugguguuaagccacguuuuucagugugaucuuccucagaauacccguuugcucuucuucccagguugaaauguuccuucuugccuaugcugugcgccacaccauccagguguaccggcucuccaaguacaacacggaagaauucaucacagucuaccccaccgacccacccaaggacuggccagugguaacgcucauugcugaggacgaucggcacuauaacauccccgucagagugugugaggagaccagucuaugagagacgcaugcuccugacagccuggcgacguggcgaagaugcacagguggcuccugggcuugggcugcagguuugggggucucuaagaacaaucucugagaagaacccuugggccccugggagccaaguuggacaggauguccugaagacuagcuuuugauaagagaaauuaaccaagucuuuccccucaucuaugaugcaauauauuucagugggggccuucagagcacaccuguuggacggugcaaaccauaucuucuccagaaggcaaauacuuuuguaucagaggaaacucaguuuuggagaggaauauguucuuuaugucucaaaucaaaacucucucuaaugguaaacuggcuucuaauuuuuuuaaguacaguauuuuuuuuuccccuuuaguaguaacggguuucuauagaucuuccuauacagucugcuuuaacucaggaccuugagauuaugagacugacgugcugcccacugcacugagggggcuucuaacagucugcuuuaagugguauaauucugggauagaucuguuacuggcauagucaugacaaccucugguaaucuuaccuucuccuuuuuaugaagggaagagcaaugguuuggacuuacaucuuaauuaaggcuauuuuaagcagauuguuuugcaacagauuaagaauugggucccaaaguggguuauuucaaggcauuuuugaagacuggaggagcguaggagggaguggugagggaaccuagaacuucuugcuccuugugacuaugacagaugucugaugcccccagcgcacuggagucuggggcuuggugcagguggugccccaucaguguggacagacacuacuugccuuugugguuuaguguuggaagcuuuaauuauucuacaguuccauagauucacaauuuuauagccaaacaguuuguauccaccugcuuucagaggaggaaccaaaggccaaauuacuuugagguagggcuuagcuggaccuggguuuuccuaugcucuuuucaugcuguguuggaggguguguccacugccagaucuguguaacccgucugggucaggggaugagugacagcaaaccaucuuaaaauuuuucaugaguacauuuaagcggaagcauacgggaauaugagugcaaaaguguggcugagccgcguaugcccuugauugguuuugggaagccugagggaggcagccuuccuggcuaugagccaucgccugcccaaucaggcuaaggguggugacugggguggugaaggggcagcucugcugagcauggucugccuuauggccugaauuguccucaagggguguggacugcagaugguguucacaugaaccggagacaucacucuuuaggauucuacuggcagccccugaauuggcucaacguuuguggaggugguauuucccugaaguacugagcuuuguuuuauaauaauuaaaauccuuauuugguccaauuuaauauaguuuagaagcuauuuuuuuugaggcaaaccguuuuugaaaauguaaauuuuguuuuuaauuaaaaauaaagucuuaguuaagaaaacucaggaugcacaaaacuauucagacuguuacuuuagcuuucucccauuaccucaucaguaauauucaccacauuuugcuaaauauuuauugauuagaguguugaaaucaaauucugcucuaaaugugugugaauauguuggagaggcuuuguguucuucacugugaaaugcaauugugccuugaauaagaagguaccuagaagccaaauuaaaguaauaaugacuucuuauuggcuuugauuuuucauugcaguauaugggauuguacagcaggaaaugcuuaucauuaauuucugauguuuuuuaaagcacaacucgaaacauuucgaucauacauacauagcaguagagaucugugcccuucagguacauugaaucugaccaucaguuuauauaugucauugaauuuuaagaauacucauguuaauaauagucaucuauccuugcauuuugaaacuguucuaaucuuagugaacuugaauuggauuucuggguaaaagaauguguuucuuuuauguugcuuauguccgaaggccuugucagaaucugucagacucuuguuuagguuuagugugaucauggcgucagagaagcaaagcuuucaaauaaauaguacuucaggaaauagaaaugauugaccaacuuuaaaaauaauuuuuuuuuaauugcaauaugcagcuucaguugcccagaaucuuaguuccguuucucauucuuggucuugagcuggucaggugacaucagcagauuagaaguugaauggagauuaaguggauucaggaggauguuccacuuagagcagucuucaaaaugauaagguguucuagaagaaaggaauguaguaggaacuauacuaugccuaacuuucuaucccagagugucuugcaagaguuuaggaguuuuggacccuguguauuggcagaaaaguuaucuccaucuuaagcaggcaugacuuuuauaccugugagcucauuuaaggugcauuuaaaccuaaaauaauuucccuguauuaugcuucaugggauuaacacugcuuuuccagaacauuuucagauuccccuccuuacauccugagcuccuucuguauauacaucuguugauuuuauccauccacaaggaacaaugauagucacauuagagaacaagaaaccaguaauacauggucucuaacugaugauucgggccuggauuugauugaaaguguuugcaguuccucuuccguagaauacagaguggaugaaaauguuuucaaugcacagaacaggaugaauccuuuuuucuuuauuuagcgauuuacacuuuuguuacucuauuauauauucaguuagugucugauaagauuuucuuugcuuaaggagaacggacauugccuugguauguuuuuuuuuuuuuuucccuccacuuuuggagcuuaucagguaaaaaucucaagccacaugaauuguuaacaccucuguugggaaaagccuuugugaguuuuuauguacuuggucuuuguuuuuguuauucauccuguguccucccucuucccgaugugcuguuuuaccuaggaguuagucugcuuucugaggaucuuuuagagagaggcugugaagugcugaaucaccuuuaaugauacagcacuucugccaucucagcaucuacauaggacuuacauagacuuccugaaugugucuucuucagauacuaaaguacaguuggaucauuuucuuaucuccuuuucuuaagcaguacuuugcagguacuccccuuugaaagccagaagcauaaaccauuggggaaucuuaacuuguagacaugcaguaaaagaaaugcauuuauguaagaucugugaguacuuaaaaagaaagcccucagugugugugaagugaaugugaaaugugugugaaauacauagaauucccaaauaguuuagcaaaggcagggcgcaauaucaaguaauuuaaaaaugguccaaggaacuguaagaaggaggaacuaauucuagaauaaauguuaaaaugccauucaagaacaaaaccacagaugccauacagaccuccugugcuuaaguuauagaagaauaaaaaucugaaugaauggaaggccuuacguguauacaguuuacaaauuccuauuucuaaaauuuaagucccuuauuuaacagaaguauguauuuuaaugcuuaacugucucgggaaaccucauuugugacaucaucuaaggggaugggaagacuagggagccagugccacguugaacagaacagugguuuagugaaugugugaggaaagacaugggcaacugauuauuaauguuuuuguaauucaguuuauaacuuggaaccaaugaaaagcaacaaaacuaaacugguuugacagccugccacuucuggcauuuccuguaagucacuagcaguaggugugaggugggcuugcccaugaccaggaggggugugugugugugugugcauguguguauaugcguguuggucugcagucacagcauaccuuuaugugcauguguccucgcagcuugggacucagcaguauucugggaggguggaggugaacugucccauguauuguauuauauauuuuuugagauggggucuugcucuguugcccaggcuggagugcaguggugcgaucucagcucacugcaacuuuugccuccugguucaagcaguucuccugccucagccugccaaauagcugggauuacagguguguaccaccacucccagcuaauuuuuguauuuuuaguagagaugggguuuuaccauguuggccaggcuggucucgagcuccuggccucaggugauccaccugcuuuggccucccaaagugcugagauuacaggcgugaacuaccgcgccuggccccauguauuguauuuuuuucagguuauauugaaaucuacuaccaggaaugucggaauggguuuugguauguauaauggaaauagauagagugguuaagucuagaaacacauacauuaauuguauugaaauguuauaucaauacaucauuuaugauguguguguggucccagaccucauggccaccaguuuguuuaagcauugugaaugcuuuuuaauagcauucauuagcauuaauggaggaggacacuguguuuucucaauuaaucucauugauuuguuugguauaaguuugggucagaaaugaaacugccaaaacaucgaucaguacaaggaagggacacagggcuuaaaauguccacagucuuggcaguggacuuggcaguucucccaguaagcagaaguacuugagcuuaauucugaacuucaaaguaauauuuuauacuuaauuuuaggaguuuucauuuacauauugaaaaaugccuugacuguauucacauaaauggugcuaaaacauuguaccccuuauaagaacugcagcaauccacaguaauguugguuacuucugaguauuugauaaaggaacaaagucaaaaugaauguauuuaauaagcuucuuucucauuuccauuguuuuuauaaaaauauuuugguauuguugccugcauuuuagccacuucuaacuuuuuguauuaugaauuuggagaggauaacaagccaacuuuagacccucugccaguggcgaugguguuuuucuuccauggguaagccauugugaauggaggcugguggagcagcacacugugugaaccuggcagcgcucaucuuggcuuguuuagcagugccucuguuuacaccauaagauguuccgcauguguccaaaauuucgccugcucugaaaaacaugcccccgaggcucugugcaguuuggggccuugguucccaccugcagaugcggucaguugccuggcuccuggggccagaguuuccucuguuacuuguugagucucuugucuucacugucagaagcugaacugacuugggggcuuugcuguugauccacuuuagcaaacccugcugcagaggacuguaaaaacaaauaacuaaaaauaaacuuagaaaauacaacucagaagccuggcucuguugcuguggucaaaugcuugccuuugaggacuuuggcagauugugcuauuacauugggcucuaacuuucuggcacccgcaaggcagaccuaugauguccacauggcugacucuugaccccuggccauugugagcagaggaaucaaggguuuagggaggcaguauugggcaguguggaagaguuagaugagaugaagcaguuagcacagugcuuaacccauacuaagugcccccaacccugccagccaaauuaggugcauaguuuucagcuugggucuggauucaacagcauucccgcugcccacuaaaagggugggcuuggacaguuccugaaccucccuaaaucuguuucuucaucuuuaccacacacagucugucucaguggugguguggauuaagugaggugcuagcacuuauuaggggaagauccuccagaccugcaaagcagggcugcagccccaauucugacccagcccugcuguguguuugccgcaaagagguuuggugugugcgagacauuucuuuaugaaccauuuacacugcuggaaauguacccacuaaugugauggcaagaacuucaacaaauugcuuaugaaucaggcucucaauggaagaaguuaauccucugaagagggggaagacuggacuuucagaaguauguuggggauagagaaugaaguuugagucagcagagcucugccuuccuguuugucaaagaacuagagucugggagucuugcaagauggagcugggcuucugaagaacccaguggguagguacugggcauccauuagacggcagugcuaagucggucaugugcagcagaaagaccuccccacugugaacaacaaaccacuuuccuccuccaguggcccauucauuuggauugauacacuuuuucagugucagaaaugcacuuucucccucuacuugucugaauuacgaugcucugcucaacucuguggacaguguuucuugaauuuccuuuuccaccgccuuuucccacucaagaaaguggagagaaaaacagggaugcaggcugugggucuuguggaagcccuuuacaaccauuaaauaaagaacaccagcugcauuauguguguuuagaacgagaaguuguuuguacaguauuuuucuauugaccgcuuccgucuugccugaaaccugggcauucuuucuguaguuucucugaauuuucugucucaccuccucaccccuacccuugccuuuugucugggcucgguugccuguucauguucuuugccucugacauuaaacucucccuaguugccugugugcuugagacgucuuaacaaguuguccucuaaguggugccauugauguacagucccauuggagagcacgaguauguuuccuuaggcucuuacaacacuggcuuuaucaaacauuuugaucuuugcugagcugaugguuggaagucugacuugcguuucuugagaaaggcugagcauguuuucauuugcguaaaccauuuucagguccuuuccugggagccaucuguucaugucuucuguaaccacuuuugaguuuucuaucugaauuucacagaaacgagauagauguagggugggagcaguaggaaggaaaggcggaccaagggguguuagagauuccaugucaggcccuuugguugcaaguaacaauaacucacucagaguauuuuaguucacaaaggguuuggccuucuucagggacaagaagagagcauugaagaccagaagguuacgggagggagggcugucuugcugguguccuagaguuggcauguucaggguaggaauaugggaaugccugcauccauucaccaaagagugccagcccuggggccaggcaugguuccaaacuuggggauguaggggugagccggccaaggcacaguccucccagcccucuccauccucaccccaaccccaugcccacccuccccaacccuccccauccauacccucugugcucacccuccgcaucugcaccucccccuuugcccacccuccccaucuguaccucccgcugugccuacccuccccagcccuccccucugcagcccuccccaccuuucacggagcucuugugcauuugucacuggugagcagaacuggcaugacuccagggauggaaucacaaaguaacuauuuuugucuuuggcuguuuaagacauaauucaaucggagaccuucuccuaccccuggugaaaacucaacucagggcgacccaucaccuuuuugagcacucugggguaauagacuuuauaguccucuuagguugccaaaugcuuuccuaacucagaaauuggaauaucgcaucugugugagagugaaagcugugacaguugcucacugcccuguuuggcccuccagaguuagaacaggaggagggagccaagacagggagggagcagagaucucagcccuccauaggaauuguccugucggccgcccuuccugggcucagccagggcuuuguucucauucucucaugggguacuuucaggaaucuuugaggcccccucugucuccccacuucuuguccccggcucagggccuucccauguaccuugaccaaggcagcuccugggaugugcuaaugcugucgccucccaccacaacuuccuccuuugcagcucguaggaagccagugauagcuccagcuucuuucuacugagcccuguccacaccccuagguggccuuguggggcaggccuuaagaugaccccaggcaagcuuguugaucuaugaggccagggucugggccaagggaaagacuuuuggacccccugcccugucaaacucgggauuugccagccagccccaaugcccuucuauuagauuugaugggugagucagacaccagcccacugaguccccaggacucaggaccccauuucaagcuuugaguauuacaacccccugccccagaaggagugggacucagugucgcucucugcaaagaaaccaucucuacaaauucuuuucaaauaucuacucuugguacuuuuuugcccuccucguguugagggauggcagagucagggaguucagacuccugcagaaggaggccgggugccaucaggaguccccguuugguguggccgccuucucuuuggugugagugucguccucucuggcuggguucuuauuuucuacauguagcucaggcguaagcuggugcccacccguguuaagugucaggcugguccugaagcagcccagugccuacagugaggaaggaccugccgggcaaagcagggcgcucaucaggccaggguuucuagaaccauaucccaggcugcugagaauggguguguggguugugugaugcagaauucuaggagaugucauuuccaucauagucuagggaaacacucgagccucguggagggagaugguucuggagggaggcuucuguagcauccaagcccaaggugagcaggagcccccugagccgagcugcugggacugaagaggaaaaggagagagugggagugagaugcuaggaggcagcgcugauggcgcuuggggacuugacugagaggagugggacauggaguggguuuccgggugggugcuccugugacuccucuagaugggggagacaggagaaaauguggaagggguaaggaaagaguguacagggaugggcugaaggccacagcccuucucggccccuggggagauguugggaggugacuggauacacccagugacuggucugaagcuugggaacaaguuagggcuggaaaaacagacuugggcaucaccgcuguauuuggagcuggaaauaggcccagauuaggaaccugggcuugugaggacuggauucccagcgaagguggaauugggccugccagccauuuguauacuuuucugaagagcauggaauuaaauagcauugggcagguuggcacugggggaaagaagaaccgggcgagguuaggacguggccuugcuggcaugauaaaaagcaugaggaaacgcuuuuuaccucagaccacacgugaauugcaagcagcugcccugauggugccaucaggggcgguggagauacaggccgcucuccucagccauuuccuuuagaccaagagagcuuuuauuguguagcagaugaaagacccgaugagaauuugagguguauaguauaauguaaaguuuggaaauaaugauuguacuuguuaauucuguauuggucuuuggaaucaaggguuucugaaccugagauaagcagcuuuuuuguuucauaaaagcucuagucauuuuucuguguugaaaguggaccacaguaauguucauggauuuguuggcugaagcacuuccauguggcuuagaagcuuagcagacacggcaccuccgccuuugugaacugucauuggccacucugcaaauccugguggugcaguaguuuagaacuguguagaaaagaucugguuguagaggacaggaggcugauccagaggcgucuagucacuugccugaaucacagcuaaaaagcagcagacagaaugaggacucacagcuccugauuuauuuuuuccuuuuguuuaaagcccaguguauugaacugggcagucagcaugguauuuacuguuuuauauuguccagguaagaaaccuggagcuuauugggagcagaauuacaaauauaagcaaugccaaccuucccugcaccuuagcauuaccuuuaauagugucaaaaaaaaaaaaaaaaaaaaaaaaaaaaaaaaaaaaaaacuuagaaggaggcauaguuuucuccacaguuuuugagaaauucuccacgauuuuucuccugagcuaagccagugagaccacagaggauaaagaggaaggcguggaaggcagagauaccagggggcagggcuuggugggacuccacuggcggugggggguugaggaggagguuuccaggugggagguaaaugugccuccucuagauggagaugucaggggaaagcauggguuggggacguagauuugccccuugugguauuaagaguaccacuccccacagggacagugaaugaugcuggggccagcgcagcucuguauugucuuuaaggcaaccaggaacugaacauacuugacccgauagcuaggccugacccuaugccauggacauggcauagcccaugcacuguggccgggagcacagcucugaagccuucaaaaacaugguugguguuagagguaguaagagagaagcacaguggagguaggacugagaucugggauuuuaacaaaaggagcaguaaggaaggaaauaggcaaucccaagcgagucuguaggaugccuagaaucuuacugacuacagguauguaaugaaacacuuucuacaaugucuuaugaggagcuaaaaaaaauuagagccaucuuucuuugagguuaaaacaugaugcuuuaagaaaagagugaugcuggccgggcgugguggcucacgccuguaaucccagcacuuugggaggcagagguuggcagaucacaaggucaggagaucaagaccauccuagccaacauggugaaaccccgucucuacuaaacauacaaaaauuagcugggcguggugacgugugccuauagucccagcuacucgggaggcugagggaggagaaucgcucgaacccgggaggcagagguugcaaugagccgagauugcgccacugcacuccagccugggcaauagagggagacuccgucucaaaaaaaaaaaaaaaaaaaaaaaaaagugauaaaagaguaaugcuuuucccauaaagacuaagaagaguaagaaucucuuagaugugggcaggaggauugucgggcucuguccuucucaggcucaccaaacacuugcuucauuuuggcauucccauuugagaagguguauagagaaguuggagaggguucagagaagcauuuucauuacugaaguuuugggaaguaaaaguaauuuuaaugcagaauaaaaucugaagaaauagguuauauuuaaguaagacagggaguuuagagaaauuucccagugguuagaaguuuuagcaaccaagggaaagggcaaaauguuaaucucucagguaaauuugauuaaaagggaaacuguaaucaggauuaggaaaccaaguaacuuugcggugaguaaacagaugcaugguuagaauaaaaaaaaaucaagaaacuaaaagcaaucucaguuguaugccaaguguuuaagcuuuacuuaaaguaaaauuagaguaugaaaccuauuugacaauauaugaauacaaauccauaaacccugaaacaaagcauauauaaaugcucuuaccaaugcaaaaacuuccaucuguuagauacauaaagagcacuuccuuaaaagcgacauguauuuuauacugaccgcuguagucaauuuuaaucaaaaacuacacaaauauuuuauuuguauuuuagagacgggguuuugcucuguugcucaggcuggauuccaacuccugugcuuaagcgauccuccugccucagccucccaaguagcugggacuacagaugcacaccacugugcccagcuaaauauuuuaaugugauugguuucaacaguuuauacccacaguuuugaugugaaacugacaaaccuaugggcugacagccacagcccauguagaggaaugacucuaagcacacuuaauuuuguuuaaaaaaaaaaaaaucuagaucacugcuaauguucagaucugaaaugaagaaugaggugauuuuauucuuccauuguaggaucucauacgacguucuaaauccuagaucauaaacagaauguuagaucaggaaggggccuuagcaauaauggcucaagccucccauuggacagaugagcaaggugaggccaagaagcgugagugauauggaagccuccagcuugaauacacuucuuaaaugaaugagugucggcauggaacagaaucacguguguggcucuuguccacuuucccgaagcccuuugauuaacuccuuggcccuacuagcuuuagacaguucccugaucaguacaucauuaagcaaccaaaauaucucauuaaauccaaggagcagcguauuugccacugcaaggcuuguggauguggcagcccugggguaagggaccugcugcacggugacaugaccaucgcuguggggugcugggugauugguguugauguguacccuguacuccuuuguuacgcaagggugguuugaacuuagcuuucaguagcuguuucauucaaaccgugggucccugcauguucauggccccacacuucagggaaccagcaucuacccgguuguaauguuccccuaauguuccccaacuccagaggcgccauuucuugcccuggcuuauagcuagggaacauugccucuaaaucuuauagugagaauuuccaugagguuguacagugagugguacaaccauuuuuagcuggucuguccccuucuuuaaccuaaggaaaccacuuaaacucuuggagagagaaagggugccuaguucuugugugcuuuuguuuacauauacauauuguagacgcuaaugucaagucuuguuaguaaagugcacuuuaaguuauguagccuaacuuaaaaacagguacuauauaaaaaaaauuugcugaaucuauguguagcugacagccaccuauaaaagugcauauaucuuaugcagucuuuuagagauccugguugauugcaaaugaagcagagaaaaacauuaucacuaaaaugaaauauuuuaaaagauacuggcuauaauucuccuggaaccacuuggacuugacagagguuuuucaaaaaugauuuaggaggcccaccuuugaugcucuucccagcagaaaguugcaaguuaauagauuuaauguccacucuugagaagaaaauaaagucuaaacuuaaggucuuaucaucucguuuuucccuuuugagaucagauaguauacuauauauuugugacuuuucugaguggaguuuggguuauuuugauuccacaaugcaauuucucucauuuugaacauuugcaugauuuuagacauuuugccuuuaaaagggcaggcaacaggcccuuuuacguuucucaucagauuuuucucuacauccuguuuuaagugugauuagaucaguugaugagucacaugauguuuuuugcugcuucaaugacagaaauagagauucaaaauaaccacacagaggaguaucccagacacguugcucaaaaacaugcuuuccuacgguuugagugcuuuauaugagagccaucagaggacugugugugagggcgaugucuacagaaugcaggcaggagcugcuggcuuugaaccggcugaaugugcaaugcagacaucucaacacuccacgucuuucaaagcucuuccucacacuccacugcaauuuugguuccaaagaaaggugaggagcagaacuuagaagauaaaggaccccuuuuucuggacugugcacuaguuugauugaugaagacgucguccuaaguuuagaagucagcucaccugcaaagcugguacuaaccggcacaugcuguccugggcacuguucugcugggaguuacugaaguagaaagauuuuuaaauacaagaaaauauuucucaaggaaauguaauuacaacacuauaaauacuugcuauuuuguggaacacacgcacacucgcacuucaguuugaagggggaaaaaaaaaaaccagucagcuacugagucuucaaaucgauguguuccuagaaaccaaggauauagaaaaguuacucucccccugccccuucccuccagaagauccccaaauggggaacaaguaagagagcagagagcuguuaacauuucacacuucuuauucugaaaauauaagugaauaaauuuugagaguuacgauauguaaugauuauuccaaccaggagagagauccagagggcugggagugagcacuccugagcuggccccgcugcgacgcauccuggcgucuggagaacucagcccaacucugucacuacccugggagcucccaggccuccccauccugggccccccacccccugcaccucccaagguuauuuauugggaagacucagagagugaaguauaaagugcuuuuacuauuguaaagaagcuuuauuuggccccaucugauacauccuaagccaauauuaaauguuucaguuucuuagggaaucggcuauccaggacauuuccaagccaaacuaccagcuaaugcuaaaaaucaaggcaaaguaaaaacaaaggaagaguaacuuuggcacaagacaaacccgaugcaggcagucaugggggaugacuguuuuuuacccagaaaugcaaacaaguggccuucugugccccauuuaaagaaucccaaacgggagaguuuccugccaaugugcaaauccgucaauacucccugagccauguggccggcagguccaauccuaccgugacuuuccaagcgcaagccucgucuaguucuuuuugcucaguuguugucucacugacgcccuuugccacugagaucccuguaagucacuacagaacaaauggcaacugcacauuuaggaugacgucccuugugcuacucaaacaggccaccaaaggaggagcucuagaaaacccuuacuauuuccuaugcuuugagcugcccaaaccuauuauuucucagcaucuaaaugaaaaacuacuucauggccuuguauuuuuagauuguauucauccacaagcaaucacucaguuuuggagaaagucacaccuggucuuucccuggucuuugacaugagaaucucacaggcaugguaacuuucuaaaaugcagcugucagcugaaugcccuacaaugaaaaauaaauguuuugggggaauguuucuuuggucacaaaagucaaaaaguugccccaaugacucugaaaagugggaaggagaaaggucacccucccugguuugaucucucaugucuagcuggaugaugggacucgauuagaagaaacgcaggagaauaugccaguucucaguuuugccucaaaguuguuaggcugugacuuaagcagcccaagugaagaaaauguacgaagaaggaucacgugcuuuaaggugaaagguuugaacaaguccugccaaaucagcuccauugugguggccugaguguggcauugcuuccuguguucucagaaacucuaaccaaauauuauggcccacugaucuugaucacugaaggaaucucuggaguuguauuuccucaucucauaaugaggaggcccuugcugauccuuccuggauuuagagggaaaggauuuuuuuuuuuuuugagauggaguuuugcucuugucacccaggcuggagugcgauggcgcgaucucggcucacuacaaccucugccucccaggaucaagcaaauucuccugccucagccuccugaguagcugggauuacagguaugugcuaccacccccagcuaauuuuuauguuuuuaguagagacaggguuuugccauguuggccaggcuggucucaaacuccugaccuuaagugauccacccuccuuggccucccaaaguguugggauuacaggcaugagccaccaugcccggccugcuuucucaguuuggaucuuuaagcuccaaccccagaagcaugaaagucacacauguuaaaaaauacuguuuaauuuucuaguaauguccuuuaaaaaaagcugauacauugagauuuuuuuuuaaucuucucagaucugccucugaaaccacugcaaagcagcuaugcaacuuaauuuuucaguacucauauauguauuaauggaggaaaagccacucugaggaagcacgccaaggacauguccccacgugggcacaccccaucagcacuggguacccaggaaugugaaugcaacccuggcauguucacagcuaacauuaugcccuugcauucuuuuuugcugugaggaacaauaugaucacacagcacugaaaacgguagacacaaagggccugccuuuuucuuucucauuuuugccuuuccagcuugcacuucuauuccuacuccagugacccauuuauuccccaguuacccauaaugaaaaauaguucugucauuuacugagccuuacauucaaaugcaaaugacggacuuuauaaaacugcugccaauaagguacaauguucauugauacaauacguuucaacugcagguauguugagcacacaagcaaucaccguauuguauuagagacauuuuauugaaaaugcgaaaauaggaaauguauuauagccuaaaauaaauuacauaacauauacagcauauauuuauaucuuuaaaauauuuuuuuuuuuagguucuuucagucuaggaauucugacuaaaucaauuuagugaaccgugucuauaauuuuuuuaaaggaaaaaaccugcuuuccaaaacuuagaaaaauauacugcacugcauggauuucgaaugcguuauuucagggaggaccacauagugacucugguaucguuauaaaaugucuugcuuuaucguauggugugggagggaaguaccguaguacauucucaauuaccuguaccgcagaguuaugacuaaggauagcagaaccagguaauauaucuacuucaaaaguuacccuacagcaaccuggcauuagaaugcuggaugagacuuaaagcuucaguucacuguaaaaacuaaaaugcaaaguuaggaugcuccaugugacucgcucuaaugcgaccuucaggaaaggcgagggaaaagcaagccuucaggaaaagucaugcggcagggucuggaaucuggagaugcgcuuuugugacaauuuaaaaaaguuagcucauguauauacacggugggggugagaacugacagcuugcucagaucuaggagaacgcagagugaaaugcuaucauucaaccaugucaguuugcugcccccggggcauuucaaaccaaaccuuucuacgggagauucuguccaucugucagccugcuguggucacaggucuccguuccucagugugaacggggacuccgggcugcagcgugccacccgccuccugcauguguggaguagaugguuucgaacuccguggcggaagggaaauuuaagaggccaccggggcuccaucucuuuguacggccaugugacugggaagcaaaucaaaggaagccgaguuuuaaccuguugauucuuaagagcgaugaagggggacaggagagucuguggccugcugugcagggugaccgaggcgcgauggcacagcugcaguccuuugguuccaagaggagauuguccaggggaggaggacacaacgucaaccgugaggcagcugugucuuuuggguuuucgugaggcagggguaugaagucaguuguuucguuuguuuuuacauagcaacaguaaagaccauucacuagguccccccgucagugugagcauacccaguaugcuagagaauugacacgaaaccuuuaaaucaaggccucuuucauuaccaaaacaaaacaaaaaaaagggaacaaaauacgaugggagagggaagagaugaugccgaagugucauccugacugacugucccugcagugcccauggcgucccgugccuuauucauucuccucucucauuuccacgaugucugucaccuccucugucggaggcaugucugucauggcagagucuucccccuccguggccgacucauucuccaucuucuuuuucuagaccaaagaagacucaucaguguggggcuguggauggggacacugcacagcagaaccacgagcagggagacaacaccggggucuugggggaccccucacuguaggcuuaaaccuucuuaugguugggguggcgucaccucuuuugcaucuuagcucaguguguuccuugcaguuugguugucugugugccugcugugugccuggcacugagcuaggcaggcacuucggaggacaccaugucccacugccccgccccagacaacccgcucccugcugcccuuuccaaugagggcugcgcucuccccgacuccucacagucaccuguagacugcuucuccuuccuccucccuaaagccucaagcuuggaaucucacauuaucaaaauauuccaccuuguacagcauccgucagucaccucugggacagcuccaggcuugccgucauucucucccacuuacugccuguccuaguuccuggucacuucccugccauguugccuguucuuacaauaaauggccucucagggaucagguucucagccccagccccaccucagccacugcugggucacugcagaccuugccauuaucgacacaccaacaggccaaggcaaggacauuguccucugucugccaaccccgcuggucccccauccacggaucccaccaacccuucauuguggccaccuuuucgauguccugucuccccucuuuccucagcuuacaugacaugcucaguaaugaccaucauuucccuacccugcuuuucuuucauuauauuugccaggcaaagccccagcugugcugagguucagaucucuaccaucucagcccacaccccucagcugccauggcuggggaagcccaaccgcaggggacagccaguguccugagaugcacgucacgcaccgugagcaggcucucugaguggccuggccgucacucugcugccccggccuguucacucugcuacucucuugaccaacuguuuccccacccauguguccucguucuuccacccucauauaccucccuuuucucagacaaugauguggcuuccuacuucacugagaaaaacaaaagugaucagaagggcccuugcgcaagcucucggacugcaucucugcuccgcccaugaccagagaggcugcccgagcuccugucuuggacugcccaguccuugugugcacagccacauugguaucacuguccccucucccaucggcagcaucgcaugucugcgggucauuccccaaagcaagccauaggcugaauuucgccccaucuacgcuggcuuucugaaauccauguccacaccucucuccccuuuggcgcaaaacucuucaaagggacugucuguacuugcugccuucagcuuuuccccuuuuuucuuaccccacucccauuaggcuuccagccacccuaagccacgagacugggcagugucaccaaggaucccccacugacgaacgccaccauccaaccuggucaguggcugcucagguucuccugcacccaggaggaugcacccgggaggaggcucccggcgcggcugucucaccugcuuccgguagacauagcacgcagcgauggcgaccaugguggauucucccacaaagcccgccaggagggagcccacgcccagggucgcaccgugcacccugcagaugagaacacaaaggcaauuugucuguuaaggccaagucaaggcacaaccgucgaugccaaaacccaggaaaguaaguguagccucgagacggcugagaccagcggcguucuccaucugcuggcuucguaagggccgcagcuaauaaccuaaugugugaggggaaccaggaacucggggcugggccaccucccucccacagcacauggaucccacagcccuucccacccuccccaggacgcugggagcucccugagcgcagggaccauguccuucucuucugguuuucauguccagcauacguucaagcccgugcagggccggccaugcccugacaggagcucaguggcuauuauucgugucugggccugauuucaaaagcacuuuucuaaaauggaucccaagagccuccaccuggugccugggcagacacacaaaacaucauucugaauuuccgauucuagacgugccuggggauuuccccugaaaauguagcuguuaaaccucuggacacaguauugaaguggcagaaggacccacagccccaaacucccugacaacauaccccagguaggguaggaccacgaggcuggcgaugaggacgaugauccgcagcacagagcugggggcaaggacgaagguuuucuucagugucaucagccacccggugagaugcgcccucacugugacuguugggaggagcaaaggacucgucagccgugcccgccauccacuccccauccugcugccucuggaccagggcagcacauccgagagccaggggcugccuaggacccuggccuugcuguugagccgcuggccaccucaucuuccugccaggguuccccaucccugcuccugagccuaggcccgccucggcuccccgccuccucacagcccuuuggaucuaaauggcugggaccaggcaggcuccuuucuccacugggacagcaucuuccaggcagccuagcugcucuuguccaguccuguccccacacuuggccagccucgcccucugaucaucuaccucuagaagagaacacucagagaaaaguggcacucuagugugaugcugcgugagcagaaaagcuggcaucagaagccaucuucccugccugcggucagagguguggggaccaagcagugggguaggaggaggaagcugcucguccccacuucccucuguucuuucccuggacugguccugaccacuuccaccgaggucacuucccuuucucccuccuaauggugugggcccucguuggugugcugccauuucaccaagggcugcauggccugcccaugccugccucuucacuggaucucugagcugcaggagggccauggguggacagcggggaacuguggagagcacggggcuugcccuugucaguaggaaggcccugagcaucuagauuccaucugaaacuggaaaggcuugaggacgcgcagggcagggccugggccuugaagagagggccuguuaaccucccuguggacagcaccaggcaagggcucuuggaggaggaagugcucauuccugggauaaaaauuccuuuccaggauaugcugguuuggaaggaagucuuugccgucuucuuggucuaacaguguguccugccuuccucuggguggaagccuuauauuaauacuaacgaggcuaauuuucuucucuuaggcaggcagacagacccacugagguuuuugaccaaaggagagagucaggaucccaggcauaugcuaaacugguuggcccaaauccaacagauugcaaagaguggcagggccuggcagcugucuggaagcccuucaucuuacagacaaggaaguggugucaaauggacaguaaaggugaaucacauacucagcuauagccugcucccagcuggggcacuccaggccccuccucuggucacuacuguagaaauuaacugcaugugucucaaucugcgagugcagcugcuucuagaugguggcaccuuccagagcuugguucgcccugugucuacccaacaaguacagaugccaucccggugcugugaucuuccagccauuucuccauuucugucacagcccagaaagugacgccgcaaggccuuagagcaagggccguuccaucagcccuggccuaccuggggcuccauggcuccuuucuuuuucuuuuuguuuugagacggaguuucacucuuauugcagaggcuggagugcaguggugcaaucucgacucacugcaaucucugccuccuggguucaagcgauucuccugccuuagccuccugaguagcugggauuacaggcaugcgccaccacgccuggcuaauuuuuuguauuuaguagagacgggguuucaccauguuggugaggcuggucucgaacuccugaccucagaugauccaccugccucggacuaccaaagugcuggaauuacaggcauaagccacugcgcccggcccauggcuccuuucuuaacauuguggcuuuguagauucuggcuuuccaguuuaaugauuuagguggaucuuuuggggaaaccgauuuuugacuaggugacacaccugguacagaauuuaaaagauacaaaagggaauagaauacaaaggucuucuucccaguggugacuucccaggcccuuguccugcuucccacaggcaaccacuguuagcagcuuggugaguuacuuauacaaaaagaauguagcuaugcaagcaguuagcacauccauaugacgauacagacauacacgugcuacauauuugcuauggaaaugguuguauacuaaucaaccauucugcaaccugcuuuucugauuuaaucuagaacaaccucauucuuguguauaguacaccucacaccacuauauuggcuugguauaauaacuuuccaacuggcuuuugucucagccaugggcaguuucuuuucugaccauccaucuggccucagguuccccuggagucuuccuuucuccagcaguccuucucugucuuuguauaucuccaggcuuuagcaauacgcucacucuauuuuucuuuuuuugauuucacuuuuuaaauuaaaguauuguaaaacuggcuuuuuggugcacaguuuugagaauuucaguacaugaacacauuuguguucccaccaccacaaucaagacagagggccguuuuauuguccccaaagcuccacaugcuauccuuucaggucuacuuccuuuuuacuguuuuuguaaucacugcacuuuuaaaaacaaguuguacgccaggugcaguggcucacgccuguaaucccagcacuuugccgaggaggagcacuugaggccaggaguucaagaccagccuggacaacauggugaaaccccgucucuacuaaaaauacaaaaauuaguuggguaugguggugggugccuguagucccagcuacuugggaggcugaacaggagaagugcuugaacccgggaggcagagguugcagugagccgacauugugcuacugcauuccagccugggugacggaaugaaacucugucuccaauaaauaaauaaauaaauaaauaaaauaaaaaguuauacuguuugauucauuucuugaacuuuuaaccuacuggcuaauguuuuugcaucuuucuaagccacagugaaauuuuacauuuguguuggugacauaauugcaaacauuuccaaagaaagauuuaauuaggcaugaggauaaacaggaaugcuuccuucauucuguuuuucuuuaccuggaacugggaagaaggagaagauccgcaaaggaacaacacagaguucugcaaaggcaaaguccacuccgaugaugucuaucaagauuuucucagacacguuggguguccaaaacaucacgaaacagagcuggggagaaagacaucaaacaggguugugaggaaaaaguguaagcaggugaaaugagcagaucagguguggcacaauccuuggagaguuacgaaagagggacaaccggccugacuggguggugggcaugcuggucccagaucugccaccugcuugcuugacucucuucugaccacagaggcccugguccauuagccaugucuguacccaggggacccccacggcagagcagauguggcuccuccaagagugggucauuuauuucugagugggugagcagacccguucagaaccagugugcuuuggggcaaggguuaaggagagugccaaacagcucagccaguuccacguggacauguuuauucauauaauuuuuacagcuuuaacaagcaauaaaaaaagaccugaaaguacuuggauguguacagaaccacgcagaaucagcacacauaaugaaaagggaaauauuaguauuuagaguaaggaucagccuaugaaccuuucaaagucuaguuaagagaauaaaagaugagacagcaacagaauguggaacucuggaaagcagaugggcagaugguaaacugauguaacagacacaggaaaagggaaucuugaacccgauggggaaaguggagcucucuccccaccucccuuccccacagaucagaaagugcggcacagguccuuccagagacagggugaaggcaggguccagagcaggauggcuggaagucaaguuaguaagcaauccauccacagcuccccuugcgcagcuggugacuacaucuccccgaauuugacaggaaacaggagguuagucucuggaugagguaaaacagagggguaccuggcauggcccagggcagaguuacuacagguugaguaacccuuaucugaaaugcuugggaccaaaaguguuuuagauucugaauuuuucagauuuuagaauuuuugcauuauacuuacagguuacacaucccuaaucccaaaauacaaaguccagaaugcucugauaaacauuuacuuugagagucaugucagcgcucaaaaguuucagauuuuggagcauuuuggauuuucgauuuuuggaugaggcauacucaaucuguacauggaaaacgggggaauuaagagaaggaugacauuugcauguucgggcuucuuuccucuucuacgcucccagaacaugggaaacugguugaguccuucccagguaggugacuggaaauggucucugaggaaucugaccagcccaagagaaaagacguaaaguuccugaaaauuagagucucccaaugaagcagccgcacuugagcagccaucagugaggcccucgcaggugagaaaccccauccugguguuuacagcuuccaaccaacuacuagucuccagauaagguaaaaugggguggggugggggguaccugguugagggcagaguuacuacaacuaguaacuagugccccacuuaccaaaaugagcaggcaaccaggaaaccagacuuugacaaaggccuccaaugugaggaggucaaaacuauggaaaaaacuacaacuuaagaggaaacaaagauaauacagaaagagagaagggaaaaaaaaaacuuuucuccacugauauccccagagaaaugggagaagacacugcacccaugaaacaagaacagaaggagaauguuauaaaaaagacauucacgccagacgcuuuggcucauggcuguaaucccagcaguuugggaggcugaggcgggcggaugaccugaugucaggaguucgagaccagccuggccaacauggagaaaccccguuucuacuaaaaauacaaaauuaaccgggcaugguggugcaucucuguaaucucagcuacuugggaggcugaggcaggagaaucgcuugaacccgggagacggagguuguggugagcugagauggugccacugcacuccaugcacuccagccugggcaacaaaagcgaaacuccauccucccaacaccaccccccccccaaaaaaaaaagacauagaaaaagauaaaagcagaaaggaaaauucacaaguuagcaguaagauaaguuuagggaagccuaccacagagacagagcagaaggaugaaggcaugcaaaugaagcacaggagaagagaguuaaagaaacaaaguccaacacccaaauaauaggaguucuggaaagaggggacagcggacgucucagacugaaagauaccaguuucaggacugaaagggcccauccgggggagguggugcagugcaugggaaaagccccaucagggcacgucacugaacacaacuggggacacagcuuccuaugagcuucuggccucaggcuucucaauagcacugaaagcuagaagacaaggagcaauaaguuuugaaggcggaugauuucuacccuagaacucuaaaccaaacuaucacucaaguguguuuaaaagaaaaauauuuucaauauucagggccucaaaaguuuuaccucucaugcacacuuuuucaagaagcuauuggugacgguugcuuugccaaggcaagugagccauggaguggaaaagagcaaggcaugggugaagcacaagacaaaagccagggaaaucucugggguggaggugaaggcugcgauaggcccacaggucagcugaucuucccuggagcagggagaaaaaggcuccgagagaugcuaacuaccuaaugugcuugaauacuugaaaagcgauuuacaccacgaagggaaaaugugggaauaacuuagugugaaauacacagaaggcuaagaaagaugauaauugacaauuauuaaguccaggaaaaauuaaaguuguuugagaaaggaagggaaucagggcucagcgucagaguuuaucguagucacaauccaucaagaguugggggugccucucggaguaggaaagggacaggguggaagugagcagcacugaagaggugggcuggggacauggcuacugugaguuacaauccuuacagagcugacuuggaaaacuuggugcuaacuuuaaaaaccugaauuuuaaaauccaacaacauaacuuuggaagauccuguuaaaaacuugacaguuucaucaaauauuuaucuccuuuucuuaaaaugcaagugauucuucucuacaauaaaacugaauacauucuaaaaugaauuaagaacagaacacuaaaauuuuagaauauaacauucuuuuaggcucugaguacacuaaguuucauggaauuagccaagcucuauuuacuaugucauguugaaauauuaaaaaaaaaauacacuggagaucuauuauaaauauguuuugcuuuguaagugcaauagagccauuccccuacguauuuucugcaucuggcaaaguauauuccacugguuuucaaaaauggcagagguacuaucucauuuaauccuacugcuugaugacaguacucacaccccaucuuugacaugaaggaaaaaauacuuccuuagaucuagcaacuuggagcucagggacuuuauuaccugaaugcccuggacaaguggcccugucaucuuuucccacugcaaagcuacuagccuacaagggugagacaucguacacagucauagcccugguaugguggcaacuucacauuacaauucaaaacaacacucagcauggaguuggaacacuauuucccuguccauaucccauccccacaaauacauggaucaucccugcuuccagcuuugcuuuauauugggcccccaauaugucccauagcaguaaaacuguaaagaauugagcuaagggaugacugccuuacagucugggcuggcucugugccuuagaaccuacaggaaguaagccauucuguguuuaucuaaggguuagagagagaccuaggccacauacuacuaaaaaccuuaagcuuccagggaaccauuagcaugcuuuacugauuuugcagccagcaaugaucugaaugugagauaaugccucacacaaauguugcaauucucuaggcuuugcaaaaucauuguaaaguggcucuucaguuacaagaaccaaggaaaaaggaggguguaauugcacgucagagagaaagauggcggaaaugggccucuguggcagaugagccagguaaucccugcucugggauccacaaucgggucauguucacccagaggcguuuucccaucuuguagaagaucagaaaaccuuuggagcaguggguggggggucagcuugaggacaugauagugagugugcccacaucacuugacacauugacaucaguaucagccaagcuguguaggugagcacaguuaugguaccuugaacacaaccacgaaguuaaguaagguuugauggauuuccaguaggagcuuccugagaugguggcucaauaguccauuucuaaaauuccacgguaugauccaaccuggcaccacucagucacucuguuuuuuaucuuggucugugcugagcacacccuaaaugccccuuaucauggccaugugccaacagaggugcuucuucaguuuucaaccacacacaccuacagcccagacugggucuucgcgggguaucggaacuggaagcgguuagucugaucugggguuugaacaaucacagguaacuaaaggaaaggaacgccacauuuaucaaagucuccuuuuucuuccucccugaagucucugaagcucuugcuaugcuuccaguaggaaaauggcgcuucacuuuucagcaaguuuuucaacgaguggauauuucuugcguauauaacuuagguauacauauaacuuagaaaggaauacauuuaacuuauaaguggauauggugagcugggcgugguggcucaugccuguaauccagcacuuugggaggccaaggugggaggaucacaaggucaggagaucgagaccauccuggcuaacacggugaaaccccaucucuacuaaaaauacaaaaaauuagccaggcaugguggcaggcgccuguagucccagcuacucgugaggcugaggcaggagaauggcgugaaucggggaggcggagcuugcagugagcugagaucaugccacugcacuccagccugggcgacagagcgagacuccgucucaaaaaaaaaaaaaaaaaaaaaaaaaguggguaugguauguauuaaaagcuacaauaccuaucugcaggugagguuucccuagcuuccccuaggcaaaguacugagcccuagcauaauaaucagacuacauuuaacaaguccauuugaaaaaacaggacgcuuuagaaguucccuugacaaagaguaucaggaacagugucauuuuaaugaguucacccagaguagucucaacucagaacaugccucccaguugaccaugaugugcuguguuccucaaauauuugcagagccuaaugacauugacuuuuccaaaccagcacacaccccuaauaaucucccaccaaugaacaagagucguuccucugagcagcugcagagguggguuuucugcugucgaguuugcugucaauauucugucaggacacagccuucaaaaucgaauaguccacccagugcccagaucuugguuuuucuauuuauucuucaauaaaaggaaccaggauuccuuagagaaaugacucauucuaggaccaaggcagagaauaugcaagaugauucgcuuggagcaucuaugguacaagaaggaaggcugugccccaaaauaaaagaaugggaacacggcaaagggacacagaagccaggcagaaggagcuuccgaauggccaaagcaaaaacaauuugggcaacaaaauaaguacaguauugaauuauaucccaaaauagcaaauaaauauccaugagucccuagggauagaaauuuaaaaauggcagagaagggacaaauguccugcacagaacucuaaauaauucauuagcugcuccccucuaagguggguggagcagaccuuccugcuccuucugaggaacuuccuucugaagagcacaguggggagaaaggaaacccguccugacagcagaggaacacggcagacaugaccccagccaugcaaucaaggucaacauccacgcacauacccucgauaagaugugaugacaguggcacuuugucucuguggucuuccuccccaaaaucccuaagcccagucuuaaucauaagacaaaccccagacaaacgcacauugagggaccuucuaccaaauacccgaccagaacuccucaaaaccguugaggccuuaaaaacaaggaaagucuaaaacucucagagaccagaggaggcuacggaagcaugaugacuagacauaauguggugucuuggaugagauccuggaacagaaagagcucacgagaaaacaaaccagugaaauccuaaugcaccauggaguuuaguucacagucacacaccagggcuggcuccucgguuguaacaugcgcgcugcaguaaaguaaugugagugagggugaggagucuaugggaacucugcaccaucuccacaauguuucuguaaaucagaaguuauucuuuuuuuaaaaaaaaaaaaguuaaaaaaagaagggcugggcaugguggaugccuguaauuccagcacuuugggaagucaaggugggaggacugcuugaggccaggaguucgagaccagccuggacaacacaagaccccaucucuacaaacaaaauguagcauacccuuaaucccagcuacuugggaggcuaaggcgggaggacugcuugagccugggagguccaggcugcagugagccaagauugcgccacuguacuccagccugagugacaagauccugucuccaaaaauuaaaggagaaaaaaagaaggaagaagaagaugacgauucauaauucacuucucuguuauuugacagacugugauucauuuucugagaccagccauugaccgugaagugucugcuuugaacucugaggugcuuacaugcagcccaagacacauucauuucuaguagaguguaguccccucucagucucuuauucugcaugaucaagggguagacuuccucauuucuugaaucauauuaaccucuuuagaaacuaaccaccacugggcugcagcuuuuuuauucacaaacuuaaaauacaguuuccagucagcaugugagccagucaguuuccagggaugauuugguugagccuaacguugaugaugacucagaucaaugaguaauuuaacauuuuuguccaggagugguggcucacaccuguaaucccagcacucugggaggccgagguggauggaucacuugaggucaagaguucgagaccagccuaaccaacauggagaagccccaucucuacuaaaaauacaaaaguagccaggcgugguggugugcaccuguaauccuggcuacucgggaggcagaggcaggagaaucacuugaacccaggaggcagagguugcagugagcugagauugugccauuguacuccagccugguuaacaagagugaaacucugucucaaaacaacaacaacaacaaaaucacauaaaaaaccccaaaacauuuucaagcaggccuuaacugugugucgucauucuguguuggggcaguacuugacuuuuauuucuaaaucuguguaucaaugggcuaagucaugaaaaacuuugaccacauauuaaggucccccaauaggaucagaaggaucagugcagugaugaaggaaaucgccagcuuuacagacagaagaccccugggucuuacuaugcuacaguccgaaacagagcuugguuuucugagcuaagaaccacggaagggggauuugaaccaagaccugcuuccucacuugcagagugggccaugcaugguccccgagcuccccuggggacaaucugagucucuuuucaaagcauuuggaaccgggauaugaagcagccaguugucuucaucagcacgugaacucagaaacaugccaaccaggccacggugggacggccguuucuguguguguccucggagaccaccacccuaugagggcacugccaagugcucgggucuuauuuaauuuccauaagcucuuaaccacauuuugaggaacucacaaaggcuuccccauugcccugaauaaccagaauuagcaguacaugagacucuuaucccugcaguuagaaaaagucaaacauaugcagcuguuuugaauaaaaaucgcuggcccuggacaucauuuuuauuuggcgcuuuugcuugaaaaaaagguucaauauaccuuuuuaauuggguugaaguccccaccgggcaagccagugguuagcccucggcaacacaaagugugaagaggagguuagggcuuggcacuggcgccugacugccgggcuggcacuccaacccagcugugucucugucuguugucucuaggugaguucccugagcacuccagccucagcucucuucuuucaaacggggauggugucucccucacagggaugcuguguggacugggcugcccagagugcuggucugccaacuguggacugguccacacugagauaagcaguugacuccauaaaguaaaucgaugccugccuuccuuaagaaagucuugccauccaaacaacgccagcugaacuggacaucauaccuggugaccaaguugauucacauuccggugcuagcuucuuaucccaucacggauggccagaccucuggcacucaucugcaaaccccgagccugcgagcacugcaguuugcauaaaccgcuuuuccagcaccggcacaccaaaugugauccacggaugucaccugugaguauuccagaagguuuccugggaccguauucuaacaaaacgcuagcaggggaguccucuggagguggugagauuaggacugauugaauuuuccucuuuguauuuuuccguggcuuccacaaagaacauguauucuuuuuaucagaaaaacauuuuuuuuucuuuugagaugcagccuugcucuguugccaggcuggagugcaguggcacgaucuuggcucacugcaaucuccgcuucccggguucaagagauucucccgccucagccuccugaguagcugggacuacagguacgugccaccacgcccagcuaauuuuuguauuuuuaguagagaugggguuucaccaugcagaaaaacauuuuuaaauaaaacagaccccuguagaugucuucacggauaucaucaaacuucaaaugugauugggacaggaaugugagaagucuugucuugggggaggggcagcuuucagaaaguggcugucagcuugguuuucacagccagcgucuugggaaaccaugucccacaucaccucaugaggaaggcacacugauuugauauacuuagggguggaggggccagcacagggcaggacacuauuagauaacacuaugcugucuugcucgacuuuccagagagagcugacgcagccauaaggaaugcuguuuggccuuuuguuucuuagugccagacugcaccagcugcaugcacguaaggaaggaggacaguucacgaaggguuucacaggucauggucacgacucuggcuuucacucggagggaugugagagccauggcagguuguggguggaggagaggcagggcaagcaggggaagggcugaaucaaggauccucgucacggcuacugugaccauccaggugagagcuggcaaggguuuggacugguggggaagggagaagaaccaauguacaauaugaaagacaggagcugggcaagagugacgggagggaggcuggaggcguggcugaccuguccucacggugguuuccugcucacuugugagcugucccaugagcuggauggggccucucuaggaguguuccuaauguuugcaugacucaguacaccccaaauggaaugacauggaauuccaucaggacacacucucagauucccaauuuagaaggaaaaacaaugccauuucaccagggugaauugccgaaagcaggcaauaugugaaaguagcaaaugacucccauuucuggggaacggugcuuaaggugugcauaccuguagcaacugccagaaggaaugggcucuugggauugacugaccuguccucagaagggugcaaagccacguguucccgauacagcacgugaggggaugaugggagagagggaugcuuccacauccgcgucuugcucagugggagaaaguagggaaccucacaggagggaugaugaugaugaccaucacaggcaguggggacacgggaaggaguuuuuacuuaaggucaggcuagaaaaauucuaguuggcuaacauagggguagcaaacaauagaugaaaaaugacaucuauuacugagagaaacagagcuugguuuucuaagcuaaggagcuuggaaaagcauauuacaaaguguuuauguagaauuugauaccuuccaucuggcuuguugauaaucauaauaauuauuauaaaucuugaauauuuucauaaaggaguugaagcaaucaucaacuguuacagcauauucacgguaaaaaaucaacacuuucagauauaguuuuauaaccagcuuuuugaagaauaugaaaacuaaaucaucccuucuaucaucuagguuuaaugaaauugccaaaugcacacacuacaugaaagcaaagugucuuucagaucccaacgacuuacuaaucuaguaaugccgcguugguggaaagacaugacauaccucaaacagcagggggcgccaugcgccaagcccgcagaggguuguccaacuccuauuccuuuucucugcagcuuuaauccuuuccugguuuuucucacaggaucugaggacuauugauaaaguuccacacuccagcuucuguuuagccuuuccuucuccuugacuauuaauagucaacuuggaacuuguuugggacugggggaaggggacaugaggagugacuguuuaguggguauaggguuucaguuuugcaaucccguuaugggcagauggugaugacaagcagcaaugugaauggacuucacugucccuuuaaaaauggugagguugguacacuguauguguauuuuucuacaauuaaaaaaaucuuaaaaacauuuggaaccugcuuauaacagcacacucuguucauuugcucguuguuuaaaugacacaugugcaucugcccuggugucuuauuaugagggcuuagguagaguuuuagggacuagccuuuauugucuucaucuuaccuaaauucccccaaaacaaaccaaucaaccacucaaaucugcuauacgugcuggauuugagcaaaugcuggauuccugaagcuuccagagagaagugcggagggaaggcagagggaaggaagucacucacuaugcgccaacagcgcuccauaugugauuccauuucaucuucauacacuccccagauagaugccuuauuagcugaggaggacacagggccuacagggacugugugacuugccccaggucaccggcugguaaagaggcaggggccagaguucaauccaggccuuggggccgcagaagcccugcuuucucccuguuuccaagaugcccuaagcugcuaaacuguucaggcccaaggguacugugaggggcaccaaaugagaaaguguugaauuccauuaauucaccuuugguucuuuucucaucccccauacacaagagaggcauuuucuuccaguggagccgggaacaaugggguggcagucuccaccucacggcgugggggugggguggcccagcauuaacaaagccucaaacaggccgucuuuguuccagacaaagggucagcauggugccaccgcuggaauauggccuuuagcauccgcccaagagggcugagugacagcuauggcuugggggaagguugccacaggaaggugagacagggucauucucaugaacggaauuucuaacauggaacgcagggccagccgggcaaaguccugucggauggcaaguuuuacuacaagcucagauucugcuaccuucuagcacaugacagaaggacucagaacugacacgccuuacugagacgcagcugcaaauaauggugugcaaccaagacgguggaguccuuggggugccggcccaagcagcggcaagacaggagcagcacaagcucaccagggcgcggaaggcccucuccacuacacauggacaguagguagaaaugggaguggaggagcccauccugaccugcaaggugcguccaaaacuggcccugaaaugaugggaaaaaagccuuuuuuuucuuuuuuuuugagacagucuugcucugucagccaggcuggagugcaguggcaugaucuuggcucacugcaaccuccgccuuccgggcucaaguaauucuccugccucagccucccgaguggcugggauuacaggcacgugccaccaugccuggcuaauuuuguauuuuuaguagagacgggguuucuccauguugggcaggcuggucucgaacucccgaccucaggugauucgcccaccuuggccucccaaagugcugggauuacagcugugugccaccacgccccacuacuuuuuuuuuauuuaguagagacgggguuucaccauguuggccagguuggucucgaacuccugaccucagguaaucugcccgccucggccucccaaagugcugggauuacagguugugccaccgcgccugaccaaaaaaaaaaaaaaagucuucuaauugaggaaauugaggacgcgagaggcagugccagacaggaccccaaaccucugacuucuaggaggcguuuccuuucccuguaccuccgccucuaccugccagcugugccuuccaagaagagguggucagagccuggguuccacugggaugaggggcacuguaaauacugaaaccgucugugaccugccaccuugcaauggugggguaggcucuggcggggagaaaagggguggagccagaauucugguuucuagcuuugggaauggcacuucccagcaagugcacagacagggguuagcucaguguguccaagagaaagacccggacagaguggauucuucaggcugcuuccuucucugaugccgcugcucuuuguuuucuuucccuccugaguugcucucucugcggccugaaguucugaagcuuuaggaucaagacauuuuaaauacuaaacaccuuuauccucaguuccgcaggguugccugcucugggauggcaccuacuucccuccggcaggcagugaagcccaacagaagcagcccgcugugcugugauccaugcuggguucuacagaaacagcacgcaagguggggaccugaccaugcuggguucuacagaaacagcacacaaggaggggaccugaccaggccgcuaagccccucuccucucuggcagccuccaaccuaaucccuucucccggacaaaguuucuccccagaagcuggagcaggggggcucacagccuugccggaggggaugauccugggcugcugacaaagagaguggccaugguuucuucacauucacaggaaucagggaaaauuauuuuuuuuaaagaaauuaagggaaacagauuucaaaacuuauggaaaagaggcgaauaugaucuaauagcaccagagauucuaaaagaggcugaaaaacucucagaagacaaauucucucccaacaaccagaaaacaggccacgaggaggaaaacagaaggcaucugaaggccucaugguccccagguguggaaguggguacuggggacagcaaaacgugcauccaugccuucaccugagggcagggguuuggaagccagucucuugcaggucucccucacccagguccugggacgccccacgcagagucgaccuuuaagggcuugcagccuggaggauggggccgacguguauguggaugugcccagcguacuugccagcaagaagcgagcgccaggagugcaggagaaggaccccaaaccucugacuucuaggaggcguuuccuuucccugugccuccaccucuaucuugccagcugcgccuuccaagaagagguggccagagcccggguuccacugggaugaggggcacuguaaauacugaaacugucugugaccugccacuuugcaauggugggguaggcucuggcggggggaaaaggggcggugccugucugugccagggagagguugauaaggaagcaccugccugccaagaagcccgacggggcccucgaggccaaggcagcagccaccaaggcaaagcacagagcgaggggacacugcugcaugggaagcuggagaggcggcccaacacgggcgugaaaggccaugucguccuccgggggcagcggccaguggugaaggacuaucuggaaggcuguuggcggauggguggcuacugagagggcucauuuccugaggaucuuuaucauuuccaaaucggccauggcuaggagggagaggcgggcugaaggggcagccuggugcacacaagugucaugucuauggcagggucuauggugguaccaaacaauguguccauaagaacguaagaacccccauaagaacaaggucgggaggugaaagcccaagugcucagaguaaaagugcucagaucaagaaaaagagcuguaaaaaaugugccacgagaaagaagggaaaagggaaagagcugccaggggccggggguaccuuccaaaccccagcucucucucugccuucuccaccaaggagggucaccucaaaacuagccaggaagagcaaacccagccaagugggaucugaagaccaacacugacaagagggagaaaagcauucuguugauaaccauaaaacugugcaagguucccagcaugaacucaucugugguggaaagaaagcuuagagaaucagggagaggcugggagccucgagguuggaaauccuagaagggcccaguccuugacuggagcuuaugggucucauguuuauccugagaacagugccaagcggcuaauuuaaaaagcagguauagccuuaggcugcacuagggaaagugaugggcugacguguucugcuccacugccuaggcguuugaugauuucagcaaugcauacggccacagcugugugggacagggcaacguggggagagacgagacacacgggaggcccagggagcugcgcgagugucacgugaacaggggucaugacgggucccuaggaagcaucacgugugccccacaggacccagguuucuguggacacgcggguguucuuucucaccugaggacuucaaaauguuaacaugcuuccugggcccaggugcaacuucaaauugguccuuacuggcauuuucuacuaugugguugugucugugguucuaucagaugucuagucagaggacucaaccuauucauuccccucuuuuuguguucacugcagcuugauggagaacuggcaucucuguguuagcaagaagauggggcucugguagcaccaucugugccugggacugggaggcuguaaauagcagggggugacgggucaacuaaagagcuuccccgaggagaaaaaugguucauacaggggucacaucuguggcaggguuugucuacugaagguguguguaaaucuaccgaucaagagacuggcuuuuaaaaaaacaacaccccccaccaccaaaacccacacaaauuugaagacuauaaacuuuauauuuaucuauaagauauagauacauauauauaauucauaaaauuauuccuuggcauaaaauauaccccuagcuacuuauguauaugugcagcccucuuucccuauguuagggaccacugagugucccggugguggagcugguggcugaggagagcugucauucuuugcauauagcacaugccagguauuucacuaagcuuuuaccccuuuuaaagucuuaaaaggugagcaauucuuguugccucuguguggcaucuggggaaacugaagauggcaguuuugagugacuuuccugaagccacuuggcuagugagugguggagccuggauuugaacccaagcccuguggcuccagggcccacagcuauaagcaccaagcuauguagccaauuccagcuugaccuaaaucccucugccuccaucccucuucccucauuaaaucaacagacacauacagggcaguuagaugucaugagagccacaggcgugacagacagcccccccagcugaacccaucuccaguuucaaaggagggaacuuguaagagaucaguggugucagcuccaguucgugcacccuggcccucuggaaacuucuuuuuugguaacaaucaguucauucuucaagccacaucaguuaagagccaucuccagggaggacuacaggccacugaaaacugucuggcaccggauucauagugagcagguuucgaggcacuguuguuugccauaugugcuguuucuuggcagcgcuuugugguucuuuuagccuuguacugggcucagaagauacaaaaagaccccagaagaauuucauggcaccauuaaaacccauuuaccuuacugugcccgagcaagugggacauccgacccagagcuggggacacaguagucagccuuuaagagaaaaugaagacccuuuugagcaaagaccacagacuagcuaaaagcacuucacaagcacugcccguaggugcaggagacacccaggccugggagagggaagccagugaagucucuccugugcccagaguguuuuuugauuguuuucuuuuguuccugugucaaaugauauguuacuucauuaaacuuacaaaauggccauuuagcaugcaaucagcuguuuuagauccucaucgugcucauuucacacacugcuucauguaauuaccucuauuugguaauuuuugagguauuuugagaucauuuacaugggcuuugcugggcucccugccugcugcaccuaagugaauggccggucaucgggaguuucaggccacggggaaagugcucgugugcggagccccgugugccucacagccuccgagcuggugcugggcucggaaagccaagaggccagaggcgccacaucuuugcuuucuccacguugauggcgcaugcgugucgggagugucuggacuaagcgccccgucaggcugaugucugguuucuguacacugucuuuaagcugagacuaagaaaaccaauuuuuaaaaaaccuguagggaaucauaagguauuaaucauggaagucgaucaaugaagcccuacugagugacuucaccauuugugugggauggcaguuccugacugaccucucccuauugcuagauaugcguucuaaauuucucuucaaagaaucaguaugucaauauguucaauucuuugccuucuacuuuuaaacuuaacuuccucguaaagcaaccuuuucugauuaccugcuccacccugacucauuccgauuuccugcucugccguaaucauuuuuccccccaaaccacucacccccgucacucucuuuaaauuagccaaucggaauuaguuuagcccgugcagucuaacccuagccaauagggaaacaacacagcagcaggggccacgugcgucagggauaagaaccccuuccccucccuuguccaugugugcgcucaccauugcuccaucuguaagggcgcauccuucuauagaaguacauugccuugcugagaauuaaaaagaaaauuuuauauucgaguacuaugucuuuuguggcacugaaaccuuauaacacuaugauagcucugcuuccacagcagugaaaaccgaaagagccgggcugggcaccugccucuuugagguggaacucgggucaggcagcacucggcaggugcagggauccguggggcccaggcuuuacuuccuuaagggcucagaggggcuggugagcagugcgugucugcaggcccaggguauaaacaacgugucuucccuguugcuuucaaacucauucagguggugggccccacguggguucuuggcagaacacggguguguauugauacguucaacugaaaaaugaguaauuuuuauaauuuugugccaaaucaauuacccuuuauaagguucaagugguaaauagaagaagagaucaagauuuugaggcaaucugggggugaagaaauacaaaugaauaaaauucuagcaacuuauuguuuccugaaaauuggaaaaauauuucaguuuuugaauguuuguaguggcccagguuaguccuggacucugcaaagaccuuguugaggggcacugcauuauucaaugaauaaaaagcagaagaaaaacaagaagcaaaguaacuuaaaucuaguccugguacuucuaucaguagcuacggugucaauauccccuguccccagagaaaccuuuggcaaaaauaucauuaagcauguaaguacuggcacagguuaccuguaucaaaauggcucauguuccccauaaauauguacaccuacuagguacccacaaaaaauaaaaauuaaacuaaaaaaugcagacacagggccacacugcauaaaguacuauauuucuaagcaaauccccuacucacauggagaaucuggaaauaaaauaauagagaugucucaugaaacuaaaaggagacagaaucuaacaaaaaacaaaaacaagugaguugaauaguuagaagucugguucaucaauccauguagccuuaagugacgagaagauuccuuccuuucagaaaucauaguuguuagcuugccaggcacccaaaacaaaauaacacaaacugggugacucugagcaacagaaaauuacugccccacaguucuggagacugaaaucaaggugugagcagaggcacaugcccucugaaggugcuagggaagggucuguuccaggccuuuccuggcuucugguagcuccugggcugaggcagcaaaacuccagccuacauguggugcuuccccugugugcaugucugugcccaaauuucuuccucuaaaaaggcaccagucauaggggauuaugggcccacccuacucaccuaccagaaccucaucuuaacccuauuuccaaguaaggucacauucugagguacuggggguuaggacuuuaacauaagaagguuuggcgaauccuauucaacccauaacaauaaaauagaagguuccggguugaaugcaguuucacggucucccuuuaaccccccacugacuacaaaaagcaaggcucagaaagauccagaguaaaaaccuaacuuuuuuuuuuuuuuuuuuuuuuuuuuuuuuuuaaagaaucagauccuuaaauacaaacagccauugaccucggauacccuugcacucuauugcaugaggccacgugguuugauuggcacacugugccagcguggccaggcuuccuucucucucugccucaagugacagcaacaccucccuacccccaccacaucaagcagccuccauguguugaagccagugaaaccaguuauuuggggaccaguggauguagucugggggcccuggcacagucccaugaccucugcgucaucagaauguggguguguggggccagcccuggacagagucccauccacaccugccaucuugaaacaggucagcucgccaaaaaucaaccgguggauaaccaauuuggccaaccaacaaauugucaaauuuucugaguuuuaagaucuugucucuuuuaaacucuucuaaaguuuauagccauuuuuuacaggaaggauuggcagggucccaagggcugggagggccccagggucucuggggccuccauuuucccugucuguaaccccaccucugccauucugcuccaguuuucucugagucgucaccuccccucuuuuucugaccagucucucucccuucuccuucugaccuucacgcuacuccaccucucugacauucagucacucuccuuucccugauccuuguucucccccuucucugacuuucucugaauguggcaucccaggggugcuggguauagucguguaguucgugcacugcacaaaagugccuggcuggcucugcuugccaagauccaucuggagagaucccauuuccauugugugcuaaugguuuggggaggcuuagcagaggccaagccugugcuuugcauggauucuucucuaugucuccugaagcagagggucccccucucuuggcacuaacuccccaaaguacagcagagcagggagcuugagaagauaaacagcagauguucugaaaaugccauugugaaaucaaaauggaaacuagucaacuaaaagcauccaaagguguuaaaaacuucuguuuauuaaaauaugauuggcuauggacuucagaaacaguuuuaaaaagucauguuuuggguaaauuggcaaauuugguaaacuuagcagcccgaugggcuggcuuucaccacuuggccuggcaugcaggaauagggagguccgucacucuuuugggacauuucuuccccaccaaaaggacuguuggaagauacagcccaugccggugagugguuucuaucuuauccccacuucuagaguccaggagggcaccaugauaggccccagggguuuguaggaggcuggguuucuguaaguucagcacugcagcugccuuccccacguaagaggaaggacuguggugccugcuccucucuugugagcucacugcugccucagccuguggcuccaggagugucuaccuagagaagcacagccuuuuagggcacacucacugucacuguguucuacagccagucacaugagcgacagagaccgcagcuguccaggaaggcucagggcaaggcgaccacuggcucugacuccagcaccaguggagacaccuugcauggcgaggcugcgacgcagucuccuuugcguggcugcaacccugcacgcuuccacgugaaagcagacccucugaagcuguucuuccaaauggcuuuaugccacauauauuuuugaaaugugcuucccuucaccccaaacagcugcuugucagucagcaggcgccuugcuaaccuggguuugcacugugucugcucccucguugcuaucaaggggauuccguuucaucugacaguucuacuguuuugaagccaaucuuuuggaucaacuaaagguacccccuuucucauccucaugcccaucagaugguuuagagagaucaaucaaccuccggcuaagcaugccuaaccgcagcucugaaggacugaaagcaagaugcuaacggaaauggcgaacauuuccauuuuccuacucuacaccccucugacuucagccccucuuccacacugggcagaagacaucugcugcuuuucuuaaaacccagugaucaacaaaacugcuggauaagaguacaagggcagaaccaacuucuggaguaggacagauacucuaaauuuaaauagaaaauguguaauagggaauaaacaaacacgucauuguaacaugcugaaaugagccucuuacuaacugucagcagugacaccgcgguauuuuucacaggcaaaggcgguguugaacucaaaugucagggccuggaaagggggcuguucugagggaaggaugcauuuugauucuggacaguauacguuuuccuuugaaucacugagucauugggugucuacaggauccugggggucagcucuucucaaaagacucagggauaaagcugauuuucccaaagcagcggagugugggaaagcgugcuaacguuggccaaugcguggagggcuguggcaucaucacgcagcuccuacuguauacacagaaucaucugcugaaauaaacaccaagugugcugcucucaagcguuucaaugaccucugcuacauuaauuuccugauauuacgaaguuucaaaauucaaaaaaacaaaaacaggccaggggcaguggcucaugccucuaaucccagcauuuuaggaggccaggaauucgacaucagccugagcaacauagugagaccccuucuauacaaacaguuaaaaaaaaaaacccaaaaccaaggaaaaagaaaauagacuagaaaaucaagagccuuuuaaaagcuuuuacgauaauacagacugagcauaaaugagaagauugccauucacaagggugaaugcugucgguaccuuacugaccggugucucauaauuaaggauuaguugauuccuguguuuguuaacuuguuacugugaccuuucucagugucaagcaggaugcuaagcccuggggauaaaagaugacauugcagacccugccucaugaaguuuggggcccaagagcagcaaaagauguacaagaaugaauacaguaagagacagaauaaggugaguacucauuacagggacaguuuaauguuuaauuuagaaagaaaaaucuccggcugggcgcaguggcucaugccuguaaucccagcacuuugggaggccgaggcgggcagaucacuugaggucaggaguucgagaccagccuggccgauauagugaaaccccaucucuacuaaaaacacaaaaaucagccgggugugguggcgggugcuuguaaucccagcuacuugguaggcugaggcagaagaaucauuugaaccugggaagcagagguugcagugagccgagaucaugcgccugcacuccagccugggcgacggagugagacuuugucucaaaaaagaaaaaaaagagaaaaaucucccuuuauauuuuuuucuaugugucuuucagugaaaacuccuuuagccaagauguuggaucaauugauugaaucaucauaaggaugguguacaugagacccuuccuaagccacaaacucaaauacuaugguuuuuaaugggcaaaaaaucacuguuucaggcaugguggcaagcgccccaaucuggaggccuaagggccaauauuuguuccuacucucugggaacagugugguucagagcacagggcccuggagagcaugcccugaaggcugggcuguagccgguucuauuacuggauacuuggacaagucacuuguccggugugaaucauuuccuuuucugaaaaauuauggguuuugacuaguucaucuccaaguuccugucugacaaaggguucugaaucucuauuucuagaaggugaaaauuuacccugagaaacuucaagucacagaugguuuuuagauagaggauuagaauaauaaauaaagccucuaccugggaaauguaagcauuuucccagauuauaagucauuaucauuucaaaauaaacuugcagaauauuuuuuuuagaaguauaaauuauugccugugaacugaaagagaggugaauguccuuaagcccaauccgguaaagcucuccaucagauucaacucuagcagcggaaagauguuaaacaguaugaaagaagacagaggaggugaguuucuggaccgcagagccagcggcagccaggcguugucagcuuuauaugcagaugagguccaagucacagggccucacagcagaguuaauucaaccuuggauuuccagccauuuaacacagucuccaaaugcugaggucuuuuccuggaaaagaaaccugcucuguucugccuaaaaugcucuuaaaugguuucaaaguugcucaguguuuugcuaauguuuuagggaacuauggaaaagcuugggcaccacagagagaaaucaugcuaacaggggagcauggcugccuggggaaccggccccgcucaaacaggcauugcuaucagcaauucuucugcagugaggcagugcuggaauagguucccaacgcccccguguuccacagggacaggcuggcaaaaggggcuguguugguggugacaagggcagcugaggacacgaggucaugacucggcagugucagaggucuucugugaugggcacugcccuugugacaaucuaauuagguguuggaucaacggaucaaauacuaagcugcaggcuuucaaaauguccauuaaagguuuaaaauguacgcaggccuugaguuuaauggcccacuaacagagcucaucaagcuccacgguucuugugaugacgguaagaaggacccagccccugugcucccguuauuggcauacuccaacaccuucacggccuccgguccucuuuauuaguuauugacaaugacaacugcacacaucucgacauuucugcaaauauuucuauuguauaugcgaaaguaaguuucuaccggauuuaauaggacauguguugugacaacaauaaacaaggaaaacagaaccgaguucaaaagacucuuauuucuucuuaucgucuuuuucaucuccaucuuuauaacccaaagggcacagucuccaacggaaggcuguuuauaaacgguaaguuuuuugccacuguugauaaacgcucuaaaaaaaccuuaaauuauauaccacguccuuuggacuauaaagcauguaccuauuuuauccauguuuuuugaacauuaucaguguucgcacacauccgaauuacacacaugggcuucauaacgaaggaugcguguuguuuauuuaagguugcgcauagaaauacagacaggcuuugcugcugacacagugucacacacgcuugcucacagcuguauccucagcagacagaugggccugggaucccgcaggggcucaaugccuaugggcacgugauggccacguaaguaagcuaugucagcacaaacauaacuggaaaggaaauuuuacuggggaacacugaaguaacgcggauuaaauuuggaaaagagacaggggugguuguaaaguugacuuucgauguuuaaaaagugggcuagaaauuuuucagcaagacaaguguacuauuccaauuaaaggcaaccucuuccuuucugcagcauuugagaagucccaagaaaugccugaaguggguccuuuauuccuagacucaagggccuccuugaauaacaaucguucacauuugaagaagaaaguguauugaagagauugcuaauuaauccagcaucacauuacauuguggaaaauaagauuucccccuuuaaaauagcaacuugccccuuuacaaaaaccaaacagagagaagaggcagagagagccucuguccuuaccgugagugacagagccaugcagacgaaggugaacuucuugaugugggcugccgugacuguguugcucgugcucaccaguuuguugcugggguuauucuggggaaagaaaaccacagucaugaaugggcccggcuuauccuuggcugaacccaccgggggaucuugaagagcaucuugcuuuuguuuuaucugaugugucugaauuagagguuucaagugacaguuugccaggcggcugucauguugagugucucucgggcagcugucaggucccuguacaggaucauuaaccugagugaauucucgacucaaugcccugcagcucuuccaacucagucaccuccccucugccugggcagcccaucuugcccaguccuggggcuuuggcucugaagccugcuccugccccaugcaccccgcuccuggucccagcagacccugugccuggccaccaucggcaucucccuaaaugccauggcccugcucaguguccuccagggcuccucuccucucuaccaaauggacuauaaauuccacugggcauucaaggccuugugcaaucugacacagacucacuuuccagccaugacuucuccacuucuagcccagaugggacuuccugcucuuccccugacacaccuggugcuuuuguuccuccugccauugaauccugauuuucaaaaacaucccucuuucuaaggcccaucaucuucacugcucaucuguucccuaaagccucucugaccuuugaccuccaagcugggccccaccuccuguaaagccugaugacccuggagcucucugagggcaggcaucauguccugucaugcguccaaccccggugaggcugugcuugcugagauaacgcccugcgugucuccccuugaaucacucagcacaacaucugcguagaaaagaugccccaagaacaccugcugcacugcauuucaagcaggacugcagggggcucagaugucacccagcuugacagucaaaggcgccugccgaggcucuccagcugcacugcuaagcgugcuccucaccccugcaaaacgagggccuggcccccagaccacgaaaacuggcagagaaaaauaacccugaccucauuauggacccaauuagucccagagucgacucacaaaaacaaacccugaacaccuggcuccgcauccagccgcgugaaacacacacccacagcuacuacaggauccaccuggaaaagagcuugugcuuuuccuuuacugggaggcuaaggucauuucucaaaucccuuccaccaccagcaccaaccucugaaugaguauacguuuucuuaauucuagucucuaaaacauaucuguuuucuagacugcucuauggcaaaguacaagucccagugguuggagaccuccgucuccauucacccuggaucuguuagaggacugcauucuguaagagcacugcccugcuggguacgaugaggaggccuauguuggaaagaauuagggaaccucagcaaaacacacauacugccauggggacagcaacguaccacagcuccuucaggggcacugugauuugcaaaauggcacauauucacaugaagaucgugaaaauaaaccagcagguauuguuagauuagcacuggaguuucaguuuguuugcccaauuggcucagaagcauccuuuuuugcagguaacugaacauuagagagcaucugcacuaguggaaaccuuucucagcucaugcuuagcuagaacucccggaagguaugugagaaauuuuaaaucucugauucuggagcccacaaagaagcucaggauuucaacugucaaugcagcaaauucuggaaguccauauggaggugccuaagauuuuggugaauagacggcauucauauaaauggcugguguagcucgcuggaaugcuuggaaacaaugggcgagguuuuaaaaggauuuggaguaacucgaaguucuggugagagguaugcucguuaaaggaauuuuuuuauagcuccuagccucugugaucaagaauaaaacaauguuuuucuuggaugcucuuacugaaaccauacaguguuguauuguuaaauuuuaugauuucaagguggccaaaaauaaucucagaugagaccuaagcagccaggagguucuaacacuucagcacuugcccuucucaucaguuucaucagaugaucaccuuauuaaucaggagcuagaacugaaauuuagcaagaagacauacauucaugcugguuuucuaggauuuacuucuauacacacgugccuugaaaugaaaacaaugauuucuaucuauagacugaauuaaacccacucaaacacagugucugcucucuccagcaagugacucaugccuucugaguccacucucaaaggccugugaagcaggaaccaaaagcauuucuuaggagaugcucugcauccugaugcugcaacugaauauucccaguagguggugaguccuaacucacaguccaguaggugguggguccuaacuaaugguccacugaggaaguuccacacucaguacaggguucugggucuaucgcccauuagcuuaggcaggggaaucccucacugguuuucaggugguuuacccuuucccacgugaccauggguaagggaaauagaggagacaggugauagagacagggaagaguggccugggggcuggcaguggaagaauacccugauggggaagugggagcaggcuguguguggagguggacguguguguguuugcacaagcaugcauucacagagaaacugcucgggaacugcaggagcagaggaggaggagggcagaugugggugaucacuccaggcuugauccuccgucuccaccucacacuuucagagaugccuggggggaugcccuugggccaggcuguaagguguggugggggagaggggguccccaggucccugcuccgcaggccucgccccucucagaacccacaaacggucucaggggggcauuuuggaagcugguggccacgugaaggaaggagagaggccugcagccuguggccuagccuuguuguguggcuucccagggcuucccgugcccaggagaggucaggccggcggugggggaaagagggaggggccagcauuacccaggguccaaggccaagcugcccauucugccagagcugagcgcuguggacaccccuggccaggaggcuuccucuccucacuucacaggcucuggcugggauaagacagugugaugcuggcaguggcugcuaguucugcagacauucaaggcacaacaggugcccuucacgguaagaaguagcagucuguuugcuuccuuccuguguaucauuuuaaaacacuguagacuauuuuuggaguauguuucaccagccauuuguuuuagaguauuaaaaaaagucuauagguuuaaaugauaacgcuauaaaauagacuuuaauugaaugacagcaggacagugcugacugggucacaaguuacagggcagaaggguuaugugacucccauggcuggggagacagagcagcugucaacaggcuuuccacuggaauacgucugcaauaucaaaacacuggacccaggucuugccuguggccaaccugagcauguagguaggccagcccacagaaagacagccacgcacggcuuccugccuacaccuuagccaucugguauggggucagcaaagcauucguuuaaagaaacaaaccacagaaauaaaaucccauaaauugauuuugggggaaguuuauuuucccuuucgcaaacaaaucauuucucaaugggaauaaccugaaaguaaccacaggcugaucacuuuggaaaagcauccugggaucagcgucaaagguaagcuucaacuugccccuguuauuuucugaggaaaauauuccuucaaugcccccaacgucacauuaaccuuacaaagggaagcaggacugagaagcaacaaagugucccucaucagagagcccugucuaucaagaagucauuucaaaagcauguuucagacacgacaccgcacggguucucaccuugucgaaagcaggauacacagcacggauuuccgucaaccagccguauggcaugugacccacaggguauguggcugucaaaaucgccacugccugcaacaggaagagguggcagaguuagcaggguaccagcaggaaguccuccaggagcuacaguaggugacgaagcacgccgacucaggugcagccacugaggacagagcccgcuacacugggugacaaacaucaggcaagcacaggacggcccaggacggggggaacugacagcaaauugggcuccuaggggcagguacucugccucaucccugggagugcaaugagccagccaacaaaguggacgugaaacgagggggaugcgucacauuuuacgcagauccaaugagaaacaggugcagaccacuggcugggaagccaagauuccuuuuuuuuuuuuuuccuucucucuuucuuuuaauuuuugagggagaccagaguuuauuauuacucauaucagucuccccgagcauuggggucagagaugaaauuauaggaagucggagcugucuucuugugcucagucaguuccuggguaggggccacaacaagaucaggugagccaguuuaaugaucugcguggggccagcugauccaucaagugcaggaucugcaaaauaagcacugaacuuuggagcaguuuagggaggaucagaauguuguagcccccagcugcaugauuccuaaaacauaauuucuaaucuuguggcuaauguuaguccuacaaaggcaaucuaguccccaggcaagaaggaggucugcuuugggaaagugcuguuaccaucuuuguuuaaacuauaaacuguaaguuucucccaaagucaguucagccuacacccaggaaugaacaaggacagcuuggagguuggaagcaagauggagucaguuaaguuagaucucuuucacugucucagucauauuuuugcaaagacgguuucaaucccucccuuuggguuuuauuacaccuuaaucaaguguaggcuaugaagaugggaaaagaccauccauugcucugagaagccaagauuucaacccagguccaccugacuccagaauccuugcucauuccauugagccacacagaacccucuagucuagcucuauuuauuuuggauucucaaaaugcaacugcgagcccucccugcucucuggagggucucuuccuugggacccaccucuaagccuccacuccguccuucagggaugcugacauuuugcgugguuguugauggcuccgugcuacucuccuuacaacccaacucacucccagucuguaugggauuucugaccauaauuuggucaguauggcccaauuuagauuuuuaauuuaagaaaauuaaauacauauuuugugcagaaagcuaucaauguguuuccaugaaaacaugaguuucugaccagccaugguagcuuaagccuauaaucccagcacuuugggaggccaagguuggagaauugcuugagccugggaguucgagaccagccuggacaacaaagcgagacaccgucucuacaaaagaaauucaaauauuaguugggcaugguggcuuaggaggcugaggcaggaggaucgcuugagcccaggagauugaggcugcagugagcugugaucgugccaccacugcucuccuaccugggugacaaagcaagaccccaccucuuaaagaagaaaaaauaaaaugacaguuucuucccuaugugaaugaaaaggaagaaaagcgaaaacaaagcaucuaaaccuacauccuggcaguguucaacccucugccuagccugcgaaggaggagaacgagcuucaucuguuuuaauuaacaaaacggcaauguccagagguuccaggaacaugaggcaaauccccagcaaugugaagaaagugugguguggcgugcugugcuagaacaaaaaggagcauugggaucgggcggaccuggauccaaaccuucaccucaucgcuccccagcugugcgaagcaccaccucucccacggcuccccuucuugcugcucugguggaauaguaagaacaauaauauccaucccauaggguuacuggggagucaaggaaauguacauaaaugccuggcacaugagcagaugaccaauaaaugccagugcuguaccccacgugcuguuccuauaugccaucgagagcaauuuucaaauggcucuaauguauaauuuguccuuuuucuuuuuuuuuaaagggguggauggaauucuagcacacagguggugggggucccauacuuuuugugagaaacuugaacugaaguauucaagaacaaaaccuguguguuacaguagccacccaagaugauguuuaugauucaaaaaacaaaauccaggaacacaugaagcaagagaaagcguucugcuuuugauuuaugugcuucuuuuuccaggagaacaugagcagcuucccaggacauggaaacuggcaggcacucuggcuggagacaugcugacagcgcaguaagggcuccgggccgcuccccucaaggcagugccuggacagggggcccucgugggcagccaugagccuuccuugggaccagcaguuccagagauggaauuaauucuccagagggcaguggaggaggaagccaaugaaguaauucuauuuguucaaacccaacuugaaagagggaaaaaugagucaacucuuucuuuggaguggcugccaguuuccagauaaaguuuguucaaucaaggagcuccccaucugaggugggcaugccaggcacgggugugguggugacgggucagguggcacaugcaggauggugaagggcaggugagggcaggccgggucaacacggaggcagcgccccugcagccacugggugugucccacucugcugccauguggcaugcaugcuccaucauccucugccaccacggugaagaggccagugcugauuccguggacauggaaaacugagugggagucagaaaaccuggauucuaacacuagcccagcuuccagcuaguucugugucuuuaaccuuuucuuucugugccucaguuccucauaugauaaacaagaaggauguacgacaugcaugacagguuuucucccauaaucauaaaaauauacaauuacaugacuauaagucaccgaacgagaucuuuauggcuuccuagugugacugucauguaauuuaauauuggggaauuacuugagcucucgagaagaacuggaaaucaguuucagcaccccccugccccaccaaggugaucauaagccccacauccccaaagcauggcccaccucuguggcugcagaacugccaccaaggucccgggaaacaaagagguugacaauaggccgacugauucucuguguggccagaauuagagccaaaggccaccagaagcucagcaucuuucuuauuguugcaucucccuguguuaagaaacgaagauaaaaguuaccugaacucuagaagcagaauggaaaaaacgauucagaaucaaagcuuuuccuucguauguuaaucacaagccaauucacuauacuugaaaguaauauaaggaaaagugucuguagacaagccaaguugaauuaaaauaaaauguucaguccuaauagaaauuaaccgagacagcuggcaagcugcugugaaauuaaaacacacacugaaguuuaauggaucccaaccacucuuuuccauacugagacucggggaaucucuaaccaagguagaacccacaucucgagccugagaaacagguuugaaauuaagucuuuguuaaucucaucaaauggacuggcuggaagccacgucaggaagagguaacucuuagaaauaaaaaaguuauuuggaaucagucagcucacaaaaaugugccuaauuauucuggcaguguagaaacugacuacagagguucuuauucucggagcucucacagacaucauguaaacuguucaaaagcauaaucaaaauaaaggcauguaaagaacaagggauuccuaagacuucuguggcaaagguguggaauaucuuuaaagccuggcuuucauuaugcaauuuugguuuugauuguucacaagggugagaguuacaucauggaaccaucuuggucacuuuauuuccauuugcugguggcuaaauguuaagagauggauuguuacugucaagaccaauuugugguuggccuagugaugggauaacuagauaggauuuuacugacagucugaccucagauggagguaaguggucaaaacaauuacugcuugauacgacaaaguaaugugcggcccaaguagggaucagggugaggugaggggaugaauucagggcuauagaugccuuacagcuaaaugcagagaaaccuaaugaugucucauaccuauggguagggaaaauuagcacacacagaaaucagauaauguuuauacuuacaacaaacagaaugcuuuggucaucucuauaagguucucuaucucauuccuacuuguuucuuauucaacuuucagggcacagcaagaucuaccuccuccaaggaggcaucuuacacuacaucacuauguuccuucucccaguguucguggcuccuauauccucaugcaggugaugugcugucucagaugacuguuuaauuguugcuucuguauuguucugaucugccagaugggauaugaugcugcuugaggguagcgaccauaucuuaaaauauucuguguugcccuaugguaccuaacguugugcuugguccccaggaggcaccugaauaagggacugggauuggccauugaagaaagcauaaacaaagccuggaucccugcuguaaaaucaaacacaaugaaauauaaacucaaagguaucguggguccuaaaaccuuugcugacugcagaauaacuuauaagagcaagaaaaaccaugaaugucguaucuauuccuuggccacagauucucugugccucugucuccuccuaugggauaaggaggcuggacagugacaucucagaucacauccaucuguuagaguucauuaauccuccaacugucuuucccugcagacaucuagcacuuggccucuggguaugacauccuggccaacuucauguuuugaugucacugauuucucauuuuacauagagguggaauacaguuuuauucuacucugagucucagacagacugcuguuggguugguagacguacccccagcuccgggccacuucugucagggaugaugucgugaauguucuuguaguagcccaggcacaggguggugcagcgcacaagugcgcccauguacaaggagaggaucgggaugagcaggggcucccggcauuccaggugacugugaagcaaaauggcuacaaaaacaaccugagagaagggagaacgggaacaggucagaggggagaagcgggaaccgacugacagaagcacaggggcacgcucuugaaccugagacagaccucugagcaaagaucuugacuuuuaugcaaacagaaccaaaaauuggaugaugacccaaugucgcucucauguaauucaugugcagauguuugggauucacuggaggaacauggaucauuuuguuauacccaccaugaaaauucuuuuaagcaacuacaaaaaucuuucaaggcaucuuuuuuaagguuauuacuuuaaaaaaauuuaugcaauauguuuucaggaaucccuuggcaaugauuuacuggaacauauaacuauucaaauaaugacggcacagagaagcacugcaugugugcaccaaaccgagagauuuuuuguaccauugugugaaacccauuaacuuaguaaaauuugaaaaacaaaacaacaacaaaaaaacaaacaaaaaaacaccccucaagaauugccacugacauuggaggcauuauaaauaauuuccauuuuaccauuggugcuuggugauuacuugcuauuuaugccaagguggcauuucaaaguacuuugcauggaaucuauuuacucauuaccaacuuaauguagccuuucccucucgaggcuggacacucagauguguauguaacacacaucugaggacuaggcuacauuuaacaaagaaaaaaacaguagugauaaauaacauauacaggaaaauagacauuaauguuuauaggauagaaggcacuaaaaaugggcugggugccauggcucacaccugugaucucagugcuuugggaggcugaggcuggaggacuguuggagaccagcaguuccagaccaaccugggcaacuuagugagaccccaucucuguaaaagauuuuuaaaaaugagccaggugucguggugcacacccguaguccuagcuacuuugguagcugacgugggagguucacuugagcucaggaguuugagguuacagugaguuuugaucgugccacugcacuccagccugggugacagugagacccuaucucaaaaaaaagucacuaaaaaugcugccaaaaaacaccaacaguaauaauuauaaaacaacuuacauuaacauuuaaaauacuaaccuauaaaacuagaauagguugaaauaaccagagugagagaaugaaauuacaauaauguuuauaucucuauucaaugguacagucucuaaaucaagcuuaacuguauuaaccucccuguacugcagaaaucagagaaucagcccagccuuugucuagaguccuccugggauccacucauuccaaagaccucagaagcauacugagaacaaaagcaggacaaugcauauuccugagcuacaucaaccuuaauggccaaauaccaauggaaaaacaagcugaaacauguaaaaaccaggacugcagcggggagagggcuggugggaaagagugugugacugaggagcggguagucaacagagcaaagaucaggaaagcugccugcugcguuuaauggcaggaaagucauuaguaagaaucaucuggguggacugauggggguggaagucagccucaaguagguagagaaugaaagagaagugaaaaagacagugaguagaagccacccucccaagaaguuuggcuauaaagugauagaacuguagcuaaagaguuaggugaaauacacaggaagcuucucguugcuguguuaacauggcagacaugugagugugacaggacaagggaaacgaugcacgagaaagcagggaacagguuccugaggaagcagcauaggccaggacccagaggaguggcccuggaugggaggagggacaccuccuccccuacaaugagaagagaauugggaggaugcaggguuggaaaguaaguguguagguuuguuggcuggaaggugacgaauuugguugcugcaguugacucugugaggugggaaaugaggucuuauguuggaaggugagagguagagaaacucucugaaauaguugcuacagaguuagcagaggugaaggaugagauugugcauuuacaguucgauuaguuuauucuguuguguaaccuuuugcagaagcaccgcgcaauuggaggaagauguguaacauaagguugguucagaggaauuuucucagaaggcugagaugaaaaggcaggagauaagggaauuuacaggaaugcgggggauguacacauuaugaucugaccagccuugggaugucagcugaccuugaaaggcgagggcugaugauagcagaggagugacaggauggaaaguccaaagacagcaaacaaccuugacaauucucaccuugauaucaagcaagcuaagaagguccagaugaccagggaacaaaacaaaaacagcaauauguuuccacgaaucccuuggcaaugauugacuggaacauaucacuguuaaaauaaugacggcaaagaaaagcacugcaugguugcaacaaaccaagagguuuuuguauuauugugugaagcccauuaacuuaguaaaaucugaaaacaaaacaaaacaaaacaaaaaaccccccucgagaauugccauugaaauuugaggcauuauaaaugauuuccauuuuaucauuggugauuggugauuaugugcuauuuaugccaaggugauauuucaaaguacuuugcauggaauccauuugcucacuaccaacuuagguauguuuucauaccuaacaaacguuuucagguaaugagaggaagccugaggguaaaagacuuaaaaagagaauuuauucccccagccaaauuguggcaggaacucaagcaacaagguuuaaaauaacuacuccaccaggcacagccugaagccagauggcaucugaacucggcuuccacgcucccacuaaccagaucuguuuauucuaaacuugcaggccuucccucaacaggcaagggccaggaucagguuuaaaauagagaaggaaaauggcuguagguguauuggcaaagucuuuuucagagauaggcuuuucuucuucuguccuuggauggguacuauguuuauuuuaggcaaaguuaagaguuuuuuuuuuuuuuuugccuuuaaaaaaacacacaucuacaaaugugugcucacaaaugcucaccgacuugcugaugccaguguuugaaauuagagaggcuuacugaauuucaaaugaagugauuagagugaauaaggcaguuuaguucaucucccauaggauacagaaaguaagacugggacaaaauucucuacuaacucuuaagaaaauuaacaaagacauaccaaagaauggugguugcuaguauugcuaguauuuacacacacacacacaguuaguagaaauccauuuaaauuacuuauaauagugauccacggaguaaacacgauuaaucuggaaauuauuggucuucagggaaguacuaacaguucaacagucgauuauuucaagaagguggcuaagagagcaggguguacaagaaaggaaaaauguauggaaauauucauagaauagaaaugagacugggcgugguggcucaugccuguaaucccagcacuuugggaggccgaggugggcagaucaccugaggucaggaguuugagaccaaccucgccaauaugaagaagccccaucucuacuaaaaauacaaaaauuagccaggcaugguggcagaugccuauaaucccagcuacucaggaggcugaggcaggagaaucacuugaaccuggguaguggagguugcagugagccgagauugugccauucgacaagagcgaaacucugucucaaaaaaaaaaaaaaaaagacaugagaauuuggaaaggcauuuagagauauagucuaaccucuuccucuaugaagaaaucauucucccaaaucccugacuguaggaacuuagucuaauuuauaaaucauaagaauucaaucuauuuuuccacuaaaauuguucaugcgcuauccuugguagaagaagaaaggacagaaagccagggcugagugccagggcucagagaauuggacccaacagaaagugggauguaggccuucuucucagaccgcguggaaagguagcugaauccacuuccugguuccuucuaaauguggggaagugaccugugaauggcagcccugcaugguaacaacagaggauuauaagaacauugaagaauaauuccuaagagccuucccucuaggacagagugacagacuucauagugauaggccacgcagagggcacccaggcaaguaaacagugacccuaagacaugccgaaagguacuagguaugacuuuaugcucaucucaugugcaugcucuuuaaaaauaaaggucaaaaccccuuuauuuaaauuuaaauucuuacaacccauauucuagcaagauuauacauacuguuauuacagggcauucccuuuucucauucauuuagcaaauauuuauugaggucucuaugugauguaacggugcuggcaaaaccaggucgaaugcagaguguacugcacagugaaugaauauaaaucacacaucaguuacacacgccagaaggggacucugaggagcucugauugacacacagaccauauuuaccugagcuaugacaucugagauugaggcacaucccaccaggaaacuguauuuguguuuuaagagaaugccagcauggguccaugccugccagaaagaaaagaauuuggcaugagauacaccuucaggauuaugcuguuucugguuguugagauuuacugggcauuccugaaauacacuuuauacccccucaaagccuuagcagcccaggucugauaaaucuuugguugguaaaauuacuguaacuugaucugguggcuggcuccauguuagaguuuacaguggagugaaggacugcacgcagguauuuauuuaguaccaauuguauguagacuagugcgcuauuagguuuguaugccuggcaggaaagcugaaggaauaccaagaauggaagaaacacaaucucugucucucaagcgucucagucccaaaguagcauccuucccacgugaugcagaucauaaugagggcucucauuugggucugaguuauuacagucauuaccggugcucacugacugauuagggccuacuguuuucuugccuucaaguuugggcaggaucugaccugacacuuugggagaugaggaggaagaugcuacgaggggagcagacgaaaagcccgaggaacagcaggucuggagaagguuucaaguucaugacgggcucuguuuaaggaucauccuucuuaccuucaagguugauuuggacugacacagaaaugacacuucaucugagcuacgcacaaugaggcaagcagggucuauuccccagguccaugucaagauuuuguacagcaacagcuaauucccugcccaucugcaaacacagcugugggcuggcuuuguugucugaaagccaccauacaauaagcuugcuggcuuuaaauauucucucuccaaccaauauaucagcgccaagcugccaggggugaggggguggggagggaggaguugaucugguccuuauaaauguucauuauuuucauuuuuauaagccaucucuugcuguuauaccagggucucugggggaacuuacagaagaaacauggaagaaaagaguaccaauuacaaauguucugguguucuauuugauuucagaaacucucuuauggcaaauaaauauagcuaaagggacauggaauaccagguccuuaagaaucugcaauucacuuuuacuaacaguccugaguuccuggaauucaccguauaacuguaauucuucuauguguguagauucccacuucaacacagaugggaggacagaccucagaggaaugacacggaccuguccaggaagcugggcuuugacucuuuagggaugucagaaaggccaccuccuucaguucucuaacugggcuaccaccaugggcuagcucaggcaccgcagggaagccaguuaugcacuuacaucaugcaucuaacugcauauaaacuugaggugggggugguaaaaaaaacuauacagacuaacauauuuuuaagucuccuuccaagaauaauucgaaauggagccaaaggaaaggguuuacuuuccagcauuggaccuuauuggaacauauauauauauauauauuuuuuuuuuuuuuuuuuugcuaagucuuuuuuauauuuauaagacagcagaagagaaugaaaagcacuguuuaagcacuccucagaaucaugacaaagaauuuauggaagugggcagcccugagcuaauggggugaaguugguuauuaaaauaaugaaacccuaccaguauguucaacagauucuuacucuaaaacucugggugucugugccacacaagugguaaguuuaucagaaagugauucugauccuuugauccugaguauaucagaaaagaacuguuuaucugcaucaaaauuuucaaaugggcuuuccugccaccuaccagaacuuguggcaaaauuaaauaaauugacaagauggacugguuaaaagucaacagacaauuggaaccugaguacucugauggugguauagcugcuacgaagaucagucugcuaauuccucaaaaaaucaaaaaucaaauuucuguaugauccagcaauuccacuucuggguauauaccccaaagaaccaaaaacaaggacucagauauuugcacacucacguucauagcagcguuagucacaagaacccaaagguggaagcaacgcaaguguccaucagcugacgaacggauacacaagauguggccuagacauucacuggaaagugacucagccuuaaaaaggaaggaaauucugacaccugcuacuacauuguuaaacucugaagacacgcucagugaaauacgccaauuacaaaaguacaaacgcuguaugauuccacucuuuugagguaucucaaguaguccaauuuguagaguuacaaaguagaauggagguugcccagagcuggggagggggccgaggaggguuacuguugaauuaggauagaaucucaguuuugcaagaugaagaguucugaagauugguuacacaauaaugugaauguacuuccugccauuaagcuguacacacaaaaauagcuaaaaugguagauuuuauauuauguauauuuuaccaccaguuaaagaaaaagaaagaaagccaacgaucuucucuacucaccauugcguccaugaaaggaaaggcggcgagguacaggaaggcccuucucgucuugcuccccaccgacucguccacauggugcaguuuauugauaauguaguauccuaaaucacuauaagcugcaaagugucgaaaggcauauguggaaauauuuagaaaaggauaucuuuauauucuuuuuguuucaaaagcuuaaaaacaauuuuaaauguaguauuuguucgucauagaaaaauuagauaagcaaauagaaaaaaaucaucuacaaucucaucccucuacccagagugggucacagccaaugaaugcucuggguucuaaucaccaaguucuuuuauuguucuguguuuuaacguaaaaacgagauuguauuccacauacucuuuuguaaaccaugaacaucuuuccaugauauacuucuacauuuuauuucuuugaauucccuucaaugaacugaauuucuuuuugagaguuugcuugguaucagcuugcccagucuccuauugcuacacagugaggugguuuccaucauuuugauacuagaaaagaaugcuugguggcuagguuugaagcuaaauguuuacacauauucuuaacuauguacuaagagaaaauuucuagauguuaauaugccuuuccauaaaacuuuaaagcuagcuuuuucacacuugccaguucuuuuauuucacuuuuugggaagaggguggcaacuuaggguauaguccugcaccgcuggaaaaugacauugcggaggugcuuuuguaguccuuccaauaucagaauuuguuaccagugacuggaacauaggcacucagccaguacgggcugaaugaaugcauaugugucaaauaggaauagggaagaaggagaaaggucuccuaauguauuagucaggaauccugacagauauuauuagcaaagguuaaauaaaauauugagcuauuuuuucaccucauugauagaaguuuagauuauauauaaaaauaacaggccaggcaugauggcucaugccuguaaucccaguacuucaggaggcugaggcagaaagauugcuuagccuaagaguuugagacuagccugggcaacauagugagacucuguuucuagcaaaaaaaaaaaauuuaaaaauuagcccggcauggugguacaugccuguagucccagcuacuugggagguggaggcaggaggauugcuugagcccaggaguucaaggguacagugagcuaugaucgugccacuguacgucacccugggugacagagugagacccugucuuuauaagaaagaaaagaaaaaagaagaggagaggggaggggaggggagggaaggggagggaaaaaaaggaaaggaaagggaagggaagggaaggaaagggaaggaaagagaaggaaaggaaaagaaagacaagaaaauaauaaucuucagguuuuucacagugucuuacgaguguuuuaacaguaggugugccuacuauuuucauucucuuacaacuauggauauuagaggugggaguaagugguuucaaggugugggaagcuggaaugacuacgaucuucagagagugagguggggcaggucggggagagugcaggaggaaagcuccuaguccuuccaggcaggguagaggugaacaaccagaaggucagcugccagguaagcaaaggugccaggugugguaguagcugggccaucagaaccacugaggcaccaagaagagaaauccaagagagggcaugucacguggcagaaagaagagagaccugggaagaugggauuaguuauagcaagggacauggauggaaggaggcagcugugaugucccugucguuuggaucagaagcugugcagagaugaaaaggggauuaguagagguuugaccugggaaggcagggagggagagcuccugccugauuuugcagccaggugagaauugcauuuagacaugagcuaagcuggcugaaacacaaagccagaaugaagauguuacuuaaucauacagaugaucuacuuugggugccgaacuguggaaauuuuguucaaaguuuauuguugcugcugcuguuuauuugcacauguguuuucauucagucaacaaauguucacugcgcagggaucugcaaggagaccauccugaccuugcccacauugcuguccccacacccaccucucagcugaggccacuggcaaugguaaaggcagcugugccaggcgaguagagcaacgaacacaaugccaagugcaagagcacagggcuggcuaggaauagcucaugagcuaaaauccccuggugaagguuacggucacuauaaaacaccagcugaggggacuugacugccaugguugaagcuggggacuauggaauuggugaaagggcaguguuguaagcugaacuaugucccuucaaaauucagauguugaaauccuaaccccuggcaucucaggaugugaccuuaucuagccauaaggucacugcagauauaacugguuaagaugaggucauacuggaguagagugggcucucaauccaaugacugauguucuuauaaaacggauauucagauacagaggcagaugcacacagggagaacucagugugaagaugaacgcagaaaccggggugacuccucuacaagcccaggaaugccaaagauugccagcaaacacccagaagcuaggggagaggccuagaugacagucuuccucauaucucucagaaggaaccgccccugcaacaccuugaccucggacuuccagcauccauaacugugaaaugcucaauuucuguugcuuaaaccaccugguuugugauacuuuguuacggcagcccuggaacacagguacaaguggcuucugagagagggagacaggcuuauuuucauguuaaacucugggguggcaggaagaucagaugggacaugugaguuucagcagcugagagcagggcaugcagucugcauguagcgcccagaaauagagaucaauacacauaagcuucucccugcugagaaggaaaagaaacucaucugaguaagggcauccccuuuaauuaucagaccuagggaugcacugaaaugugacaaugugugacagcagucacaucucacucccaccuugagugaauaaugaccuugaagccacuugcuaugugcgcuccagaugaacugaugccaaguagccauaaaaugccauaugcuggacaccacaauucauacccuauaccguaaaucaaugaguauucccgucaagcaacuucgugucagaccauuccuuguccccuuuugccuuuuuuuuuuuuuccuuugagacagagucucgcucugucucgcccaggguggaaugcaguggcgcaaucucagcucacugcaaccuccaccuccuggguucaagcaauucuccugucucagccucccaaguagcugggacuacagacgugugccaccacaccuagcuaauuuuguauuuuuaguagagaugggguuucaccauguuggccaggcuggucuugaacuccuguccucaggugauccaccugccucagccucccaaagugcugggauuauaggcguuagucaccgcacccagccccuuuugccuuuaaaaaccugcuuguaacaaaggccgaaaggagcacuccccaaggccacugggaagugugucccaggugacaauccucaauccuggcccaaauaaacucucuauauaauuuaaccucaguuucuuaaauauagcuacuuauuucaauaguuuaacagaaacaucaaaaacagugccuucaugcagaguaacugggguaaacauguaauauuuauggggucuaaggacugcuggggcguucgccauccauucuccuggggaugagcccagcccagcuuucugguugggugagaagguguccccaacucuugccuccuucagcauccagggcuuguccuagcucccuugguuucagaguacugugggaccuaugaggcuugaggcugccuuugcuucuuuuaacuucuuuuuauuucagucucuuccucuuucagcuacuccgggagauauuuggaggccaagggaagaagcuuuuccucccagauuuucuaacuuccaucuacucuuccccuacaugauagaggagucugauuauagcuauagagguuaauucuacccugggagcugugaguauaaaaucccaacaacuguuuucacccacucuguuggggcgacucccucccucccaugccccugagcuauuuccagcuagagcuauuggggggguggggggguaauuuguuuaaagugauuugcauagaguccauaauuaccaggcuagcugccuuagcaauauuuagcaaccuucagcuucuauaaaccgccuuaccaagacuguucuaaaacagcuuguauuccuuaugaagagcagaacauuacaaaaaaaauuaaacaagguuuuugaacagauguaaacaaauuuuaugauauugcaacagcaagaagacacugacuugaccuguuuacagguggacagcuuugacccuccuaaacaagggacacagaaagugcccuucagauccacggguccacugacuucagccagccagggccaugggcucuuucugaaucagugguucucaaaccuguucauccaggagcuguugcaaaccauaaaauguuaauaugaaccgaaauaagucuacacacauuuuuccacauccaauaggcaaaucugagaaccauuauucuaauucaaauucccaaguccucaauguuuaaaagucucacagguacuguuguugacccacugugaccagcuugcgaggcuuuucacgggagcagguaauuucaccccugugcuucuaggguaucauuuccaagguauguguguuuacauggcugauaggccauauuuaaaucacuucgauaaauacacauugagugacuuguaugcaucagguacugcacacucuaacacagcugugaagaggacaguuuccugcauaugggcugggacacagacauuuaauaucacccaucuauaaucuauacuaggcaacacuuguccaaugugggggauagggggcauaaauaucaccuaggucuugaagagauaccauaaacccaugcacaauguaagucaaguaauugugaaauuuuaacgcaaguacaagaauucuaucucacuggcaucaagacuugguggagugggguucagaagaauuuauugcaggagaucugcuucuuucuagagaacauuucuuauucauguuugaauucucaggaucuagcccagugugcugauugaauaaauguugaaauccauaacccccaaaagaagugacugggaggcugggcacgguggcuuaugccuguaaucccagcacuuugggaggccgaggcggguggaucaccugaggucuggaguucgagaccagccuggccaacauagugaaaccucgucucuacuaaaaauacaaaaauuagcugggugagguggcaggugccuguaaucccagcuacuugggaggcugaggcaggagaaugccugagccugggaggcggagguugcaauaacccaagaucacacuaaugaacucuagccugggugacagaacggaaaauaaauaaauaaauaaaaauaaaaaaagugacugggauauacugguagcaaaaauaucccuugagucuucccuccuacuuauauccccacucuuugucacaugauuuggcaguuccucacaccaaaaguuagggucuauuccccucgccuugaaucugggcuggccagugauuuguuuuggucaguagugugcggugggagugauggugggcccguucugauuccuggccucagggagccgucaugugugcuucugucccuucacuuggagugucaccacagccaucuaaaaaagcccaggcaaugcuaguggaggaugagagacuauguggaggagaguucagcugucccaacagaggccaucuaggcuggccagauguucgccaacaaggagcccaccaaggucagcagagcgaccuccuggcccucagcugaccauagaggccugagccuagucaaguuccaaagauccgcccagccagccugcagucuugcaaacaaaaauaaaugcuuguguuuugagccacugaggaucggggugguuuuuuacacgacaauaaauugugagacuauacuggcacugucuguucgcucccagcacccucguugguuuaaauuauggcaaauuauacuaauucacccuuuauagagcugguuaauaacccaugaauaaugggaaaguuugaaaagagaagucuggcaaacagaacugguccagaaauuauuccaauggcucacuggaagagcacaggaaccugcaguuuuguuccccugaauucugcugacuacccaggaagcuucagaacauggcaagggccuuacagguuacugucaagaauaaacguguaaagaaaguuaaaauccacagcagcgguuucgacaucuucgugaauuaggagguuaggcaauacuaauuuccacgcacgugaaauuaauuuggacccaaauggaaccaaaugcaaggucagcacgcuuuccuccaugcagcacaaccacuggccuaaaugaagguguggugauggcaaaccccgggcucuguacucuucguuuuuguuuuguaacuuaaucuagcaggacaacgcaguuuuaaaaaauggugucucauacauggguccaugacagaagucguggcuaugguuaagcuaaaaaagagauacuugcagcuguucaacaagggccaagaaauacucccaaggcuugugcaauuuggguaucuagagccaggcuaugggugugcauaguauggacaguaacucuuguccaguggaucuucuagacuucaacucucucaguccaacacaauuccaagugucugcucuauuggcucauugcacaagguuugccugggugggaagaguugcugggcacauucucuggggccaucuuucccgcacaaucuccaccaagcauucccagggaagugucugaguggucagugguaucuaacccagccuugucuggggaaauccauuaccaagcacaaaguucucaaagaugggagaaugccuagcucaauagcggggucaagaaaaaaaaaagaaaagaaauguaaggaaaaagaauuccuuaacuacaguaaaucuaaugaaaaggaccuaguagaagguucuuuccuuuauuggggcaaacccagugaaugagggaugacacuacaaaagcuuuuagugcucuuugaccugagccugucucaaucauccugcugcgacccauuaacugaugcacagaggggacacugcguuagugaaagugagaagcuacaucugcaacugauuuuucagagcuggcaauguccacauuugaaaucccuucuaagugaagaagacccuccagggauugguaaauuauuaguaaauagugaaaaguaugaagugucaaaguucauccagacugggggaaaaaagucuaagauagagaacaucacguugggaugauuuuagauggcuauagcaaaauauucauuauagcgcacagggcaaauucuugacuccauuuuguaucaaagauaaggaaaaauuagacaguguugugcuggccaggugugguggcucaugccuguaaucccagcacuuugggaggcucagguaggcagaucgcuugaacucaggaauucaagaccagccugggcaacauggcaaaacccuaucucuacaaaaaaaaaauauaaaaauuagccagaugugguggcaugcaucuguagucccagcuacucaagaggcugaggugggagaauugauugagcccacgaguucaagguugcgguuaguugugaucacaccacugcacuccuggcugggcagcagagcaagacucugucucaaaaacaaacaaacaaacaaacaaacugaagaaaagugcugaaaugcaauucauccuucagagacgguuaagaaaugacucaauccaugaggccugucccaaccccaaaaagaaagaaucucuuccugcucuaugcucucacauguugaaaauaaaugccuuugaaaaauuagaagaacuugcuaaaaggaaauaaauucauuaaggugaugggaaacuagcacuuaaagaaauguugaaggcaauucaacuacuuuugccuggacaaaagaauagaaagaaauuaguuuaaaccuagauguaucugauuuauauucccacucugugaauucagcauguugaauuuauaauacaaagcuuccuguacuuacuguaggccccacccaggagcuguacauguagggaauauaugcucauuucaauaucagcccaagcaaauauaaucaggaagacugcuugaaaucauacaauggcuuuucgagucaaauauacuuggaguauuuccuuuucuguuuuaucuaugucaguguuccccugucacacacauaguuauccaggagcugacugcugaaguagaaauguaaguagcuguuuucagcauuacuaggaaaugaaaauggguguaagcgucaaauauaggugaugcauagagacugccauuggaagggcaacguucaaugacauaggaaaguggugggaagaauggcugggggguggagagagagcaacaucccaucauggagcuuguggccacgauuaugggaaacaaaaugggcaggaucuggauauagaaaagcuuacaggauuacuaaaaacagaggcagaaaggugaacaaagaugcccgacguagcagauggcaaaggcaagagagcagcuaaagacuuaggcagaaaaugguaaggaggccaacacucuagaaaaggguacaucauuaagaucugauuuucagauguucaaaagaaauucauaugugcuuucguagcaacuguggaaaacauuuguuugguggauggaaaaaugcugugauugcaaaaguauaaaaacuaauaaugauuauuaaauauauaugagauacagaaaaccauuuugguuuaaauuuaaaauuuuauaauucuauuuuaaaauugaaaaacuaaaaugacauugauuuuuauuuuaaugaccacauuuucuucccgacaauugcaauaacacgggaugcuuagcuuuucucuuccagaauuacugacaacugauaauuagcuguuuagucccaaaguuucauccaaccauggcuaaauagggaauguuggauuauuuauaaguccaaguaaaaaaagagcuaguaacaaagggaacucauuugcuuauuuaaggaagccccuuauuuuacaaaauauauggcuuuuuuuuuucccaaauacuguacauguauucuuugaaaauggcucaggucaaauguagcagaaauuuacuucaaauacaaguacaugugcaaauacucaguccacaguuagccuucagggcauaaacugaggaaaugagaggcagcuccucuuuacuccaugcccugaagcucugagcacaaauuaaaggaucaauaucaacgcuuuggcugaaugucugguccaucagcagaugcgcucucuuccacaauguucuuagcacaaaauuuuaugucacauuaaaaaggaaaaccacaaaggccuuaccuuauuuacuuucagauucgcaguuaugugaguaagcauuagcugccaugcaaacacacuguaaacggucuggguuaaucuuuugguuccuuuauucaccacugacagucacgcgucuuaaacaaucaguaacaauuuuaagguacacaauggguuuaugaagugucauucacaguguuuuauguaacugguuucaguagagguaccacucaauuuuuaugccagguaagcaaagcuguuuuaaagccacgacggaagucaugcccugaaggcuuuauccccaccaagaaagcagcagcagaacuccagcccugaaggagagcugcuuuuccagggucuugguuaaacuggaggccagucacuguauguaugauacagcuuuccuguuguuucauggaaagaaugcuaucacaagagcauuuagucuugucuuugaauaaaauagaauaagauccuagaacaaauuaauaaauagaacaaucugucauuuguucucacugcuaauaagcauuaauucuaaauaagucauucuauuuuuauucuuaagauuuaaugacccaguacaaugacgcacacauaucucuaacgaaagcaccugcuauuuuauuggccuuaccaaauguuauuccuagauguaaucgccuacuaaugaaaucacugcuuuucacuuugggaaucagagacacaaaacuacagcuccccagaaaaaacacauuauugucuuaagcuaggagcacaagcgcuuuccuucuauccccugaaaauuucauaagaaacauuugauaauuagugaagaaaccacuuaucucaauaaauacauuuaaaucaaugaaaaggaauaagaaauugccaaagcuagauucgucaguggcggucggcggccucaccuaucagugugugaaagacggcagcgauggccccugccaccaccauacacaggacggcuuugguccugucucucuugcuguucacaaacaccaggcccacauuuuugaagucacucaugggacccgugaagaacuucaugagggaguacgccagcccguagcuggccagcaucucgacugcauccuccuugacagcagcaaugccccgguucaaggccugggaagggggaaaaaaacccacaagcauuagaaaugucaucucuucucuggggaaucauaccucuaagaugaaauucagcagaucacguuucuauagaaacacuaaguagcuuauagggugcaucucauguaauuggauaaaggugauugguuuucauuuucaucuacaucagcuucaguuugaguuucuuuuugugaaggagauaccugaccacugcaguuaaaauaauagcaaaacaccaacaaauauuuuaugcuaauauugaaaaauaauucuaagaaguuuugguuaaaaguugauuuuuuuaaaaaaacaaaaauguuaaauuuuguuugcaggcugaauugacauaauggcaagagacauucugaaaacgagucuaacaguuuauaucaaggggauggguucuuuuuucuuuaaagaaggggugguguguguguguguguguguucaugugugcacauguaaucuuaaauacuguguauguguuauguauucuucauagcagagcucuaugcuaugaaaaaagguacugaaagaauuuauuauauucuucauucaugcauguuguuuaccugauuccuacuauauuuuaaccugaaauacauuccugagcucuacacagacaaauaugaaaagaacaccuuuagacuaaaaaauaaauguuuuuggauaaugguugugcaggaagaugcgguuguaaaauacccugacuacuuuaaccauccuccaagagagacgcucuuaggcacugcaggccuuggugggaugguacuuccaaacuaaauuucccaccccgaagacaaaucaguaacagcagaccagugggaauggauguccagguagagagagcuuucugacuaaaaugccucuagaacauugcaucugucauuaggaacaggaaacuaagcagaagagucagcuuucuguauaguuauauauuuuuagaaaauagacuguuuuuaaggcaguuuuagguucacaguaaaauugagcagaaaguacagagcauucccauauauccuuugccccccacaaacacggagccuccccugcuaucaacaucccacgccagagugguacaugccuuacaaucaaugaaucuacacggacacaucauuauuacucaaagaccagacaguaguccccccuuauccuuaggggauacauucuaagacccccagugaaugccugaaaccauggaaaguaccuauguuuuuuccuauauauacuauguuuuuuccuauauauacauaccuaugagaaaguuuaauuuauaaauuaggcacaguaagagauuaacaacaauaauaaucaaacagaauaauuauuaacaauauauuauaauaaaaguuuuaucaauguggucuuucucucaaaauaucuuacuguacuccuugugaugaggaagagaugaagcaagauggugagagauuucauuacacuacucggaauggcaugcaauuuaaaacuuaugaauuguuuauuucuggaacuuuccauuuaauauuucugaaccuuggucaaccauggguaacuguaaccauggauaguaaaacuguggauaggggugacuaguguaauguaguuuacauuagggcuuacucuugguauauuguacauucuguggauucugacaaaugcagaaugacauauauccacaacauauuuuuaagaaaaaagauaugcuaaagucuuggcccugccauuugucacucauccaauagagacacaaucacauucauagaauucauauucagucucugcuauguaaacugaaagaagaaaugaaagaaaugcacuuuuccugucuauuuccuauuucuauuaaucaagauagcuguugauaauuuucccuacaaauauaugguuauagccacagucugagagcugccuugcuauacuggguagagcuaaugucaacaauaccaaaggagccaacgggugcuugaaagaggaaagacugaauacaacaaaagauucaagaacuaaucuucaaacauauauaagaaucauacuacauuaugacaaaacaaaguaaacucaauccaccauuguguuucacugaaucugauacuauagacuguaa

SEQ ID NO: 17740 - RNA, 2035 nt, Homo sapiens
gacuggugacagaccacucccggagggaaggaaggaaggacgggagggaggggcauccagucccacugccagcggaacacaugcacaacaaaagcagcaugccaccgccgcagggaggaaaauaaacaggcgaacggcgggcagcacugucacaaaagagaaaaaggaaagggaagggaagcugcucuuucccauucucccgaggcucaauccagacugcaguggaaauaagaaaagacccucaguucgcagaaacaucugcugauaugucucgggcucuuacuuagcagguggacacuuguauuucaauuuuucauuauuaaaccaccgauuucccccggaagcacacagaaggaagugcacaaugugaugagaggaauucaccaccgagccuggccagggaccaggguguggagcuagggaggugacggcacgagcccaggccccacaaucaggcugccaacaguucgggccuucaacggaaagagugugcaugcugaaaagaugcagacaccuccacugccaccaccauaaaacaggcugcuggagaccuagaugaguaaagacacccuggaaugagaguggcaagaaugacuuugggccaggugggagccagggagcagagccuacuuccugaaaguccauuaacuccugcagaucucugggguacuauucacggaacugaaaaagacaauuaauuacauuaaaugggcccugguggcuuguauguagagaaaaugcuuucagccuccucagggacuaagagucagcucacgcaucuucuguaugucuaguggggacagccggcucagcuggugagauggggcaagucgggaccucccgcuugauacccugugcaacgccugcugccucaagacucauaagucaaaacugcacuugcagaaagaaacugugugugcauguggucuucuguuuccaagccaagcuuuuuacaaaacggcuuuacugaggacuaacugacauacuauaagcugcacaaauguaaaguguccaaugugaguucugacauuugucuauacccacuucaccgugagccucucccucaccucaaagcuggcugaugcccucugucaugcucccucccuggcacucaccugcucucagccacuggagauuaccuugcauuuucuaaaauaauuucuagaacuggaaugggacaguauguacucuuuuuuuuucuguccagcuucuuucauucagcauaauuacccugagauuuauccauacuacuguguguaucaaggguucguuccuuuccacugucgaauagcagucccugcaugugugaaaccacaauugaucccuucaucugcuggugggcaucucgguuauuuccaguuuggagccacuacaaauaaagcugcuguaaacauuugggcacaaccucuguaugaacuuaugauuuccuuccuuuuagauaaauaccuagguguagaauggcuggaucauauggcagguguaugcuuaacuuaagaaacugccaagcuuuuccaaagugguguaucauuuuuaccuucccaccagcagcguaugagaguuucaauuccuccacuuccucaccaauaacugauguggucagucuuuuuaacuuaagccauucuaaaugagugguauaucucacuaugguuucaauuuccaauucccuaauuacuaaugauggcaaauccaagcuaagcuuuuaaguguucuuuugcugucaaacauaucuucaaaaacacacuauuaccagaugacuuuguuucucugaaauaugcauagggaaacugacuuccauuuuuaacacagaaaaucuuaguaucaauuccauacuacaauuuguucacugagcaauauuuacauacauaaaauauacuuuuauuguuauuugcaggucaguacacauuuaaaauauagcaggccaauuuuaaaauaagaaaagugcuggcaaagaaguuauuuuucaauccuguuacccaggguccuaagaauuaauuuuacugaaaauauuaaaguaaauaaaacauuuguuaacuuu

SEQ ID NO: 17741 - RNA, 2950 nt, Homo sapiens
uaggcaaugguaugauuaacuggggccuuaaagaugaugaagauaugacauuuacaagguggacaggcaugauuauugggccaccaaggacaaauuaugaaaagagaauauaggccgggcauggcaguucacaccuauaaucccagaacuuugggaggccaaggagggcagaucacgaggucaggaguuugagacuagucugcccaacauagugaaaccucaucucuacuaaaaauacaaaaaauuagcugggugugguggugugcaccuguaaucccagcuacucgggaagcugaggcaggagaaucacaugaaccuaggaagcagagguugcagugagccgagaucacgccacugcgcucccgugugggccacagcgcgagccucugucucaaaaauaaaaaaaaagaauauauagccugaaaauagaaaguggacccaaauacccagaagcucccccaucaguuagauuuguaacaagaauuaauaugaauggaauaaauaacuccagugggaugguggaugaccgcagcacaccaguguuagcaaaaugacaaaauucauauagcauuaaaguuguacuucaggagcuaagacgucuaaugauguccaaagaaaauaugaagcuuccacagccacuggaaggacaaacauacaacaauuaauuuuaguggaucucaaacuugucuuauaucaacaaccuucuacucguguuaaugucuugauuaaauaucacaaugcaaaauacccacacguuaaauaaaagaacuccggcugguaaacaugaccuggacauuuguaagaauauauuuaauauauguacacccauuauguuuucagguaacaggaaaaaugcaacccaauuuuuuucucuuguuaagguacugucauuuaaacauaaacuuggaguacucgaaauauaauucagguuuacaagaugaaagcgugguaagaagugucagauggcaguggaagcauguguguuucuaaagacuaaaaaucucaauaaagaaaacagggcugggcacaguggcucaugucuguaaucccagcacuuugggaggcucaggcgagcagaucacuugaggccaggaguucaagaccagccuggccaacauagugaaaguccgucccuacaaaaaauccaaaaauuaaccaggcgugguagcacgcgccuguagucccagcuacuuaggagacugagguaggaugaucgcuugaucccgggaggcagaaguugcagugagcugagaucgcaccacugcacucuagccugagugacagaguaagacccccaucucaaacaaaaaaggaaaggaaaaagaaaacagaggccaggagagguggcucacaccuuuaaugccagcacuuugggaggccaaggugggcagaucaccugaggucaggaguuugagaccagccugaccaacauggagaaacccugucucuacuaaaaauacaaaauuagcagggcgugguggcccaugccuguaaucccagcuacuugggaggcggaggcagaacugcuugaaccccggagguggagguuguggugagccgagaucgugccauuguacuccagccugggcaacaagagcaaaauucugucucaagaaaaaagaaaacagaaauggcaugcuuuauccaucuugcuuagugaaagagagcugcaguugaaauuguuuaaaaaguagcagguauuggccaggcauaguggcucacgccuguaaucccagcacuuuaggaggccaaggaggguugaucacuugaggugaggaguuagagagaccagccuggccaacauggcgaaaccccgucucuacuaaaaauacaaaaauuagccaggcgggcaccuguaaucccagcuacugggauuauacuugaaccugggaggcggagauugugguaagccaagaucgcaccacuguaccccagccuaggcgacagagcaagacuccguuaaauuaaaaaaaaaaaaaaaaguagcagguacaaugaacacugucacaaauguguuugauuuuuuuaauuuuuuuuauuuuuuugagauggagucuuguucuguugcccaggcuggaaugcagugaugagaucuuggcucacuacaaccucccagguucaagcgauucuccuaccucagccucccaaguagcugggacuacaggcaugcaccaccaugcccagcuuauuuuuguauuuuuaguagagaugggguuucaccaugcuggccaggcuggucucgaacuccugaacucaggugaucugccugccucagccucccaaaguguugggauuauggguaaaaacuaccacauccagcacaaauguguuaauuuuugaaguggugugggugcugacuacuaguaguaugaaaaauauguucaggauuguuuugauaccuaucuuauaauaaaaaauguugggggggaguugaugaauuucuguuaaaagcuguucauguguguuacacguaacagacaugguaaauauuugcuuacaguuuuuuuuuuuuaacaaacuaugcacuuaagguuaagugacaucaacaaaaaagggauacauauauggagauauaauuuugaaacuaaaguuggucuuuuuuuuuuuuuuuugagauggagccucucucuguugcccaggcuggaaugcaguggcaugaucucagcucacugcaaccucugccuacugggcucaagcaauccuccugccucagccucccgaguagcuaggacuacaggcacaugccaccacgccuggcuaauuuuuguauuuuuaguacagacaagguuucaccauguuggccaggcuggucuggaacuccugaucucaagugauccacuugccuuggccucccgaagugcugagauuacaggcaugaggcacagcacccagcccaaaguuagucugaaaauguaaauaaaauguggaauguguccaagaaaaaaaaaaa

SEQ ID NO: 17742 - RNA, 860 nt, Homo sapiens
cuccucccgcugcccaagaugccgaaaggaaagaaggccaagggaaagaagguggcuccggccccagcugucgugaagaagcaggaggcuaagaaaguggugaauccccuguuugagaaaaggccuaagaauuuuggcauuggacaggacauccagcccaaaagagaccucacccgcuuugugaaauggccccgcuauaucagguugcagcggcagagagccauccucuauaagcggcugaaagugccuccugcgauuaaccaguucacccaggcccuggaccgccaaacagcuacucagcugcuuaagcuggcccacaaguacaggccagagacaaagcaagagaagaagcagagacuguuggcccgggccgagaagaaagcugcuggcaaaggggacgucccgaagaagagaccaccuguccuucgagcaggaguuaacacugucaccaccuugguggagaacaagaaagcucagcugguggugauuucacacgacauggaucccaucgagcugguugucuucuugccugcccuaugucguaaaaugggggucccuuacugcauuaucaaggggaaggcaagacugggacgucuaguccacaggaagaccugcaccacugucgccuucacacaggugaacucagaagacaaaggcgcuuuggcuaagcugguggaagcuaucaggaccaauuacaaugacagauacgaugagauccgccgucacugggguggcaauguccuggguccuaagucuguggcucguaucgccaagcgcaaaaaggcaaaggcuaaagaacuugccacuaaacuggguuaaauguacacuguugaguuuucuguacauaaaaauaauuaaaa

SEQ ID NO: 17743 - RNA, 1022 nt, Homo sapiens
ugcuagagucucaccucauuaucuauuuucuucuugcagugauacaauuucuucuugggauuuucacaaauggcaucauugugguggugaauggcauugacuugaucaagcacagaaaaauggcuccgcuggaucuccuucuuucuugucuggcaguuucuagaauuuuucugcaguuguucaucuucuacguuaaugugauuguuaucuucuucauagaauucaucauguguucugcgaauugugcaauucucuuauuuauaaaugaauuggaacuuuggcuugccacauggcucggcguuuucuauugugccaagguugccagcguccgucacccacucuucaucugguugaagaugaggauauccaagcuggucccauggaugauccuggggucucugcuauauguaucuaugauuuguguuuuccauagcaaauaugcaggguuuauggucccauacuuccuaaggaaauuuuucucccaaaaugccacaauucaaaaagaagauacacuggcuauacagauuuucucuuuuguugcugaguucucagugccauugcuuaucuuccuuuuugcuguuuugcucuugauuuucucucuggggaggcacacccggcaaaugagaaacacaguggccggcagcaggguuccuggcaggggugcacccaucagcgcguugcugucuauccuguccuuccugauccucuacuucucccacugcaugauaaaaguuuuucucucuucucuaaaguuucacaucagaagguucaucuuucuguucuucauccuugugauugguauauacccuucuggacacucucucaucuuaauuuuaggaaauccuaaauugaaacaaaaugcaaaaaaguuccuccuccacaguaagugcugucagugagagagaaguuggaucaguucaaagaacccaugauucaaugauuuacccaugccugccacacuucccucagccagacaaagcagccuguucauaaauauacaacauguccccuucaggccuguu

SEQ ID NO: 17744 - RNA, 6614 nt, Homo sapiens
agugugugaacuccuugcuguuucuuccaugcuuuagaacugcgaaggcguugcaacagucagccuguuucccaccaaagaacuuacccuuucuguuaucucaaccacauauucauaaagccuguccuucagcuugaaagucggaaaaccaggccgggcacgguggcucaugccuguaaucccagcacuuugggaggccgaggcagguggaucacaaggucaggagaucgagaccauccuggcuaacacagugaaaccccaucucugcuaaaaaauacaaaaaauuagccaggcgugguggcgggcgccuguagucccagcuacuugggaggcugaggcaggagaauggcgugaacucgggaggcagagcuugcagugagccgagaucgugccacugcacuccagccugggcgacagagcgaaacuccaucucaaaaaaaaaaaaaaaaaaagaaagucggaaaaccagaaaccagacaggaugaagcaaggaagucuggggcuauucaaaccagugucauuucccaaauguuggcaccgaaucaaggggccuucacuguaacagugugugcaucaccacaucuaggcucuggacagcuuccuaguaggauuagcuguggguccucaugauuauuuaacuucagaucuauuauuuuaguagccaauuuuucugcaaaaucccuuuaaaaugguuagaaaaaugucauuguuuguucuaaggcccuuccuauuucugaaaaauacuaagaacacaagggugcucaccuuucauucuuugcagcuugauaaaacauaauguuuaauaccugaaaugugguuccaaaguacagacauacacuuuggaagaaucagcaaaucuucuugcagaucuuugaucuugcauuuuuaaucauaaaaaaggcacaagauaauagcuguguuucuuaaguaauaaggccauugucuaggacccagaguuguuuuaguauauaucugagagauacuaauuauguaauuauuacuaucuguaaugggagcuucccagcaggcagcuuguccccgugggacccucaaccuagaagggcuuucccucugugcucuaguguuugugggcuggaguucaugggccagaaauacacacccacgcacuugguuuauaaugaauguauguauuguauaugucuuuagucauuaaauggagaguuggcugggcacaguggcucaugccuguaaacccagcacuuuaggaggcugagacaggaggauugcuugaggccaagaguuugagaccagccugggcaacauagcaaggcccugacucuacagaaaaguaaaauaauuuaauuaggcaugauggugcauacguguaguuccagcuacucugguggcugaugugggaggauugcuugagccuaagaguuugaggcuguggugaaccgagaucaugccacuuguauuagucugcuuucacacugcuaugaagaaauaccuagaccggucauuuauaagguauagagauuuaauugacuuacaguucugcauggcugaagaggccucagaaaacuuacaaucauggcagaaagugaagaagaagcaagcaugcaccuucuucacaagucagcaggagagagaguucaggagaaacucacuuuuaaaccaucagaucuugugagaacucccucacuaucaggaaaacagaaugggagaaaccacccccaugauucaauuaccucccacuagguuccucccuugacauguggggguuacaguuugagaugagauuuagguggggacacagagccaaagcauaucacuacugcacuccagccugggcaacagaacaagaccugucucaaaaaaaaaaaaaagaaagaaagaaaaggaaagauuuaauauuucagaagugaagagaggauggucacuaaaguuguuuccuacuacugagaggaccugagguccuuguugccuucugaccuuacuugaguuuuuaacaaguaagaucagaagguaacaaggaucugccauggugucaaggcugccuccucuaccaucucugcuuucaaaaauaaagcugagaugugauaucuggcucucagucagcaaaacacucauuacaaggucugcuucuucugaugacaggguauuucauuacacaaaacuaugucugucaucccacccaauguauuuuaucacauaucaagauacacuuuagauaaguuaagcauauacaaagaaggcaacaaaagacaauaaauuaugucauuuugcacaaaacacaggaaaggaaaccauauauauuucuggguuauauaggcuaccauuuugaaaaugagaaauucauauuaucuaacuauacaucucuuucuaaaaaucugucucuuagaaggagaugaccuagauguaaaugauuugcauuaauauacaucaguauuaacuuagguauuuaaaaaaacuauugaaauguaauuuucuuccguguuauuuuuuaacugaaauggaacaagggcuuaauuuuauugggcaaaucuaucauauauaaucauuucugauaugccacugguugugauguguaccacugcuuuauauguugcuaagaaacaacaacaacaaaaaacacucucauggauugcaagaugccaguuuauuuuagagaugguaaaauacaaaaaaaagcagagggaaguuugcaaucaguaaacacuguuaccuacuucuacguauauagaucauagagguauguaucucuuuccaaaggaaauuaagcuuuauaagcugagggauuuuugaaugagaccaaauauuuuauaccucauguaaaagugcaagcugcauaaugaaagacaggagauccuguuacauugagugcaauaagaguuacaggaauauugaugauggugagucaaccucagacccucuugugugugacccucccaaguaaacuuucacaaaccuuggaucaaugacauagcacaacugaguuucccaaaguuaguguucuagucaaacuucaugcaguggcugugacuuauggcugucuuagaccauuuauguugcuacaacagaauacauaaggcugagugauuuaaauuggacagaaauuuauuucacaucgucuugaaggcugguaagucuaagaucaagguaccacuacuuagucuggugaggggcuucuugcugugucccgccuagaagaaguugggagggcaagagacagccaacuuucuuugucacaacucuuuauaaggguaccaaauccauuccugagguaggagcccuccugaccuaaucaccucuucaggauuccacuucuuaauaguaucacacuggaaacaccugaauuuggaaggagcacauucaggccauggcaguggcuuaaauccucugcuauccagagaguuugaauuggauaagggacccccaauaaauauuucuagggaauuagggacuuaaagaagacuuauuuucuacagagggaucccuauuuaaaaauguuuauggguuucuauaguacagaugacagggcaauaguuuacucacauauugauuaauguucuguuugcuuauaaaauuguaauugaaaacauuacucucaguuuaagagauuugaagugcaucaguaaaaucuaaauuggcauaucuagacugauuagaauaauauauauguccugcauaaaucauaauguuguuuaacaaggguagcauagucuuaggaaucuacuugaguuuuauuuaugcaugaauaccauccacacccuuuguggauacaugaugaccaggguaccauaugauguaaugagucccuauuccaaaaugcaucauguauuauagucugcauguucacuccccacaaauaugauguugaaaugugauccccaguguuggaguugggaccuggugggagguguuuaggucaugggggcgaaucucucaugaauggcuggauucccucucuucaguaaugacugcauucuugcucuauugcucacaugacagguuuuuuuuuuuuuuuuuuuuuuuuuuuuuuuuuuuuuuuuuuuuuuuuuuugagauggagucucgcucugucgcccaggcuggagugcaguugcgagaucucagcucauugcagcuuccaccuccuggguucaugccauucuccugccucagccuccugaguaucugggacuacaggugcccaccaccacacccggguaauuuuuuguguuuuuaguagagacgggguuucaccguguuagccuggauggucucgaucuccugaccuuuugauccacccgccucggccucccaaagugcugggauuacaggcgugagccacugcgcccagcugagaguugguuguuuuaaagacccuagcaucucucacucucucucucaccaugugacacaucugcuccccuuucaccuucugccauaauuguaagcuuuguaggaccagaggcagaugccagcacuaugcuucuuggccagucugcaaaacugugaccaaaauaaaccucuuuucuugguaaauuacccagccucagguauuccuuuacagaaaugcaaaaugagcuauacaucauguaauaaguaacaaaauacaaggagcaaauaaacaccuagggggucuccuaauaacaggauucuccucaaugccauuauguaguuagggucuuuagaauaaaaggggacuuuagcagugaucaagcccagagcccucuuuuagauggcaguaccauagacuauagucuaagggguuuaucaaauguuccaaaacugcacugggaaagaaaccaggauuuaaauucaacauuuuugacauuauaccuaaucuucaggauaaugcccuucuaagcucucaacgucuuuccaaagcaggggugacacggucaucaccaacagaugaugcuuagagaguaggugagagauuauuucugaauuuugugauagaaucuuaauauaagagaaagaaaagagaacuaagguuuacuuguaugucuggaacgugugcucagugccaugugaggcaacuuucaauggauuaucucauuuaacguucacugugauccccagggauggauauuuuugcuuccauuuuauaaauggaagagguggggcucagagguauuagauaacuauugccccaguucacccauccuaucagaggcugcacagugcuucagcuuaguucuuuuuggaggcacugcauuuccuguguaacucauuugcagagauaggcuuagggaugaugcuuaguugauaucauagcaugagacaagcuuucccgaggagcauaucuaacauucuguuuuguuacauucuauggcaaaacguacaugaaaauuuuaaaaaggaagauuuuuuuuuaauuuuugaaaaaauaucagaauagaaaaauaagacuucaauuaagucaugaaacaauagugguuggaauauaguaagaaucuaaagaugaacuccagggaccucugcacucaccaaaugcaucuacauccuuggucaguugaaauuaaugaaauggacaugaacaaaucaaauauaggauuguagauggugcuugguaacaaaauugaaucuuccuuagcuagcacuuggaaaccugcuauuuccuagaugaagggaaauuugcuauuacagaguuggggguaaaauuacuugaagcuaauuucuuugagagucucaccaaagaaggaucuacaaauuacuuuacagaaugaagugguugagaucauaggcucuggacuagcuuguuugauucuugggucuuuuacaaccagagugacuuugagcaacuuacuuaucauaucucagcccauuucauaucuguagaaugggcuguaggugcuacagauguguugaagauucaaggaguuaauacauguaaagcacagugccuggcauacacgaaacuaccacuacaugguauaugucucacuaaggucuaauguuuaauauuaaauaguauaauacacauaccccuaauagaaacuuucauugcagaaaucuggaagauagcacaacuacagauaauuuauucuagauaugugucugaugucuguuuaaggaagccuaagaaaauauaaaaauaccuauucauaugaaaaaguaaagccacagaacuuagauuguuauucauggaucugcuuucuaggcagauucuuacacgaauauacucagggucaaaaugagcaagugcuuaaaugcaacacagagaaccugcacccaaagacccauguacuuuucuaaggauugcaaguccucauucugaaauguaguagaaccaacuacagugauccuggauugaaaacgcugcccuuaaagucuucaacuacuccggccauggccagaaacugaaucucacauucuuacccugccagagugcaauugcuguguguucucacugugauuugcccaaugcaguuccuuuucuuuccaggguuugguaacuguuucugcacuauuuuauuugccucuuuccucuucauucuuucauuagccaucacuuauuucaaguucuuccucuauuucccugugccuuucuuaugagcuccucuuuugccgauucauauauuuggaaagagaacauuuauagcaucucuuugcuuaagacccuacuaauucaugcuaggccaaaagaaaaugaacaaagaaug

SEQ ID NO: 17745 - RNA, 118523 nt, Homo sapiens
ucggagcugccaaucggcguguaauccuguaggaauuucucccggguuuaucugggagucacacugccgccuccucuccccagucgcccaggggagcccggagaagcaggcucaggagggagggagccagaggaaaagaagaggaggagaaggaggaggacccggggagggaggcgcggcgcgggaggaggaggggcgcagccgcggagccaguggccccgcuuggacgcgcugcucuccagauacccccggagcuccagccgcgcggaucgcgcgcucccgccgcucugccccuaaacuucugccguagcucccuuucaagccagcgaauuuauuccuuaaaaccagaaacugaaccucggcacgggaaaggaguccgcggaggagcaaaaccacagcagagcaagaagagcuucagagagcagccuucccggagcaccaacuccgugucgggagugcagaaaccaacaagugagagggcgccgcguucccggggcgcagcugcgggcggcgggagcaggcgcaggaggaggaagcgagcgcccccgagccccgagcccgaguccccgagccugagccgcaaucgcugcgguacucugcuccggauucgugugcgcgggcugcgccgagcgcugggcaggaggcuucguuuugcccugguugcaagcagcggcugggagcagccggucccuggggaauaugcggcgcgcguggauccugcucaccuugggcuugguggccugcgugucggcggagucggugagugggccaggcggaggaugcgcgcgccguuuaggguguuugaagcuacgagaggagcccgcagggaauaggggagcgccaccuggggaacccccaguccccaaguauacaccggagauccgcugggacaaaugcgcucguccggucacccuuucccccucuucccuuccucagaaaagcgcugcucgcuggcguuaccccgcgguccgcgggaaugggggcaccgagaauugcgguuuggucuagccgcagaggccccugaagucacucccaacuucuucgcccucggcgggucuugcugcguggucugggaaggacggaggggaaaggguggcaggaggggggagccugggucgggcccgcgagggaacggcuccacuccgcgcgcuccucgagaccagggaugaccuggaaacuucggggucccuuccuccgcacaccaucccccccgcgccagcuuuccuguuugacugcaugcaaguucuggggagaugggggccagauuuaagagacccgcgaguguccagagagaaaaguuugcaaaaguucuuuuguuugaugcucccugcggcuagggcgagguaaccgacacuacguggaaucgcaguaggcgaucccucaaggggauacugggggaggcacggaacgcguccgaaaaugcugggacgccggccacuggauucccaguccugcggcgacccccuccucguugagggguggagguugcaccgcggggcgucagggacgggaggacauuuucauaggaguuacacgggagugccgcaagcagggcgaggcgggguacgugugacacggcgcucggcuucgggucgccuggccgcugggggacagaggcuucccucccgccacgcucgcccucucuggcccuggcggggcgcuucuggggccgggaggagucucgucuccggcggagcgccugccggcacccagcuucccucccccgcccuggcggugggaacuugauuucuccuuuuggucgcgcuucgggggcuggagcuuguuuccccacgucgcccaaugagcgcccucuaaagggaacugccuccuuggccuccucucguccgcagcugccuccaccugggcgccaggagcucugucgggccagguggaagcuugagcaccccagauuucgucugcagccucagugcccucuggggucucagggagugcggcuguuucuggcccuucugguuccccacguccucucccuuugccauuuaauaacgugucaauuucuaauuaauugaauggucuuuucaaagacaaauuauaucaucuuaaggucuuuuagguaguuuuaugaguuugagucucccucccccccuuuuuugugcugaggcuaauuuaggacugggaaaccucuuuggcaucgagcggcagauggacauuuuuaaucagugugggagccucugugugugcuagcagauccccauacguucuuugugguuggagagcauguagaauuggaaacuguacagacuacaugaguauuuugggugcucagguuguaaaauagaacucccagccuuaucaguguuucccuuuggcaaaugaugguuuaauccguugguauuaguuaucucccagccaguuaggaugaacuuuggcucuuuguacaccaaaaggcagcaguucucuuguuuauuucagaugagcguuguugcuccucuuguugcaaaacagggcaaagggacuucaucuaauaaauuucaagagccugccuaaaaaacugcacaugguuaaggaggcccuuuuuuuuugcugagucuuauucauggauuugcuaggaaauguuacuguuuugggauucuggagaaagaauguuucugucuucugcuccucuggguuuuugcauaaaucuaccagugcuccuuaaggaaguuuuuuggccgaacuauauaccuguccuccccggugacagcuuuccccugaacuguguaucuuugggguucuaauauuucucaauuugaaccagaacuggaugcuuuccgagugaacugcuucauugugauagacacuguuuucaguaauuggaaaaucauccaaaaagggugauuagauauuuauaaaaugucaacuuagagacuagcagagaaucuuuguuaggcagugagucagucuuucuaaauagaagcuguuucaaggcccagaauggcuaacaguccauuuaaauuacuuuucagucuccguuuguuucauguauagcagcaaaaauauaaaugaagucaaaagacugaauuuaaaaaaaaauuagcaauuacagaauauuauuuccaggacuuugcauuuuaauuugaaaacugcaacuguuuccugggauuuagaaguagugauuuggguuuaaagucucccuuuaaaggaagaaaggaaaacugccuacaguuagugaauucuuaaguuuuauacuuagcucuggggguaaaaaagagguucucaggaacuaaggcucaaaacugccuaugaaaaggaacugguagcuguuccuuuauggauccuggaggcagcugggaaagccuguuccuagugauccauucauacuuuccacuggcagguuaggacuuuggcugcggagcaccaggcaaggggaaaaucugacugaguguggcaguagugauaugcugcugguuuucuguccauuuuguacaugacuguuuaucuuuagaaauaauauauugcagacugcuauaaacacauaauuugaacuggaaauauguuuaagaaaaggaaguguuuugaacuagaggaauuuuauaaacauucuuagaugucuguaaauuaaaagaaacugucaagucauuugggcccaugcauuaucucucgguguauuaugaaaggcaggcucuggaaaguuugcauuagaaggguaacuaaaaucgaaaucauguaacuuugcaguucuuuagaaaauauaguuuggcuguuuuaugagugaaacaaauugcuuuugcuagggaauuuuauaaaaacaagggcucuuucucucuuaguuggguauuagcagaaggaggaugucauuuaagaaggaaagaucuugaaagaucaggcuugcagaaaauggaugucugagaagcaauuugagcaugcccuucagcuucugcuuuuaggaccugauaugucuaguuuugaugguaaccacccuucgagggguagccuacccuguguaauaugaucacuuaaauggcgccuuggauaaucauuaguuuggaaaggauuucaaaaggugaacugguuuguucccuggguggaacuaguuuucaagucuccaaaagcccccagagaccugacuggccagcuagagguggcuuggagucuccuuagguuggcaaggccccugaagcugacccagucacacagagccccaccagcccugucauuaagguuuauagcaaguccagucaagccacugugcuguuggcauaccugcugguggggauccaguuguccugugaggaaugccaucuggguuuagauucucacuagauuguccuucuuccauugccaaaaaucaaacuaaaagauuuugcccauccuuuucuucuucccaaggcagaagggugcauugcagaaucuccaaaccacugaauucuuuucguggacuagaggccaaaauaaagucuuagagaaaagccagaaguaaugaagaagaaucuuugcuaaaaccaaucuacucuuauuuaacuuuuuuagucaacugugacaguacuaucauuuucauucuaaucauuuggauuuaaaucuugaagaagcccuggacucauucaucuuuguugguuuccacguccagucugccucuaaguccagcugugcauucauucugcagauauuuauuucauaccuacuaggugcuugagguaaagcagugagcaaaccaggcagauaucccccugccuucuuggagcuugcauucuagugaucuuuccguucauuuuuucaugccuucaguggccagcguggaacuuccucaggagugccaaccggccccagaaugcccuggcccaugggaaccugcacuuaaagaugcagcaccaacagguguuuacccagcuccugaccugagcucagcacugcaaagaagucgggguuuggaaauguggucccuuccugcagcgcuaaucuuuuuuuuuuuuccucuugagauggagucucacucugucacccaggcuggaguacaauggcacucugcaaccaccaccucacugcagccaccucacugcaaccaccaccucccagguucaagcgauucuccugccucagccucccgaguagcugggacuacaggcacaugccacugcaccuggcuaaauuuuguauuuuuaguagggaugggguuucaacguguuggccaggcuggucuccaacuccugaccucagcugauccaccgccucggccacccaaagugcugggauuauagacgugagccacuaugccuggccauuggucucuuccugcagcacuaaucuugaugggacagaaaauuucaaaugaagagcuuucccucuuuuuuucuuccuugggggcaugccagcuugugcuucuaugucaguagccuuguaguugccauuccuggcccagacacuugcaugcaguuugguuuguccuccaccacuuugaucauguugcccauggucuagacaccuccguguccuuguuaucauggcauauagucuguaugccucugcuggauuuauaagcggccccauaauagccuuccuuucugguuacccccuugaucacuuuccaccacaucucccagcccuggcccauugauaucacuaucaugaacacucccuggacauugcuacuuuuucaguguuucuccuuuuaaaugcuauugauuaaaugcaagcuccaaauaccuuuucauggcugauccagcccuguuguuuuuaauccuucuguaaauagcaaggcauacugaugaucagaaucauugaaaguaugugaaaauacagauuucaggccuccucucagacuuacacaaucagaaaccugaaugggggugggagugugggggaaacuguauuuuuauaaagcgacugagaugauucuaaugaaucagacuaauuugggaaucgcuggucuagaucacagcauuaccccuuaauuaugugcuauucuauguuacuacuagaguuuucagcaguagcugggcuuagaauacaaagggcuugggcuugggagguggacaagucuggguucagaugcugguaccuugccacuuaaugugucagaacuuggacaguauauuaaagcucugagucacuuaaaaaaguguguguguguaaauuggaccuaagaaugccuuuauaacaugacuguugugaagaugaaaugaagggagcauaugaauggugcuugaggcacggaagauaggacauuuuuuuuucuuccuuuccucucuuggccuuuuuuuuuuuggcaaugaaaugaaugaaaugagggagccaugucagauguucuuaccucucugacauucuaaauaggugaauuuucucucccaucaagguuagugcuauaggaagaaaccauguuuccaaaucuccuacuccugugcagugcugagcuggguaaacaucuguugacacugcaugcugaagugcagauacccgugggccuggacauuuugggguugguuggcacuccugaagaaguuucacgcuggccacugaaggcauuaugguucagggucaacugaauacaccagcccccaguggaccugggcuaguuguccaguuuugaugccucugcacucagugucaucagcauugcaggguuggugucaagaauaaagaagacauugauguaacgucuugacacaucagcugugcacagucacaccuccuccucuucccugaggcugugcugagauuccagcacaugggaaggagagaguuagaauuuagucuguaucaugcguugguaugccguuggucauuuagaaugagguggcagggguagugaguauauuuuggggaucugggggcagaaaagggauuauuuuuauuuuuuaaguguggaaauguggccuggcgcgauaucucaugccuguaaucccagcacuuugggaggccgaggugggccaaucaccugaggucaggaauucgagaccagccuggccaacauggugaaaccccgucucuacuaaaaauauaaaaauuagccgggcguggugaugggcaccuauaaucccagcuacuugggaggcugaggcaggagaauugcuugaacacaggagacggagguugcaaugagccgagaucaugccauggcacugcagccugggcgacagagugagacuccaucucaaaaaaaaaaaaaaaaaaaagaguggaaaugcauuaaauuucuucuuuuagccauugggcuuuaggucuuacuauuaaaaaucucaacugcauuuugauaagucuguuucuaggcagcauuagcuuuagcaacaaggauggaggggugaaugccucugaaugggagaggacacuguugaaauagaauugugaaugucuguuuuucucaaguaucucaaagaauugguaggagugggagaagagagaagccuugaaaucuuuggagauuuuccauuugcauuucacaucagcagagugaagccaaugaguaugcagcugguggcgugauagccaaugcauagucuuggaaaaauggaaaaauguuauuaaagacauguuuucacaguuuuuuucucuacuauucagucuauuuugugaaaaaugucacaaagacucaguaaguaugcucucuacaaagcauuuugguguuuuuuuuuaugauuacacagguauauuaaauacaaguaaccgugauguuuaaggagugugugcaauuaauagaauuuagucucaugguauaagaaugacacacgggacaagauacgcaauuauuaaaggaaaauuuuuuuuaagggaaaaguuaaauacguauuucuuuuuuuuuuuuuuuuuuuuuuuuuuuuugagacagagucucacuccgucgcccaggcuggagugcaguggcauaaaugaggcucacugcaaccuccuccccccguucaagugaaucuccugccucaaccucccgaguagcugggauuacagugcacaccaccacgccuggcuauucuuuuuuuguauuuuuaguagagacgggauuucaccauguuggccaggcuggucuugaacucuugaccucaacugauccgccugccucagccucccaaagugcugggauugcagacgugagccacugcaaccagcugaguuaaguauguauuuauguguaauuuguuauuaaauauaaauacaguagacuaaauauacaacauuuuaagucaaggcaaaagcaagguuuuauacacauguaauuaacugucuuaaucccugugagaccucaguuuucucaucucuaaaaugauggaguugaacgagaaaaacucucucuccuuaauauuuacuuuuucugcacuuuagggugugguaggagaaaugugaagauuaacuuaauaaguaauuauuaauccccugucaaauacuucuaauuuuauuauugaaacauggaauuuauucaccuuacagaaaggcaaguaauuucuaauagcucaugguaaccuguuaccuugaacugaguguucauuguuuacuaggagugguauacauuguccugcguauucgugaucuaaugucuauuuguauuagucuguucucacucugcuaauaaagacauacccaagacuagguaauuuauaaaggaaagauguuugauggacucacaguuccacauggcuggggagaccucacaaucaugguggaaggcaaaggagaagcaaaggcacguccuacaugguggcaggcaagagagcuuguacaggggaacucccauuuaugaaaccaccagaucuugugagacuuacuaccacaagaaaaguauaggggaaaccgcccccauguuucaguuaucuccaccuggccccgcccuugaaauauggggauuauuacaguucaaggugagauuugggugaacacacagccaaaccauaucacuaguauuuuuuuauauauuuucugauacaagccaguguaacauaaagaacagcugcgugguaaaaauaacuuucauucuagauagaagacuacaugacuugauauacugggggucuuuuuaaacuauaaaucucauaaaguguuuuagucuccucauaugguuucuggccuggaucuccauuuccagaguggggcuuuuaacuggugccuuccguuuggucccucucuagagcacuugagccuggucugaguacugugcagaccacaagcaagaaucuaaaugagcagacuaugguaguguugccuggguuuggauacacuuauuauguaaccuugggcaaguuuuuuaaccuucugggcucaguuuucucaucuguaaaacugaauauccuaaaauaaguuuuuaggauuaugugagacacaauaaguagggacuuuuuagcauaagggaauguccaugcguugugucacaugcuaguuauaauuccuggcuuucugcuucucugaagaauaagggcuuggcacacacauuaguugggcucaucugauaagcucuagcccagaggguggcucagcauaugcaugcuaaggccuacuuuuucauaacaggggcuuucuucuugucuugggguagacuaguucuacgcugagauauugggaauauguuuguagucagcuuuucucuaaaaguggaugaugugagaaaauaugccauuuauuauuucuggcugaugaaagguuccuuacagggacaggacaaauccguguuaagaugugaaaagcucaucuuucccaguaauuuuaccuccacaaaucuguccaaaggaaaucauuaccagguaaauaguauuuaaugucuuuguugaagucucuuacuuauaauaguuaaaaaaauggaaacaacccaaguguacaauaauagaguaauuguuaaauaagauucuaauuuagacacugaauaucauguggccauuaaagauuuauuugaaggguauuuauaacuuagaaacuauaguacacaaaaaguuagauauaaaccuauguauagugagaccuugguuauauuuuaaaagguguguguguguauaaagauaauguauauauacaaauccauacaugucauagaacuguguagauacacauacacaaacauacacagcaugaauacagguaaaacuaggaaaaucagaauaagauugguagauuguaucaauaucaauaucauuguugugauguuuacuguaguuuuauaaauguuaccauuggcggaaacuaggaaggggcacaagagaucuuuguauuauuucuuacacugugugugagucuauaguuaucucaacaaaaauuucaaucaaaaaauggcaccagagcuagauuguuguuuaaguaaguucugcugauccuucagagaaagauauguuauaaagcucagagaaugauagaaggcuguucuuucucauuuuaggagguuagcaucacucuaugucaaaaccagacaagaagagcagaaaaaacaaaccuauaggccaaugucaucuauauuagaugucaaaauuuuaaauagaguauuauuaaauugaauacagcaguuuauuaaaagaauaaugaugagcccaauugggauuuuuccaaggacaguuucaacaucagaaaagcaaugcagguauuaacaguuuaagggagauaacaauaugaucaucucaacagaugcagaaaaagcaucugaccaaaguacaugugaaaguauuaauauaaagguucccaaauucugguuaacugaaggcauauuauauuuggcuaguacaucugugcuucggacucaauucacuugacauguuuaggaaccaaaaggccucuguuuacaaaguuguuaggcaacagucucuaguugcaugagugacaggugugugacaacccaauaaaggaugggccaugacauauauagauucuaauucauauggaguuguucuagcauugcccagguucacuguguacucucccaaauuaagaaaaugcaagagaugguuuugaauguuuuagaaucagauaaauugggguucaguuucugguauuaccacuuaaaagccaugagaagucucuuaucaucuccaugcuuguuucuucagugugaaacugggauuagaauauuuugcuuuuugguuauuuugaagauuagccucaauaaugacuaaaaucuucuaacacaaagcuugacccauaguaggugauuuaaaccuguugguuucucuuuucuuccaucuuuaaguuuugugauucugcaguauauuauauguuuauguauaaauauauacgcauauguuuuguguuucucacuugcauccugacucuuaacacuaugggacauauauuuucacaaauuuagaacugguuuuuauuuuuauuuuguauuuuuuuugugugugugagcaacaaggcuguuuauuucaccugagugcaggcaggcugaguccgaaaagagagucagcgaagggagauagggguggggccguuuuauaagauuuggguagguaaaggaaaauuacaguuaaaggggggcuguucucuggcagacaggugugggggucacaaggugcucaguaggggagcuuuugagccaggaugagccaggagaaggaauuucacaagauaaugucaucaguuaaagcaggaacaggccauuuucacuucuuuugugguggaaugucaucauaaaacugguuuauuuuuagucacgcaaguuaugaugcuuaauuauauuuuguauuuccccugucacccauauuuccugaauaauacuuagcuaaaacuugcauacaaguuggaaauuuaguuaagacuggaaaaucuuugguaguacuuggauuauaauuaaaauacuuaaagaaggucagcaucggaacccuaauuauuuuuauuauuuuuauuuuuuuuugagacagggucucgcucugucgcccaggcuggagugcaguggugcgaucucggcucacugcagccucugccucccagguucaagccauucuccugccucagccuucugaguagcugggacuacaggugcaccaccacacgcagcuacuuuuuguauuuuuaguagagacaggguuucaccauguuggccaggauggucucaaucuccugaccucgugaucucccugccuuggccucccaaagugcugggauuacaggcauaagccaccgcgcccggccuggaacccuacauuuuaaacacuguuuuauauaaauuuacuaaugaauuaaaaucuuaacuuuauuuaugucccacuucugaacucgcuuaaauaagaaugguguuuugauuugauuauuagauuugauuagguauugugauuaugcugauuaguuauugaauuaaguuuuguacucgauaaaucaguuuaacaauggacacacguuacuauaagccaacaaaggacaaagcucuauguugguccugcaaguuaaaaagaaauuaugacaugguacucaccuucaaguaacuacugucuaccuuaugauuauuuagagaauugaaaaugaguugggccagcacuuaaaauauguguuauauguaaaauaugcaucaguuuauguugaaucuaguucggcauuuguacaaucaaaauugccaaaaaaccacaauggagaauaagaagaaccccuuguagaagagaagucacuggucuccuggaaaagcaaaacuuuccuaaaaccuuccuugaaguggcacaguauguuggagaaaaaggagaauucuguugaugacuuggagacacuugauuuucauauguuucucuuuuucccaaucuucucuucaaagaaagacuuccaagugguaaaauguacaaaagguagaaagaguaagaaauuguuuagaaccugaaugaucuguugauauuucuaucaggggagaaaguaaccuuauauuucaaccagucuugauucuccauauucuauaaucuuuggggucuuaaaagugagagcugggccuuuguauauaucauauguaaucggguaaaaaguauacauuuauaauauauacuuauauauuauacacaucauauauuauauacauuacauauauguauccggugaaaacuuauaagagacggagucucauucuguugcccaggcugcagugcaguggugugauuauggcucacugcaaccucgaucuccugggcucaaggcauuuuacuaccucagccuccugaguagcuaggacuacaggcaccaguccuggcugaguuuuuguuguuguuguucacaugggguuucacuauguggcccaggcuguggaccuuauaguagguguucaguuagaucaaauagccuuagcuggccgggcacgguggcucacgccuguaaucccagcacuuugggaggcugagguagguggaucaugaggucaggagauccagaccauccuggauaacaaaaugaaacugucucuacuaaaaauacaaaaaauuagcugggugugguggcgggcgccuguagucccagcuacucgggaggcugaggugggaguauggcgugaacccgagagguggagauugcggugagccgagaucacgccaccgcacuccagccugggcaacagagcgagacucugucucaggaaaaaaaaaaaaaaaaaaaagauagcuaaguaaucaaagagguauaaaaguguugggauaauucucacuguauucuuuuggauuuugcuuuuuuaguuuuuguaacaacggauuuuagagcuggaauggacuuuuaaaaggaaacacauccagagagguuaagugauuuauccaagauuaccuagguaauuaguggcagaguuguaaauuuagccuacgcuguuuuauuaguguauuuucuuauaaaacauuccuuuucuggcugcuucuacucccucauuccccacauuaaugauuagcaccuaaugcacuuauuucuggcacauguuugacaaauaaaugaaauaccaugaaacauacauuuuacguuauacauuuagcaucagugugguuaguggguuuugugcagaauccuuugguguuuagauacuuuuucuauuuccagcaaaacugugcuccaacuaauuccuuuacuugcuggugaaacuucaggcuaauuaugggaagacaguugagaggacugagauuuggaagacccagagacugaaauagaguugauuuguaagucuuaggaagauuguggagauuuauagauagaaaaggagauaaaagcuuccuggagauaagaaucgggaccagaagcaaaauccucaugaauuaauacugcauuuucugggggaaagaaggcugcuauuguaguuaagagaaaacgaacauuccuuggauuuuuaugcuaaaaauaugucagugccuuccaggagagagucugaugcacuuacagcccagguagaagugcuuuuuuacccaauuccuuuugccaaucuuagauguaggcuccucuuuucucccaagaguuuccucuugaauauuggccggcugugguggcucacgccuguaaucccagcacuuugggaggcagaggcggguggaucacgaggucaggaguucaagaccagccuggccaacauggugaaacccugucucuacuaaaaauacaaaaauaggccaggcgcgguggcucaugccuguaaucccagcacuuugggaggccgaggcggguggaucacgaggccaggagaucaagaccaucuuggcuaacacagugaaacgccaucucuacuaaaaauacaaaaaauuagccgggcaugggggcgggcgccuguggucccagcuacuugggagguugaggcaggagaauggcaugaacccgggaggcggagcuugcagugagcagagaucgcgccacugcacuccagccugggcaacagagugagacuccgucucaaauaauaauaauaauaauaauaauaauaauaauaauaauaauaauaauuagccggguguggucgcgggcaccuguacucccagcuccucaggaggcugaggcggcagaauggcuuuaacacaggaggcggaggucgcagugagcagagauugagccacugcacuccagccugggugacagagcaagacuccaucucaaaaaaaagaaaaaaaaagauuauugguuuauaaauuuuaucauaacacaaauguauuugagucaagcuuuuucagaaaaauaagucugugagauauuuuuaaggaaagaauuuuauuaaaaggcaguaacauuaaaaauuaccauuaccacagccuucuccuacuauagauaggcauuuuccauucauugucuauaacugucucacaacugcuaggcgguauuacuugccaaggcugcauuuuauguggcccagcacaaguuagagccucaguuuuucuagcuuuaaauagucuuucuaugauacuguaaucuuucaagagagcagugaaagugucuaacuguaucaccaacuguuuaauguaguccaauggguacaacccuggaucaugaagugucuaaugguugcagccucaaaucaugaaguaucuaauggaugguugcagccccgaaucaugaagugucagaaucuuccuuuucauugguuggccuaaucuuccaggucacugauauucugauuucuuuaccaacuuuuagcauauugcuuuaauggcuucucucugcaaacuucagucugguaaugggagaacuaagagguagaauuaauggaaccucucuaaaucucagcucugccaauuucuggacuugggcaggugauuuaaccucucuaugcuuccauuuucacaucuguauaaaggagauuagucauaguagccaccucauagagguguugugagggcuaaugccuuaauuaaugggugucaagcaguaauaagagugcgcaggauagagccugcgcuagacucucaguguugaugaugauugaaauggacagcuaauuggauguacugaccaaagaagacagugucaauagucuuuugagguuuugaacaugaggcagagaagacugauggugccacugaccagaucaggaggacagaccgauuuuuuuccucuucuuuuuguggcucuuguguuuuggugaaaggaggaggcauuuugguuucucuagguuuuccaucuggguaguggagggcauauucuccaucacggguuuucagcccuugcugccgauuacauaaacuuggggagcuuuuaaaaacuauucaugccuuggccccacuccagacaauuaaaucaaaaucuaugugguugggguccagcucccugugaaagcuuauucucacuuccagaaggcuugagaaccuugcucuagaggacuucuuagucuccaguuuagagagcagccuagcagguaagauuuuguauucuuaacguaugcuuucuacugcugugauuaagccccauguaaugagguggcuuuccaggacucaucugcugccugucacagucuaagcaguguggaauugggaaauccuugcucccuuccagcuuuuuccuuuucuccagugucuuuucugcuggaucauacuuuuuucuuuugacuauuauuuugguggauuuggaaacauucgagaggucuuuagacagaagacugcauagcuauaaaguaaguuuaucugaggaugucuuuuaaaaaaaugcacacauugcccuuccugaaggaaaacuuuuccuaguggagcaagggacacucguccucuuggucugguuacagaaaagcauguuuggccagcuuauuagauuugccugaguucauacuuugaacagaaaaauugcauguuuuacugauuggaaauacauucugggacuugauugaauauacugaucauguauagguccuacauaggugucuuaauaauggucuucuuaccguaccugcacuuaaguucagcaauuuggaccugguucaagucgcuucaauuccauggagcuguauuguuugcagcugaaauaggaagagagagugcuuuaggcugucuugugagcaagacaucugaguugucuuuaguucaugcuuaagcacaaaagcagcagcccaucaucuaaucuauucauaguuuacuuuguucggguaucuaauuugggagcaugcuugcccucacucacuucuaaaacacacaauuugaauaaaagggucuaucuuuaauugacucagggaacaaaaccuuguugaagaauucuggauuucucaaagcuuuuaaaaauugcucugcaggauaacauuacaaugcugacccuacugccacucaacauguaucuguccuacaauggaguuggaggagggauuauucugagaaggcuauuaaaaugaaccauuuacuaugauucauaggcuuuuaaacccaguaagucuguaauaucuagaguaaaauucaacaucaguuuauuauuuuggugaugaugggguuaaagugucuuuacaaaguauuaagcaugcacagagaaaaugcaaaugugaauucucuucguucuccccguuaggaguguaugccugauagauaaauguuccagagcauucauguaauacaauuaguagauauaagugcuuuuucucaguggaaauugaggucuguuacaaggaguaacagauuaggccagugguucucgaaguagggacuaaucagcagcaucuacagcuccucggaccuuguuagaaauggagauucugggccucucugcagacuaagcaaucagaaacuuugcagguagggcccagcagucuugagcuuuaaaaagcccuucaggggauccuucugcaugcuaacguucgagaaccucugagcuacgguucucaccuugacagcacagacacuauugagagucccugguuguggggcacgggugucaguauuuuuguuucuuaagcugccuuggugauuccaguguucagucaggauuagaggcugcugcucuaggaccuugcuacccaaaaugagggucccagaccagcagugugggcaucaccugggagcucuuuagaaauccaggcuaucaaaccccaccugagacuuacugaaucguauuuaaguuuaacaagauucccagugacucauaagcacauuaaaguuugugaaacacugauuuauagaaauagugaguuuccuuuguagaagccagcccuuagaacgcccuuaauuuaaaaguuuugugaggagguagaacagcuguuuuggcuucugccuggcagugacucagggaagcaaucacugggggcaaggcaaggcuccgaaagcugugaaggacccaggaccauuucaucgagugagugcuggugcaaguaaugaaaaucccaacucagauuggcuuaagcaauggaaacuuuuugguucagauaauggaagaguucaggaguaguucuguuuucagaucuggcugcaucaagaggcuuaugugauuuuuuuuuuuuuuuuuuaaucagccucaaggcuuacguaacucucagcucaaccuuacuuuguuagauucacuuucagguuuuacagaauuagaguaacagcuaagcuguuguuaaaaagagauuccuaaacauaguggcuuaaaguagauuuauuucuguuugacacaacagucccaagacaggucuggugggauagcucugcugugcucacacgcaguucuuaccugcugguccaagguggccaguccauccauacugucucccagccaggagacagagucaagggggagaacauacccauuccuuuuaaugccacagccuggagggguaacaugucacuuacacuuauaucccacuauuugcagcauagucacguggucacacaagguacuaugcgggcugggaaauguagucucuacauggguggccacgugcccaacuaaaaucuggggauguuuuguuacuaaaaagggaagacuuuagguauugaugacaaccaggagcgacuucuccucuggugguggcaagauggagucuggcaacuucaaguuaacagccuguccugucagcaguuucaguagaaagcacuacucuuuccuaguucuuccaguaagaaucccagaauagcuuccuaguuccuuaauuucugggaacuacacaugaagaaguguccccagaaucccguggacugugauagaaaaggauugguucccccaaagagaacuguuuaauagcaggcuuagaacagagagaccuuuaccucacuccuuugugaauuggcauuuagacccagacaagaaaggaaaguggagaacaugggggugcucaagccagaugugggggcauugggggcuauuuacugucgaguuagucaagcauggaauauuugaagauuauuagcacgugacauaaaggguauuuaggaauaaauguguuugcugaguuuaauaaacauaggagacuguaacaguguacuuuugaucuucugaucucuuauuuuagugguugguaaauaagaguaaaagaaaauauaaacuuugacaaaugcuuuuaagaauguuuuaaauuauuuaaucuuuaauugcuaaagauuauguaaauagaagccuuuagugcaucaaacgaugaguguuggagagaugaugaauugaacuuguguuuaccgucuccuucucaagguuuuguuuucuuaguauguuuuuuauacuuuauacuuaguacuuuuuuauacuuuauucauuacacaaaggauuugagguaauuuccaagacuaaggccuuucucgcaagcuuuagaagaaaauucuaaaagcauacuacauccugcuuuuaaaaaaaguugugacagucuuacaugauagaaaaauaauauaucauauucaaaauaacaugguauuuccaagguucucaacugcuuauuguccuuuuaaugaaaauguggauuguaggcacaucugcuauaaaugaauuaaaauuucauuugcccagaacuuuguguauuccauuaauaagauuuacccaaaacacuauuguugguuuaauaaauauuaagagagucuuugggaugugccuccuggcguuuguuguuucucuccuuugagcauuaacuacccuucugagccuucacaggcugcuuuuguuguuuugugccuugagauauaaauagaggcagaaaacccagaagaugcaaacagauuuaauacuauaaacuauuuacagauguguuuaguauucauucaauagaaccuuuuaguuuauugaauauaaaccagcuuuagcauucuacaugugccagggguucuguuuuuucuuuuauuggaaauuuuaaaaacgacaaaaacaucuuuugguaguaucaucaucuaauaagcaugagaaagauguaacgucaugacuugcaccugacccuuugucuucuuggaucuuacauacuuuuggacaaccaagagugaaaaggguggaaacuuccgaucucgacugaguaaaaggaaagccuuucuaagaggcagucaaagauggaacaggcuacuuaagcaggaggcaggacccauaccuggagcuaagcugguguuuguuuggauggcuguuuacugaggaucuuuagaggagauucaagccaucaacuggcuggggagagucgcugaccuuuauagcuuccuucuaaccuuagaagauucuguacgacauuuuaaaggugagugcugagcaacuuaaacuauauuuuauuuccuuuccugauaacuuggucugacugagacuagacaucuuuuguugccuauaguugaaggagucuggcauucuaggaccaacuugcuguuaaacugauggcaagaucucuauuugccaaaguuaggggacuguguauguaaccauugaaaucuaacauuaccucaaacuucaagggacucugacagguacuuuaaccaguuagaauggcacacuugacuaucugguuugagucagagcagugagugccugggagaaaacagcaaacucaagacaccaugaguggacuuuagggagagggaagagagacagagggcccacaggccagcacgaagaauguaaagggaaaguagccacugucccaaccugccagggguuugggaggcacuguuaauuucccaagcauucacuuauccgcacuuugaccaggcaacccuucuucggcuggacagggacacucaugcuggaccuugaucacccaugacccaugugucauagugcagagcuuuccuucugaggcuuaagugaccagugugacaagaacccugaaacaccuaauguacagaaggacucuagguccaugguccccaaccuuucuggcaccagggacugguuucaugggagacaguuuuuccacagguguuaggggggaugguuuugggaugaaacuguuccaucuuggaucaucaggcaucagacuccuuucacaaggagugugcaaacuagauuccucgccuguguaauucacagggguuugcauuccuaggggaaucuaaugcugccacugaucugacaggaggcggagugcaggcgguaaugagauuggauggcuacucaccugcuguggggcuggguuccuaacaggccauggaccaguacuggucuguggccccgggggucggggaaucccugcucuagucaugaaccauuugucucccucuugauuuuuccugugcuagcgcucacuuccauguuuccuucuuuauucuggguaaagcaagagaaugcuggacagguagccagaagacuuggguucuuauaggcuggccuuucucugccaguuaccagcugugaccucuggcaaaucacucaaccucuuuuaccucaguuucccuuuuuguaaaaccagcuagucucugcagucaaaccuucaauaguucuauaauggcuaugcuuuucuuaaggagucgcuuuuucccccuacuuucuacuuacugccuugcaaugaaguuuuuaaaauuccaguccagacuuuaacacuguguucuauucuccucucuucuccuuuggcagccaacuaaauugguuacaguugucauuuagaaugcgguaaucuuucaugacuaaccauuuccucucuuagagaugccacuucaucuagcugcuguagcucggauuucuuccucacagauaagaggauggagguugcucuugauaugggaaauagaaggauggagguugcucuugauaugggaaauagaagucggaguaggagguaaaguuccacuguagagggaaaauguccaccuguuagagacaggaaacaacuggggugcgaagggccagcuguccguguucuguggaugaaaauucccagcagauuuuuucuguauuuuuggcucugaauauuauacacugaacauagagucuuguccuggaaucugauaguuuucuuaaacacuggacaagugaauauacuccaaaaagaucaugaggccacggguauuguauucugaggucccgagaaguugaugaaucuucucucccaaaggcggauauuuuuaccagugugagcuacccagaaaauuuuaaauuugaaaaucucccaaaugcccaugauuuugauggcaagaauuauuagaggcagguggaaaauacugcccaacugugaucaugacacuuucaccaacuuacggcucccuagcccugggacuggccaaagaacccaguguugggcuggaaggggagcccuuccaggcugauggaucucuuugccccaaguacuguugucacacugccgguguucgaaucaccuuggggauugggguuauuuguuaaaaaugcacauucuugcaucccaucucagacccugcauuugaauguagcugaaacauacugaaguuacagaaucauugcuuuuggcugaaaaccuagaaagcuugcaauggcuuucuguggaccccaccucucugcuuaaccuuuuuggguuuuuaguucgggaucuaaggcccuccccucucuaaaaugcaaaaugugacacugagcuaaagaucaaaacauagcaagcguuaucuagaaauuauuccuuuaaaaauaguuuauuuagccaugcaauaggauaacugucaaacaauauuuuaugcuacuuagaguuguacauauagguacauaacauugaauagcuuuguugaaguauaauguaccugccacaaaaauucacccauuuaaagcguaguuuuuaguguauucacacaauugugcaacagugaccacaaucuaacuugagaauauuuuaaucacccccccaccucaaaaaaaaaaaccuguacccauuugcagucacuuuucauuccacucacuucaaggccuaggcaaccacuagucucccuucugucucuguagauuugccuauuguggacauuuuauguaaguggaaucauguaauauauggccuuuugugauuaacuucuuucaguuagcauguuuucaagguucauucauguuguagcacuaguacuucaucucucuuuauugccaaauaaauauuuauugugcauugcauauagucauacccccuuuuccauuuguuaguugguggacauuuggguuguuucaaccuuuuggcuauuaggaguaaugccgccauaagcauuuguguccaaguguacaaguuucauggggcuauauguucauauauuuccauuucuccugaguauauauaccuacgaguggaauuucugggugauaugguaacucuguauaacauuucaagaaacugccacacuguuuugcaagguagcuguaccauuuuacauucccaccagcagugcacaggguuccaguuuuuccacauccucaucaauauuuauuauugucuguccuuuugauuacaaucccuauuggguaugaagugguaucuuauugugguucugguuuucauuuucuuacugacugaugauguugagcaagauguguuuuuguguucuuagccauuuguauuuacucugugaagaaaugucuauucagaugucuauucuguggguugucuuuucauucucuuaauaguguccuuugaagcacacaaguuuuagauguuuaugaagucaaacuuaucaguuuuuuucuuuuguugcuuauguuuuugguaucauauauaagaaacacugccuaacugaaaauuggaaacaucuauuccuauuuucuuccaagaguuuuaugguuuuaguucuuacauuuagaucuaaaaucuauuuugaauuaguuuuugcauauguugugggguugggguacaguuuauuuucuucuuuaugcaugugguauccaguugucccaacacuuucuuagaaagucuuauucuuuccccguugaauucuuggcacacuuguugaaaauauauugaccauaaauguagggguuuauuucugcacucucaauucuguuccuuuuaucuguaugauuuauaugaaguacuauauguacauauuuuuguauguauauaugugugugcauaaauacacacguuugugugugugcauguguguguguguguguguguguguguguguauauauauaugcacacaugaaucuuaaaauuguuuuuccuguggccuuaauuuaggugauuagggaaauggacaagucaauagguaggaauuaaagacguuaacuacaccaggagacuugaccaugaagucccuccugccucagcugagcuaauuuaacagggauacaaagagccgcagaacgauugguuugcuguugguuuuuuucuuuuucucucccucccugaaauggaaugccuuucagaauguuuuggaguggggugcauuuuagauaucucuaguccuuggccuagcccugacagugaggucuuggcuaagauacuuaaugaguucugaaugccccuguccucacccuuaagcagcugauuuuucgaaguuuuguuucgcuucaugguauaaaaagccuagucaugugaucuuuguaauguuucuugguuauuuuaauuuuuaaugguaaaaaaugccugacagaaaaaaaaagaaaaacccaagacuuuccugugacacggugcacuucugccuuguggaccuaguuggagagacugccuuaccuugagagguuuuuuuuuuuuuuuuugagacagagucucucucugucacgcaggcuggagugcaguggcgcgaucucggcccacugcaagcuccgccucccagguucacgucauucuccugccucagccucccaaguagcugggacuacagacgcccgccaccaggcccggcuaauuuuuguauuuuuaguagagacagguuucaccauguuggccagauggucuugauuucuugaccucgugauccgcccgccucggccucccaaaguggugggauuacaggcgugagccaccgugccuggccuaccuugagagcuuuuaacuacagauaaagagcugaaacuucuugugaaaaugucuuaauuuuauucuuggguccgugggaauuuagaacuauaggcuuuuaauuguucacagcuggugcaugaauagagugguaauaauaauuaggaauaauaugguucaccuccuaagcuguuaguuuuaauccguuaaauuuuuuugaacugacgucuggcacagucuucaagugagaccauuuggaggagguccauccuagguuucagucaagaagugugcaugucugucuuguccugcuaauuuguuacagugauuucuaugguuugauuuuaauguuuuucaucuaaaaacacacaugcaaauccagccuacgcucaacaaaauccauccagacacucccacuacagagcccuugcgugacaauuuucuguaucuaaguuagagggagcuugcagccucuccuacaucccucugcggugggaggagccuugcuaggggagagaggggguuugcucuaagucucuuguaaauggaggccgacccagagugcccagagugcagugcuuccuguaauuccccagagagcaguuuggaaaucauaaagcugauuuacaguuauuuauucccugccccuccccccacacuauuuuuuguaaaauccucaaauuucaaaguauuaguacaauugauuagugauguuuacuuuucgucauuucuuaaugcuccacguuacagaaauuuuucaaaauguuucaaaaugacauauuuaguagagaauaaggauuaaagaaggaauguguucuugaagagugaucugguuggagguuguuuucugggaagguuuaacaaaauaguugucuuaggagaacacaucauaauaucacauuauuuaaugaaaccucuuuuaucuuagauaaucuaggggggaaaaauccuaaauuuacacuuaaguggugaaaaaaauuaaaucgcaauuuaauuauuuuuuagaaguaguauaaauuuuuuuuuuucuuuugagacagagucuagcucugucacccaggcuggaguguaguggugcaaucucuccucccggguucaagcgauucuugugccucaaccuccuguagcugggauuacaggcgcgcaccuccacgcauggcucgguuuuuauauuucaguagagacaggguuuguuggccaagcuggucuugaacuccugaccucaagugaucggccugccucagccucccaaagugcugggauuacaggugcgagccaccacgcucggcguuagaaguaguaguauaaaauugaugauaucaacaaguugauagcuucucauaauuuaugcugcccacuaauuuggcuaauuuaguaaauaguuguuaccuggaacuaaaugauuucucauaacaugccuucuuggccuuucucacgggacuuccuggaacaagaugacuuuuguuggguagagcugauauaagaauccagccaaugaaacuguagugacaacuuuuuacuuuuaaaaguauauauuguaaaaagcucucuugaaucuacaaauagaauccauuuuacuaaagcuaggguguuagucacauuauauuuccaagaaaacacaguauaauugucacuuucaagggccaucgaacugaaguagagaaagguggugacuuuaugggaacaccagauuaguauuagaaauuagcgugagaucuauacauuuagcaguuucuaaaggugauuucugcugcuucacucacucuuacuguuucuugaaguauugauugucaaagugauuagaggagcaguaauaauucauuuacagggagucuuacugccuuuuccuuuccagagccucuccucacauucccaagcuguuuauaugugauguucagcuuguggacagggugugugcuuauguuuuaaguauuugcuucuggagagcuagcuagaaaaagcaaaacagagaaacccauuggcguguugagaguugaauccacaagaagauguuguuugcaaugugccgaaaacauaagguccaaacagccggaacaggccuggugccaggcaauuucacugugagagaaagaggaggucugaugcaguucucuaaggauuagcugcaacucagcagcugcugucugaguuugauuaugcacauccugagaccugcauuaacccuugugccccugggggaaccucagggcugucuucuaaacaaaggacuuuuccccuggacacccaggggcaaaagccaaaacaauauggagguuaaaagaaggcggagcucugggagacuggauuugagagaacaaucuaggaaggaaacggauuguagaauuuuggaacugcaagugccuuuuaagacccuuucauuuuauugaucaagaagcagaggcucagagaaguuaggugacuugcccaaggagaaucagucaaaacuuaaguccaggugucuucauucccagcuaagcuguuucaugcagcaccacaucccuaaugggaugauuuucacauucguauaaauaauauguuguguauuuuugaaaacugcgcugagaggaaaccaaaagcauuuuugaauuauguguuaaucacuucuuauagacuguccagggauauucagauuuuucuuucaaauaacauuuuauuaguguguaagucuuaauaagugacagguaaauagaucauuccaguagcuaccauguaugauucauaaaggcagaacaggcguccugggaagguguuaggagggaaagcucggaucuagggagacugcucugaaaacaaggaaggauguuuauggaaugaacucuuuuguucaaccauggcgaugucuggaucagggcagccuuggaggauuuauggccuccagucuggagaagguaggugggcucgcauuaucuguguuguaagaaaagugugugaggucuuugagccuaaggcuguccagguaacaaaagacucugucaaaaaaauaugucuauuuagaguucuuugagaguaauauguugcuauuuauuucacaucugugucggguauugagcauuuuccuugcuuugcgguuguaacaagauccucagcuuucuuccuuuuaaagguuggggagcuaauuucuuguaggaaauaacacauuaaauccaagcguaucacuaaaacaugugugccuucucuuuuugcucaauuaaaagauugagcuguucguguuuuguuugauauggggguacuuauugaacauugucaaccuaaagcauuuugaguaaccaagagaaaaaucaggauggccuaauucacuaaaauuccaaguacauuugggauguauuuuuauacuucuuaauuaugagauuuuaaauugcuuuauuuuuaaagguugagugugagcugagugugugucuuuuucuguaguccuaccauccuuucugcaaaacucaagugaaaauuauuuauuuaggaugcccuauugagauauaguggaaugucuuuguuugcauuuauucuuuuucugggauuuugguuauaucuauagcuguaaauaaaggggaaaggaaggcuuggagugcauguuaggacaagaggucccaaguaggaaaaaaagucuugccuuagagcuaugccuugggaagugcuuuuuauuuaguaaccuaaucaggacaugccugugucuauuuauuguuggaugagcuuuugaaguacauauugccugaaagagaauuuuucaagugguuaccuauuuuuuuuuuuuucuccucuggcuggagaaaaguuagaacagaagggaacgccguguauuauuuuuguuguucuucacuaaagacauagucuuggcuacuucggaaaaagaaggaagguaugaaauggugguuaauccuuuccuccauuuuguccccaauugcuugcagugucucuucacccuaucgagaaacacuuucucaaagcugucucuguacugugcugauaucagaggagucaacuaaaagugauuuucucuguagacaguuauucuaguuuaugggauguauuauaaaacuauuggggaaaaucacugaacuacuaagguaagggaaauagcuuaaggaucuaugauccauauuugaaauagucauuaaguuauauaauuggauuuuuagagaacaagauagagcaguuucaggauguaagguguaaaauaaaucugguccaugaacugcuuccaaauugucacccugaccagaagaaguaacauuccucagguuguggcuuuaucuagaaaggggaaauggcuauuucuggauuagcuuuauacaaaugaguguauuucccaccugcugcuuuugccuaggguuggaauuuuuccuuuucacugcuuguuacuuggcguuuggauggaaacguauccucccuuucagagccagaagauucugugugagucaucaagaaaaauuucuccgaggaguuauuaauucaguuaguugcuccauaguaaaugguucaugcaacagugauaaaccucugaauuugaaaucuuucuuuaaaaucuuuuuuccuucaaaaaaugcauacaguggauugcugagcaucuaaaaucccgcacuguucagcacugucauucuugguaauugcuuuuuagaggauuuggugguguuuugcugcuuaagcuaaaccacgaaguuaaacuuuuguacuguggaaguaguucaugaauccuuuagauuucuuggaagaggaaagaugaguguguggugaauauauaugaauaucgcauauuugaauguguuacuuacuaguuuugguugagcauuaagguugccccuaauggaugggaucucugccagggguaacucuuggaguccuaggugcuauuggggaggaaccuuucauucucggcauucugggggagauuuacaucuguaagccggauaaaaauauguggaaaggugauuaguuuaauuggcccacuauuauaauuauucaguaggagguggcugugggacugcuauuauagcccaaaaugccugguaggaagaggcggagacucauugaaaacagcagcaagguuauaaaacguugguuuaaacgugcauuuaauaacagauuacccuggugcuuuaaagacagaggaaugcuuaaguauuugguacaagaauccauccaaaaaaagacgcggauuuuuuuucaaagauaauugugggaaauucugcuaaugauuucuuuucccuuaaaauaucauacaggggaguaggauuuagguagguguaaaguugcucaacguguugguaacuuuaagauuauuucuucucugguuguugccacagacacucaggguggccacaauggugguguuguuuuaggcuucuuucaaaaaagaaguccaguccaggauaauguuguaaaguggaguauuuuucuuucacaucaaagggcaaggaauguuuuacagacagugagcuaagaaguagggcacagauauuucaguacuugcguugggaaacuauguguggaaugucauaguucauauaccagagaccccgaagugaauccaggugccugcacggugcugacuuuuccuggagugagaugacuguaggcagaaauugcagccagaugaaccuaaaauaaaauugauggcuuuauuggacauucuuuucaugagauuuaacuucuuaacgugcacauacaucacucuggggaugucauuaucauggcugaccuuucguuugggggagcugcugcucgcugucugugcagcuccgaucagcuuggcuuugauuaccacccacaucuguugagcaugugagagagagauuuugaaaaaucucaagcacacugacaacuggcuacaaagauuuaauuaagaccggucagaacuaauuucaguuauauauuccaguuuaggguaucaacuccucugguuucagaagggggaguuaugacuuccuaaaaguuguuguugaaggcagcaugaggaaaucuccuugggcaagcaguggguuucuuuguccuagcucccccacugcuaccugggguuaaugauugcaggguggcuggcguaaugaaccagugccggaaagcuuauuaucaacaugcugaagucauauuuagaaaucauuccuccuccuuuuuucuccuuuccaauacaagucagagcacugcugugguuccaccuaauaaauacugcaggcuucauugggcuguucaaugagaccuaauauaguaucauuugugcacuuuagugggugguuccuauuuauauuuuugugugguuuacugcucaaucuugggaagaugugggguuugaggguuuaucaguugcaguuuuuuguggaaccaguuugagugagacaagacuuuggccauuauuugucggguuacauggaucuccauaugagcuaugaagauacuggaauaauugggucacaauaauguaaaaucguagucuguacuuucagcucauuccagaggaaugauuggaagcccugcucucccucucuucugcaugcaaaccucaggugugauuucggccugugcccaaguguucuugaaauguucaaggcuguccguucccacucugugaugaggcuuccgguugaugugugacaucacuuagggcaggaacuggcacugucuugauccuggcuguccuagagaagcuucugugcuuggccuugggaagccaccccauuuggugcugcuguagucuccuuucugcuccucuuuuaacagcugccucccaccugugcucacuuccaccugcaggccuuguuuuccaguggcacuggagugccaugcugaggucacuggacaaguuccuuaucagagcccccuucccauuagagugaggcugcaccccauccugccugggcuuacuuugugcguugcuugggggcauggagaagguucuugcccuugcugcuuuauaugagguccaauuccuccaguguuugccaucuccuuuagagcucucuggugacaaaaccuucuucagcuugucuacccuccaggcuggugaguugaacucagacuggugcucggaaagguuaaaggacuuguccaagauguuaccuuacuggcaaacugcauucccaagucuuuauugaucuccgagggcaucucuuaauuuguuggaguuuucuuuuccuggaaaaaauacugcuugggucucaguuucuccacauauaaaaucagaauaagaccauaaauucauguaguugaaaggggcgguuucaggaagaaaacuaagauaaugaaagccuccggaaaagggucugggacgacauuauuuacagaguacuuuccacacauugucaggguggggccgcacaggaaccuugugggguaggcaucauugaccuguuucaaaaaugaacaaagucagucccagagaccuugaauggaggcuuaucaaagcuaagcauacggcuucaaguuuaaccgucaaaugguagaguuagucauggcuuuuggaugugcgggccaggcauggugcagggccagguauguuuuagccuugugguucuuuuccugauauuucgguccugugggccuccccaaaguggcuuugcaccuauguuuguuaugggcauaaggaaguuagaauucuaugaauauguacugauuuuuugugauucugaauuuaaauaggccucuauaaagcuaauacuugaaguuuuguuguaaugaagcaucacaaauacuuuuacauaggaaaaaggaccaagcugaucuccuuaaagcgguugcaaaaaccacccaguuguuauacgauuguuuguuucauguuucuuguuauguggcauauuuccaguaaguggagggaccaaauauuuuauaguuacagaaacuucuucucucccuccuugaaguuuaaaaaaguggaucaaaugucugccuauuuucaaggaggcagggagacagaagaucuuuuccagauugcaggaaggccaacgcagguugcacccagagaacuauggaaaccacuguugaggaggaaggaauugggugaaaauuaaagaaucaagcuaguaaaagugaaaagaggccuuugguuuuuuuuuuuggacaguuuuuaagggccuucauaaauacuugguguacuccucaaagaccaagcguugaaggguuaagucagggaacuaaaacuuggauuguguguugaccccuguguagcuguggccagggcuccugauuuuccccugacgauccauugguagaacaaggccagugguacuguuuucuggugcaggggaggcucggaccugcaggggaguuacggaggcuggccacugguuuggagcagacagguaaguagccucuagggaggugguagcucuguacaacagucuguucccaaugucugggugacucuuguucccaauacuuggcucucuuuuuggaugucagagucauauucuucauucuccaugucuccugcuaauuuuuggcauugacccauccaggauuuauuucagcagcuagcauggugccugaccuauccauaguaggugcuuaguaaauacugcacuccacagggggaagagggcaggcacguucugccuauugacguggugggaagagagaccgugcuuagggacagguuugggagcuucauuauuucugccuugggacuguuugaaugcacccuauuuugcuauaggggaaacacugcaauaacauaaaucccacuugaaucauucuuuguucuaucaccccugcccuuaucacugcucuuguaagacagacaucauaggagacuccuaauccucucccugccucuggugggugcaugacacugaucuagcuuccacuugcacaguucucucucucucugccccuaaaacagaaauaugaucauguuauucuccuacuuacaugcccgucaguggcuccccagugccguacugcuguggcacacagaacccuacgugaucugguccugcgugcucuguaaguggcaagucccagggccucuucgugcaggcuguucaagggggucucauaaccuaccaguccgaguuagacuuguugagucuuaaaaccaagcugcuuugaguugggucuucagaugaacugggaaucaacauauuugggauggaucuguagggugcauuuaaaaggcacugaauguuuggaauggagugcaagaauuaauguuaaguuaccagagaaaauugagguauuaagggaucugcgcauauaguuuucaaaaaucaauuaaacaaaaagccuguuuuuuaacugauucuauaguucauuuggaagacuauguauauuacauuauaucauauaucuacaugugugauauauuuauaauagaaaaaugaagcagaaacuucuacuaccaaauauuaaaacacauuauaaagugcugauaaaagaugaugaugugggcauaaaaacaugcaaauaauccaacaaaauagcacuuuucaaaacuuuuuuuagcguauggaauaacuuaauuauaagucguuggggaaggaacagauuauuugaugaaggggguugugaaauuggguauuuuaaaaaaucuauuuauaucuuugcuuuggugacacaccaaaauaucuuucauacggauuggauuuaaguauauauauuuaaagcucuaagcgagaaaaaaaauguggagaaaauuugaucucugagaaagaggauuuuuuuuaagccuaaaagccaaaaacucuaagugauugcucaacuuaaguacauaacaguauucauuuuacugaagaauuacaaauaacuaauaaugaucacuagaacagaaaaaugucaaaagaaaaaacacacgguauucauuguccucucauaaaauuaagaaagauuuagaaaaugcaaauacucagugcucauaacaauaugguuagauuuucaacacuuucuaaaaggaaaaauguuaaaauaaauuccaaagaaaaaauuuuuuaaaugguuugguuuuuacauauacuggggaaacuuacuauuuaaagacuagaguuaauuauuucaaaauaaaaauagucuuucuaauuuuaguuucauaauguuguuuuuuaaucuuuguuugauuuuaaacaaccuuuuagucuuugggcuguccaaaauuauaaauuauaugucuguaauuuacuauuguuaaucauacaguucuccauauaaaaaauggcagagagaaaaacuggaaaaauaugcccugugaaggggauuuaugauccuuaauaucccagaagaagaccauaaugaggcaucuuauguaacagagaagucauauagggcuucaguuucuaaagugcucaaauuuuaauucauagugugacuuugaacaggcuacuuuaccucucuuggucucagugucuucaucugugaaaugggaggguuggguuagaucaguuucccagcugagaugccccggcacagcugugccaaaauucugaugccccucggcccuaaagacagcuggacagagcugggguggaggcccuaggucaguuacuuccacccaagggcagccauuuguuuuucccaaggaaaauaguaccacaaaucacucucaaugcacucuuagauaaugaguugucuuacuuuuaaauucaagaggugagagcuacauggaagaggagauaauuuuggacaucacagugaaccauucguccuucccagucaauauucaauagguauguuaaaaaaugaauggaagaaaacacaucaaaauguuauuaguaauuaucucuggugauugacuuacagguaauuuuuauuugcuuauuuauaauauuccgccucauucaaauuuacuguuaagaauuuguuaaauuuaaauaagaaaaguuauuuaaaacaaaucccaaccuguacccauuuuuacauuuaaaaacuccaugaguacgagugacggcuauggcugucagaguuaagaaucuaacaaaaauaaaacggcaaacauggacccauuucacauuauggaaauauccugggauauuuucauuccaagguuucuugcucagugcuuacuuucaaggcugguuucaggugugaggaagaagcuuugagcagaaggccuguuuguagagugagugaguagccuucuuacuuggggcagcugaccccaaaggucuuccucuccaucucccuccuucagugcuuucuucccuuauuuuuccccuucccugugaccccugaauugcugauaauuccuuuccuucuuuguucuucucaaucccugguguguauaugguuagaaguuccggugcccacuuagcugagccacagagauuccauuuuuaacuggucccucauaugccagcccaucuaguuccucaggcauuaccgccuucccucucccagcuuuauucugcuuauuuacaucuuucugggaaugaugugcuucaaacuuuccaaccuauuaguuuaaaccagauuuaguggcaggggcggggggaaguagacuuucucugcccuuugguuuugcuuuacuuugagauaaacacuauauacauuaaaggugcuuaaaugauguuuucucugacuuccuaaagggguuacuuuucauugacuccuaacauuuuaauucucugauugugauuguuuugucuaaaucaugggguggagugcauguggggaauuagaaaacuaauugucauuauaaccuuucagcagaauuuuggaaugauuaauagcuauguuaauaugccauaacauaauuacuuauaaaaaucagaauauaccaccaccuuguuaguauuaaaauggugcuaggcugggcgcgguggcucacgccuguaaucccagcacuuugggaggcccaggcaggugcaucaccugagaucaggaguucgagaucagccuggccaacauggugaaaccccgucucuacuaaaaauauaaaaauuagcuggacguguuagcgggugccuguaaucccagcuacuugggaggcugaggcaggagaauuucuggaacccaggaggcagagguugcagugagcugugaucguaccauugcacucuggccugggagacagaguaaaacucugucuaaaacaaaacaaaacgaaacaaaaaaaccugcuaaaauauaaguuacuuucuuuauauaacauuuuaggaccuuacaguguaccuuaacuuucugagcauagauaacaaaugaagauaauaagaaauauuguuuuauauuguuuauaaagcacugugcccuacauugcaguuuauagaaccacauaacaguuggccaugggcaguaucucaggaagccuuaaaaucucgggaagacugacagaauggcggagcuaagauggaccucagggucaucuaauccaguguuucccaaccauuuucacaucauggcacacauugaaaaggugcacagcacacccuggggaaauaaaugacugcucuuggcuggagguaguggaucugaggacuccagccuaggcuguguccagcuccccugagggcugaugggcaucagaaccuuggcgcagcuguccuggggcauuccaguugggaacugugaucuaacccaacccugccauuuuacagaugagacacaucugcauuuacauaucgagacccagagagguaaaguagauuguucaagguuacacagugaauuagugacauuaugauaaauagaauuugagcauuucagaaacuggaguuuaauauaacuucucuuuuacauugcaugccucauuauguuguucuuacaguacauuagaacuuuuauagggcacguuuuuccaaaagguuuaccucugccauauuguauauggagaaguaugauuaauauuaguaaauuauagauauaucucuuuuggacaaccuaaagaauaaaaggcucuuuuaaaccccaaauucaaguuaaaaauuaagauuacgaugcuaaaaauagucuaacauauguaaaaaugauuuaaaaaauuuuauuuacacaaagaauguacucaggcuaugaaacuuguaugcuggcaguugccucacuuuaaaaaauaaaagagagaaaaguaagauggaaaagaaaauuaaaauuguaaacauuuuaaugacucaccacuaccuccauccuuagauuucuuugccaucaacuauuuaaacccuuuaagaauauuaggaaaccgugguuacuuggcgugguuuuauaaaucuguucugguaaucucuaaauucuccuucaaccccaugaugauucacugauucuaguguaaugagggcuugguucagccuuacauauauuuaugugugugucaaccaagauguacaugggaacauggcaucucaucuucaguucuuugucugaaccacaaaauuuaugugccaauucaggacaguuuauggcgcuagguuuguaacaucagagugacuuguuccaccaugaccucaagaugguagcuguagacuagcgacaccuuccauuaacagcugguugaccuuggagaaguucuauaaucucuuuuuuugccucuguuuuuucaucugugaagugaaggacaggcugccuaccugcuaggauuguuauauggauuaaaugcauuaguuagugcaaagucuugaacaacacccagugcacacagaaauaaauaugauaaauaaguacagugaaugugggccguuuucaucaccauuauuaguaauagcugccaugaguugucauugaacagggagcaguaagggggccuccagguauaaacaagacccacccugcuuugucagucucagguuuuauaaaaauagucgcugccuaacugaguucuuggggcacuaaggaauaggauuauuauuaccagaugccccugagucucucugcuuauugaggcguuuuuuuuuuuuuuuuuuuuuuugguagggcuuuguuugggaaaaaaaagaaagaaaaucuaccuccagggacauggguaaaauauuuuuucccuuaguuaacguuaaauuccagucauucuuuugcagaaguguuguggaacagaagggagggguaaagauuccaacuuuagacauuagacuaagaaugcauguaaugaguacccagacagcaugacacuuuuucaguuaucacugccacccccauccccccaaaaaaacacacugugagggaaagagcaagagcugugaacucagacaggcugagugcagccccuagcccgcacuuaauggcugaguacauccgggcuaugcauucaccuucucugaugggucuucuagguuggagucaucuucuagaggugcuguaagcugguguaagagacuagcaaagugccagcagcauaggcccugugcccuaaaugggcccacauuuuucugaguucaucuuugcuaaagggauuuuuuuucuuaaguacauacuguauccagaauugguggguucuuggucucaccaacuucaagaaugaagccgcagacccuugcggugaauguuguaguucuuaaaggcagcguguccagaguuuguuccuucugauguuuagauguguuuggaguuuuuuccuucuggugggugcuuggucucgcuggcuucaggagugaagcugcagaccuucguggugaguguuacagcucauaaaggugguguggacccaaagagugagcaguagcaagauuuacugcaaagagcaaaagaacaaagcuuccacaguguggaagggggacccgagcagguucccacugcuggcuugggcagcuugcuuuuauucucuuaucuggccccacccacauccuguugauugguccauuuuacagaaagcugauuggucuguuuuauagagagcugauuggucuguuuugacagggugcugauuggugcguuuacaaucccugagcuagacacaaaaauucucuauguccucacuagauuagcuagacacagagcacugauuggugcauuugcaaaccuugagcuagacacagggugcugauugguguauuuacaaucucuuagcuagacguaaagguucuccaaguccccaccagauuagcuagacacagagugcugauuggugcauucacagacucugagcuagacacagagugcugauuggggcauuuacaaaccuugagcuagacacagagugcugauuggggcauuuacaaaccuugagcuagacacagagugcugauugguguaucugcaaucccuuagcuagacauaaagguucuccaaguccccacuagacucaggagcccagcuggcuucacccaauggauccugcacuggggccacagguggagcugccugccaguccugcucggugugcccgcacuccucagcccuugggcaguagaugggaccaggugccauggagcagggggcggcgcucguuggggaggcuugggcauggcgggcugcagguccugagcccugccccgcggggaggcagcugagguccggugagaauucgagugcagugccggcgggccagcacugcugggggacccagugcacccuccgcugcugcuggcccggguguuaagccccucacugcccggggccggcggugcccacuggccgcucagagugcggggccugccgagcccacgcccaccuggaacucacucugaccugcaagcgccgugcgcagccccgguuccugccuguguuucucccuccacaccucccugcaagcugagggagcuggccccagccucggcuagcccagaagggggcccccacagugcaguggugggcugaagggcccaccucucgaacguggccagagcggacgcugaggcugaggaggugcugagagcaagugagggaugcgagggcugccagcacgcugucaccucucaauacuuuaggcaauuucuugugguggcacauuugagacuguuucaugccaguggcuuuuccauuuuccuuucuuuuuuugagacucuugcucuguugccuaggcuggaguacagugaugcgaugauaacucacuguaacuucaaacuccagggcucaagcgauccucccaccucagccuccugaguagccaagacuauaggcgcauaccaccauaccuggcuauuuuuuuuuuauuuuuuguagagacgagggcucgucauguugcccaggcugaucucaaacuccuggacucagccagucuuccuaccucggccuccaagagugcugggauuccaggcaugagccacugugccuggcuggccuuuucacuuucuauuaaugguucucggggucaucucccgcugcccuucucccccaggaauauuuuagcagcauucuaaguuauuucagcuccuucaguuuuguugcucauaucuuugcuacccuugcucaccauuacaauucaaagccucacuguucuugcuuucucacugauggguuaaccuuuuuuucuucuaucacaaauaggguugcuagauaaaauauugggcacccaguuaagauggaauuucagauaaaugccaaacaauuuuuuuuuuuuuucgagucagagucucccucucuagcccaggcuggagugcaauggugcgaucuuggcucacugcaaccuccgccucccaggucccaguucaagcaauucuccugcgucagccuccgaguagcugggauuacaggcaugugccaccacgcccagcuaauuuuuguauuuuuaguagagaugggguuucaccauguuggccaggcuggucuuagacuucugacaucaugauucgcccgccuuggccucccaaagugccgggauuacaggugugagccacugugcccggccccaaauaauuuuuuagccuaaguguggcccauccacuauuugggacauacuuaaacuaaaaauuauuuguuuaucuggaauucagauuuaacagagcauccuguauuuuuaagucuggccacucuacaaauaucuguaccaauucucccauuacaacuuuuuacccacacggcagcauguuuuggccaagaggaauaaaagaggcuucucagauauuuccuaaggcccuguuuugacgaacuuaaagagaaaaugccgacagguuaauaggagauucugacaacgaagaggaauuccugugauuuuagggguagagauauauaucgacuucgauuugggagaucacuugguaaaugugaggugucuguauuuugggcugaaugucaacucuggaaguagguaaaaguuaaguuuuauauccacaugcuauuccaccuccguucaaaacuuagaaaaauauugucuuccauaccuaauucacaguccuaaugaucagguauuagcugaacagaacaaagaagccugccuuagaggauguugugaauggguuuuggggauggagacuugagacacaauauaaaaagauggucagaccaguuaaguaugacaugaggcaguuuuaugaaacguaaaaauggcuuuuucaugcagcucagaggcauggauauagaaagggaaaaaccaaaaagaaaugauuuguguaugucagcccacuaacauuuuuggaaaugugccugaggacuaccgaaguaaucagaugacauggacuugccccuugaggaauuuaauuuaugggugagaaauuugaaaagaaaguggcuuauccuagcuuuucuuuuuuuuuuuuuccuuuuguuucuuccaaaaauuuucucccaagggacagaagugggucugccacagcuauggauaggaauaaccaagugaagggaggcagugacguggguacuuccacauagaggcugcacucugaugauucaggaauauuucuugaguacccuuuuauuuuauuuuauuuuauuuuauuauuuugagacagggucuugcucuguugcccaggcuggacugcaguagugcgaccuuugcucacuguagccucaaccucuauggcccaagggauccucccaccucagccucaacaaguagcugagacuacaggugugugccaccaugccuggcuaauuuuucuaauuuuuguagauacgggguuucaccauguugccuaggccaaucuccaacuccuggacucaagcagucccccucccuuggccucccaaagugcugggauuacaggcaugagccacugaguugaguaccuuuuagguggauugucaucauauuugagugccuagcaugguguuaggugcuggggauguagcaacagucagcaagggcagagucucagucagcucuguagagcuugugugcugucaucauagguacuuugagaaaugcaaagguagaccagguaggauagggaauucuggccucuaggagcuuccuuaggguugauuaccuaugcuuuuccuucuguggcaauuggagacucagucugcuguuggccagaauacuggauaacuggcagguaacucugcauuguuaggaaggcugaucagacuucaggucccccauugaggaguuuuacaucugaaucuucagcagcuggucuaaacugacaauggcaggcuucaguaaaaucagccauucaauuuaucuauauuauaaaaugaugaaggcaugcuccaucugguaucagauagaguaccuucuaauauuggugcauuaucaguaccuuuguguguagggggucugcuguaaugaaaaacaguagagcucgauucauccuaauuacauuuugagcaauuuuagggggcugaaaagauuguacugugacaauaagguuuuuccuucuuaccaaaagaauuuauaaaugguacagaaaaugaaagauggcuagugguuuuagcaguucuaauguuuuuucuuuuuuuagauaaggaaaaaaaccccacucugauucuaaaacccgcuggaauuugaacuguugccuguguucugaaagugucuugaauugcuugggaucccaagccugaaguuuacagcaucucaugguguccagguauccaagaggagucauaaaguucuccgaaaauugugaaaaccauauacuuaagggaccacacgcaugcaguggaguauucuucgauggcagcauuuucuuuugcgggaaauagcaaaucaggcaguaaugagguguaaggucagaaaaacugcauagaaaucaaugacuagguguucagagaaguuaaaagaaauuaauaauuuuucuucuguaugauuuuugcuuugggauauuuugguuauuuuuuacugguuucggaugcuauuuuaaugaguauuuuguuuauauuuuguaggcccaugaauaugaaggauaacuuagauuuuaaaaguucuuucuucuauuccccaagggcugauggacuuaaaaauaccugucaguugagccuucaaaaucuuuuuauugacaagugacuccugacuucaggccuaauugguuccugaauguuuagucuuggggcauggucauaacacaaacucuuacuuccugcaggcuguguuaucuguaaagcuuauguuuuguuuuuuguuuguuuguuuguuuguuuguuuuugagacggagucucgcucugucgccaggcuggagugcaguagugcaaucucggcucacugcaaccuccacaucccagguucaagcuauucuccugccucagccuccugaguagcugggauuacaggcgcacaccaccacgcccggcuaauuuuuuauuuuuaguagagacgggguuucaccauguuggucaggcuggucuugaacuccugaccuugugauccacccuccuuagccucccaaaguucugggauuacagacgugagccacugcgcccagccaaagcuuguguuauauauugggcuuccauuccugaaagcugguuuuauacuauacaaauaacaaagucaauaugaaaaugugucaaaaauaugaauguaccucuuaaauacacauauuaacuauuucaaacaaaaguacuaaagauaaaaaaaaguuauacuguaaauguuacuuucagggaauuuuuuucugcugagguugaguugacugaagcuuuuaaaguccaauguuaagucuuucuaaagcauauagagguauuuuuuuuuccaguguuucaaggucuuuuaaauuguguuaaaaaacagaguuaucugcuuccaauucuauugcauaugaaaaguguagaaaugcugggaaguuuguuaauugcuaaaaguugaaggagggacaguuuccauggcaacuucuucaguaacccaugcucugauauuucagaaggauauucuuugcugagcugugaaugcaguauuaagaauucaaucaaaucuucagaaugugaagagcaauugcuaaagaaaaucauuagcccugugcacaguuagaccaaacagcuggcugggucugggcugucccguauugagucagccuuaccuguccacuaaucaaggcguugccuucuggacguaguccuuggugagucugcuagccgucugguuuuggucaucccuaugaaagucuuaggaaaggcaguaacagguugagcugucuuugauugaguuagauucaugacugaauaucauuaggguguauuccuuuaaucuguauguguugggaaaugauuugugugucugaagaaaguaagcaacauauaaauuuugucuaaaaggccgcauuuaugcuguaauaauuuucucguuuuucuuuuaaauaaggggacaaaccagggccugacauuaucuuguaauaacgaguacugagcauagaauuuuauguguccaugucugugccuucaugaauugucagauucuacagacaugaccugaaagggagaucuuuuaucucccauguuuucaaagaugaaacccaucuacaugugaaugagaugauauaaaauuauuuucuucaaacauuuuuggguacuuacauuuucuuacugaucuucucgacuagauuuugugcuuuguaggguugugcacguauaaaguacugaaguauuuauggauuuuauaauauguugacucauuuucugguugaauuuauauuuucaaaaauuauuaaauuauauuaaaggaagagaaacaaucaucuugcauuauugcuaauagucaaguaaacaucaaucucuaaaugagcguguuaaguauaguacauauuugcuugccuagcacuaugccauagggaucaaaaggaaauguaggaaaugaugccugcaucguuuaaguugcccagucugauuuuauaaccucuuauucauaguugaaaagcaauaugacgugaauuuaauuagguuuucauuuaacaaggcagucuacuccguuuuuuucauucauucuguuuucucguguuagauggcauuucugauauuuauagucuuuggucauuccccuacccagguuuuccaauuuuauaaggugucauuucuggagcaagguauaauuuaacccuuaccuacccuuaggacaccauaugauauaaauuaacuuauccugacuuccauaaccacagaagggaaccugcuuggaggcagggucucacugucacccaggcuaguucugaccaguuaacuugguugggaaaauggggacauauugacggaagaaauccuuuuaaaaccagucaagccuccaguaaguuucaagaaauaggaagaaaaauguaguguucauuacaugaauaugaaaaucaucuaugauuaugccuuucugaugucuguucagaaucucaaggaggggagaagaaagaaaaaaaaaagcccccccgccccgccagcuacagccuugacaacuaucagaauugcacaggaggccaggcguguaaucccaguacuuugggaggccgagguggguggauugcuugagcuuggguguucaagaccagcuugggcaacauagcaaaacccugucucuacuauauauauguguauauauauauauauaaaaauuagucggguguggcaguguuugccuguggucccaacuauucagaaggcugagaugggaggaucgcuugagccugggagguggagguugcagugagccaagauccgagcuacugcacuccaaccugggugacagugagaccccgccuccaaaaaaaaaaaaaaucuguaugguaacuucaguugggccugccucugcucacccgcccaucuuuaggaagccagucuuagaaagacaguggcuggccagaggccucccuccccaacacuccuuucccccaacacuccuuuuucaaacuucugugguuauggaagucaggauuugaaaagagauuuagcaauguuuuucucauucuguagugguuuucuuuuuccgguugaagaggcuauccucuuggccuucaugaaguagguuuuaccacagcguugaaagugaaguauuaaaauauaagcugauaagagcaaggaaguuuaccagaaaaauuucaguucacauagggccaaguagguuauugagucgugcauucuuuuugagugguaggaaauagaagagagccuuggagaagcauuuucuuaccugacuuuaguucaucucuguuuaucuaagaaauuucaaauauuccagucuaagagauuugaaauucugucaaauuuaaggagacugucuuucagucucugaaguauaguuauuuaauugauuaaaagguauuauagauaaacaaaaauauuuuuuauggauauguguauacauacaguggaauauuauucagccuuaaagaaggaaauuguagacugggcacgguggcucacaccuauaaucccagcacuuugggaggcugaggcaggcagaucacgaggucaagagauugagaccauccuggccaacauggugaaaccccaucucuaccuaaauaugaaaauuagcugggugugguggugugcgucuguagucccagcuacucaggaggcuguaccccgucucuccuaaaaauacaaaaauuagcuggacauggcggugugcaccuguguucccagcuacucaggaggcugaggcaggagaaucccuugaacccgggaggcggagguugcagugagccgagaucgcaccacaauacuccagcccggugacagagcaagcccaucucaaaaaaaaaaaaaaaaaaaagaaggaaauaaugcuacaacacggaugaacuuugaggacguuauacuaagugaaagaagccagccagaaacagaaagacaaauauuucaugauuccauuuauaugagguaccuagaguagucaaauucauagaggcagaaaguacaauggcggcugccaggggcugagggagggggcaauagggaguuaguguuuaauggacacagauuuuuaguuuuuugagaugaaaagaguucuggagaugaauguggugaugauugcagaacaaugaguauauuuaaugcaauugaacuauaggcuuaaaaaugguuaagagggcaaauuuuauuuuguguguauuuuaccacaguuuuuaaaaauguuuauugagcaccuguucuuugguuccaguugagcuccaaugacugaaacaaaggcccucagccuugagggagcugacaggugaguuagaggugagcaugugaugcugcuggaauagggaacacaaggucauugucauggauuaggaugcucugguccucagugcaggugaacuugaaccuagccaugaaaaagcaccagaaauggcucucuuuguaauuuucacuucuccccagcuuccccucccaauauguagugcugccccacugcugcaucccaaagccaaugccguggaucauuuuaaccggcugcugcuuuaacugguuugucuucugcucuuuuccuaaauccagcucugcuccuccuccuuggucugcacuuguaaggccuuuauuugaugugcauguaucucccauuuuauagcccacaucauuuuucaucuuggacuauaaauucagagaagaugugggcuaugcacuuugaccuucacagcacccagcacaguaaaccauaaugaauguuuuggaugaggaugaggcucugaaguuggaagcugacauggcuaaugccuauuuaauugaagguuauuaaugccucuuuagcagugaaggcuagauagucuucuguuuacagcagagaaggaacaagcccucaagcuuuuuccaguggucucaaagaauucucugucagguguugccccaguacacacugaccugaacuuagcaucccggagaaugaaagggacaguuggggcaguggggcagcuuccccccgagaagacaagcgucuucuccucuggguucaugguucccaggugggaauucagggcggggguaagucagaauauuuauguucuaguucagcuuauuaaauaugagauuuuccaucucuuagugaauagaguuugccuucuguccagcaugauaguucuaaguagggcgaccauaugucccaguuuuaauaccuauuugccuggauuaauuauuaauagcucccccuuuaagagugcccugguuuggaugauaaauauuauugcuauccuuguuacaagggggaacauauagagaggauaguuauacaggggaagguggggagaaagagggaggggaacuuaggcaggcugcuggagauucagaagauaaggaaugugagaaauagcuguguagucaaacauuuagauguuuuuuggauggaaaaaauuauuuggcuuuuaaaugauaagcuagucuaauaaguuaggauuugaaagucuugaucaaagggagauuuuauuuuaucagucauaguauaggaucuuuuagugcagguuaacagguuaauguguauacucagagcuucagguauuuuauggcuaaagacaaaagacuuuaauguacaaauauguguauauaucucacauuuguuucuuuaacuaugaaaaugaacuuagucuguuuaaaauccuguuuuuauuugcauauguauuuaacuuagauaaugguguaauggauauucaauauugauuaaccuuagguaugaggaaaagccacauugguaaugaaggaaauuagguaggaccauauuaauuccuucauauuuguuaagggaacaucauguaaucugaacaaaauaaguguuuuauaaucagguguuauuuuggaauuuuuauauucaaaguuuuuguuuaaaucaguuugagcugguuuucggugaaggaguuguaucaauaucacuuuaaaucaauggaaagucuaaacauagggugcucuaggguugcuccaucaagcagcccggcagucuuagccgcauccugugucuuuccauuucucuuuggcgucccuggugugugcuucagccugagccaaaugcucaccuugcucuggggaagccaucauauuugaguuuuuaaaaaucauaacaguauguguauaugaguguguauuauaagugcguguuccuuguguacuuacaaauaaauuuauaauuuuucaaaguuaucuggcgguauugcuuuacauuuugaaagagcauuacaguuuuagaaaugacuauuuaugucauuggaucagcaaacaauuuuacaggaugcagaaauuaucgauuguauucuguauguuagugacuuacucgagaugcuagagcugucagaaugaacuuagacuaaaacccaggucuucugacucuauguccaucacccuacccaugauauugacuuguagaugucuugcccaguaaguauauuucagaaagaauuuuucuuuuacaauugcuuuucuguuuugguuuaauuugauguuguccuacaguauuccuuguuaggaaaaaaaaauaaccucggugccuuugggcuaauuggauguguacuuaccuaucugcaaaguguacuuacugaugcaaaauuaucaccauccuaccgguauaccuugaugguggucucaguucaaacauccuuuugacaacucugccucaguugccgucucaguacauuuguaccauaggagcuuuucugucuguauucuuuaccucuuguccuuccugcuugcugacugucuuuucuauucuaaccuccacuuaaaagacuuaugcucauccuucaagaacuaccugaaaugcugccgccucaaugauguuuucucuguucguucuagcgaucgcucuuuucucucuugaguuccuguagugccuugaauuucucuucuggcccuuaucauacccugcuuuacaccacagccauuugucuuuauuauauuccucccuacaagauuguggugagcuucucaagggcacuggccauuucucauucaucuugguguccccacagcacuuugcacagugccacaucccuuggaaacucugcaguucauuuuguuuuaaauaaaugaauggguuuagacaugguuacacccacucauaagauaugaggugauuguagauuuuuacagcauauggagauuacagagaaccuuauauugguauaauuaucaccugguuugugcauaauuaaaaauguaauuguauauuuuuaugcaauagguuaucauguacuguuuuaaguguguacaguuuuuuaugggccuaccauuuaguuaaauugcauagaugcuuuuuagaaugcuacugugaagaagugcagaguugaggucguuuuuagaagcucagugaguuggccccuuuugcucucuguauuauccuuuuaggcuaagcugcagcacagcugucccaccugacuagcuuuccuccuguggcucuuauugucauugcauuagcugagagaacagguuuuaagauuuuuaacucuucucugccuagccuagguuucagaaauauuuuagaggguuuuuagaaagucgaaauucaguggauaagacuuuugauaguuuucagguucucuuuguuuuauguaaccuucgguuuuuaaaaauguuuacauuucacuccauuuucuucuaauccuguagauaugggacuggccuaggaucuggcguuuuaaauaaucuuuucacuuccccuucccccaacaagguaauucugaugucagggagacagggaaaaauucaccucgagaaacaccaugacaggucaguauuggggaaugaggacuugagauuugccuuucaaaaugaguaagguuuaaguggauggagaggagaugauuuccuuguggagguaagaaauggagcaaagucuaaggugagaaugagcacguaauauuaggagagaaggagggcaaggaggaugcuaaccagcuuucaguggaagauuauuuuagagcaauguucucaaacuguggguacauuagaaguguaccaugggcuuguuaaauagccacauuccugccuuccaccccgacccugaaauugcuuguuugggcauucugugggcuuagggugguggccugggcgucggcauuucuaacagacauccagcugaacuuggugugauggaaucccugcuuuauggaauaaaagagggucugcugacaaggcagcagggacugcauuuuggcaguccuuacuguguuagaugagguuucggaguuaagauggggacacuagaacucuagcugggaaaucaggugcagggaugcugcauaauccccugaggugaugcgugcagcgaggcaacagcagucaggcucuacaggguagaauuuauucucagaagaagguauagaccgcugacaaaggaguucacuccucuguaaacuguuaaggaauugcaaagaaauuuuccauuuguaaucugcugacauauuuuagaaagguagccuccuuaauccaccccucuaaagaccugaugguggucccucacagguauccaaaguagccuuaaaucagagacuggucuaguuggaggaugugacuuggaaucuaugaacccuggauguacuugagggcaacucacuugaaacuuuggaauuucauguggaugcauguuuucuggagagagguccuagagucuugaccauauucucagacaugcccuuacuuggauuuaggauaagaugauuuaguacuuggcucauuggguggcuggcuuucucucuccucucuuuuuuaaaaacccagaacaaauuccuauuagugaaaaagaaacaauagcuugaagaacaaagaaggccccagaccauaagauagaaugauagaagagcccuagauuuuccaacagaugacccucccuuuauuuuugcuugggugggugugccauuauuaauaauaagccaggggaauaggggauugagaagcucuucguagaauguguaaugaauuuuucuguuccuuguggagcaguuucagugguuucagcugaaguacacagagagggcuauguuaacaguaaggaggugaauuacuaguuauugcuaucaaguuuggagcuggggagaaagcggguguaugaaacaggaccaugugugaauggauuucucaaguguuucauuaaagauccgucagaacgguuagcacucuaaccaugcuucagucucuggcuucugauuccuuuguggaauuaaaaaugcuuuugggaagaggggcuaaacaagccuuuugucugaauuuccauguauugauuaauggacccagcagagcauccugcugugaauucugucugcugaugguaacucuuacaaugagcaaagcuuuucugaacuggcauuuuccacucagccuguaggcugcuguauugggugugacaauuuuuuaaaagccaucaugcuagaaugaaaaugagccauuucuaaauggccuauugauuugcaaaaccuuuuuguguuggauugaaugguuucauaucucagcugagggaaaaagaugcaggcuauuuuuaauuuauuguuauuuuaucuuaaagauuugaguugacaacguuuuggucaugauguuuaccuacuguugaaaggucuacuugcaugucaugacuugauaauaaauguaaaacucugguucauuagcuuacacuauaaaagaguucuacagcuccacuuacagugugagccacagucaguaaauauggauccagaaguccuaauuaugacucaagcucacccauaaacuuggggaccaccuucgcaccaacgcuguccacugggcuauuuauggaagaagccacuaggaacuguuaggcggcuccaugugucuggcuaacagggucuuuauucauucaccucaucacgguauucagucuugaugcuagugugcacgcuuccuaagaauuacagaugggaauaaaaggugucuggguauaccuggggaguauauguuuuugccugcugauauaggauacuaggguagcuuguaugcaaaagcaugagcgucuagguuuaaaggauucuuuuuguuaauaucugaguugacuugguauggauccuuguuugauuuuuuuuuuuuuaaauuuuuauguauguauguauuugcuuuugagacagggucuugcucuguugcccaggcuggcaugcaguggcaugaucacaguucacugcagccucgaccuccugcugcucaagugauccucccaccugagccucccaaguagcuggaacuacaggcgcacaccaccacaccuggcuaauuuuguuuaauuuuuuguagagaugguuuugcuauguugcccaggcuggucucaaacuccugggcucaggccauccugccugccucagcuuuccaaagugcugggauuacaggcgugagccaccacgccaaguccuugauugauuuucuuaaccccuugauggcagcuuuuguagauguuucuuacuuccaacaauaauaauaaugauaaauaauaaacauaguugaaauaucuacuauuugcuagguggagcaauuucaguggucucaacugaaguagcugauuuuuguaaaaugcagaaauuaaaaucaaaaugaaaaacaggaugguuuucccagccucucuguacaauuuugauuaggguacaguuacagguugggcaucccaaacccaaaaaucugaaaugcuccaaaauucaaaacuucuugagcacugacauaaugcacaaaggaaaugcucacgggagcauuuuggaucucagauuuucagauuugggauucucaacugguaagaauaaugcauacauuucaaaauguuuccccagacaugaagggucaaagagaaaguucauucuaagagucacagaugcuuuuugcugcagauagaugauaugauucaucuugacagagggauucuucucuaaucugcagacaggagugagcaaagugccaccuuuucacuuguuuuaaaccuguacuuuacuccaacacuucaguaucuccuuuuucucuucuugaaguggcaugaaucuuagggaaaggugaggagcuccuagaaguagcugucaccagaaacgggccaaugaacuuccugguccaagucuucuguuuaaacucccaguuuuaacauugagcgucugcuuugcaaugaacaugaaacaaggaauuugcagcauugagggucguacgcuucacugacuugaggucaguguugcugguaaguaggccuauggcagugaaaaagcuuugaccccaauuccgugggggacagaacuuccuagagcauucuagaaaacaggguacacguggaguagaugccauauucagugcgauuuugcagcauaauguuguguuguggaaacuucccucuuaccacugugccccaguaaauugaacucgaaggugccucuguaccuuuugucucuuguauaggaaauuauaucugucagaaacauuucuuagguaaucugaguauaggaaucuaaaaacugaguacucuuguacuaaaaugagacaccaguuucucaggaaaacuuaaggaaagcauguuauuuaaaaacaauuuugaauauuucuaaacuuucuccuuugcauuuuuuucuccaaccagaggccuuggcuuagauaaaauaaacuaauaaaaucuuuuuuucuuuucuuguuuccuguuguugaaugacaaccucccugagcagccugguggcuuggaggcucugaugugaaguauagaauagguggagggcgaauaacaaaagccuuaucauguagauagcccugaaaugggaccacagucuuuaucuuugagaacuguccagugacugcugcaaacugggcagcucuuuuggaaaugagcagucucugauacagcugguagguagaaccaauuuggccccuaauaggcuaacuggagccaguaguuuaagggggugauuauuaauuugccuuguguuugucuucauuuagaguaaguucaucaggcuauguuuucaugguaccuugcaucaaggaaaaugugguucuguaagucuucauaucaguuucucuucgagaguaggaguaauaaugcauauauguuugcauauuuccaaaugccuuuguuuagggacucaauaaguauuuacuauuaaauuugauuuuuuaguugaauaaacauguuuuaaacaaaaauuauuuccuaauuuugacucagagccuagaaacuguuauaauguguggcauauacacuucuuuuuuggcuaagaguagaguuagaaucuacuuucuaauucauccauuuugaacguugaaccugaaauccagcucaucuuuaagauuguuguaucugcuagguuuggaauuuuaaacuuggaauuuuggggucuccuuggugguguauaguacuuccagauauagacagcauagaugggucucuuagcucaucugaaaaugggagcucaaaauuuuuucaaagaucucauauuuacaaaugaauaaguauaauguaaaaugcaaaaaugaaaaucaaaaugaaaacagggugguuuuccuagccucucacuaggauuuugauuaaaauacaguuacagguugggguuccaaaaauccaaaaaucugaaaugcuccagaauucaaaacuuuuugagcacugacgugacacacaaagaaaugcucacgggagcauuuugggucuuggauuuucagauuugagauucucagcuggugaggauaaugcaaauauuggaaaaugugaaaaaauaugaaauccaacacacuucuuguccaaagcauuuuggauaagggacacucaacccguuuaauccaagcacuugguggagaauguugacagucacuuucagagguagacaaauuccacuggcaaguuuaaugacugaugguauuauuauuguuaacucacacuugugucaaaggugcuugugacauagggaguuuugcucucuccagcauguccauugacuugagcugguucccgcucaacacacagaccucagggcccuggggaaauaacuuaggcagcccaaacaagaccccugaccucugcuguauaggcagauuucauuagcaaaucagaaauguucuauuuaaaguauauuacagugauucauuguagauuaacucacaaaucaagacagaccagugcccuuuugugauuauuuuucaucagccucaggagccucuagaagccuccuguggaggucucacgcauggggugacaggagucaaagugcuuccugcugauggguguccugauuuuuuucuaggucuaauaguaucagcuguggguuccuuccuguagucuuugugaucaucugacuggcaaggucuccagguauccacagcucacaaguuacuauuggcgagggcuuggaacuugccuccugcccagccagugauagcauguucaugcaaguccccacuggccagcagggcugcuggaauaguagauggcucucccuggggaguucugccugguucaagcaucauuaccguggggaggauuucuuugacccacaccuagucuaggcagguggugcaagugcagagacaccugucacagccuugcuguggguugcaucacauuccuccuaaaagcuccaagaaguucacuucucacucacuaagugggauugagagaaaaccugccuguaguuacaauuuuccuaaucgaaacucaccucuuuucaguaggacaguacaaaacaggcuacuuucucaguaaauaauuacuaauaacuaacacugauauacugccuguuuacuaugugccaaguaccuauuccaagcauucuguguauuuuaagucauugaauccucccagcaaucucaugagacagguauacuauuauuagcccuaguuuacaggcgaagaaaccggagacagagcaguucaguaacuuguccaaggucuccaguccaguggaaccuggaauaacucauccagcuccaaggcccaccuccucaccugucaugccucucaucaccaaaugcaagcuaguuucagggugguuaauuuuggagcugaugagcuuuacaggugauugaauuuaaucauuuaugagaguaggcagguaggauaugccaagaaagagaucuuacucaguaaguuuggcaggccuccauauuuugggccuuucuuugcuucccccugugaucccaaugaacuuggguaccaagucuucuuguucccauuacccuuuucuuggaauagauuuucucagauaaucuccaucuuucucccaaucuccucuuccuucuuccuuuuucuuaaacaggaugagccuguuuacugcugggggcaggguauguauccccaugagucaggggcuugauugguaggggaggugaguguucaugcugcgucccuagacaucuugaaugucccccaauuugagcaaguaacacaucacuuaguucugcaacagaaccagccacacauugguguguguuuggcuugccucugauuugauguugcucuuuucucacgaggcuuggacaaaacuccugcuuuacucaaaucuuguuugaguuaauaucucagccuccaggugaaaugaggaaugaaauacagauuuuaguaucuaauauaaaaccauaacuuguuuuuacucugagcuccaucuugggacuauauucuauccagaggcccugaggaacuucucucccuccuuuguuuugauuuauuaaaguucuugaauuauaucccauguuauugaucucagcaaauguggguuucaaaauugagagagaaguaaaucgugcuguguuguuacugugcguuuggcugaauucuguucaaccucuaaaggaaaggaaauauaucaugcugcagucuuuuaacauaaaaucaguuuacacuuugccauucuaaaaaauugaucaguucaauacauuugauaagugccgcaaguaaggauuuacucugauucaguaucauugucaaguccuaaauuuuacuuaaauuuuuuuaacuuacaagcugucuuccucuaaauuuaggauggaaggggacaaagaaguuuuuagauuuuugucacugauuuauagcauguaauuaaggucauuuuguacuauuuugaagcuccauuuuguuucuugguuauguuguucuuagaaggaauacuuuaaaauuguugaguguauuuaguuaauguuucauauaaaaugguaucuacuuccccucccccagguuaggagacucugaaugaugaaauuccucugaauuaucuugaaguaucuucuuagaaaguaauguuucuccaauucauuaagcuacuaagaguuuucugguauugaaugaaaaagaauuguagguauuucaggaauuccugaauagcuguuuuauaaccagacugaugaaaagaaagccauuuuagaugugggguuguauguaauaaaaguuucaaauuuuaaaaauaacacagaaaucugacauuuauuuuagaaagugccuuuuuuacauugagggagaaauuaccgaaaggcauaaaauaaguuuuaucugauaaauauuuaaaauagaaaugugucugugagguauaacuuuuuaaaagacucaacccccacaaaccaguauuucuguugauauuaauuuuagaaaagauuaauuacaaguauucaauuuugaugcugaucuauaaaauauauauucuaauuaugcaggcucuaugugaaaaugcauucuuauuggauuuuaauauuguuuuauuuugauuuuaaaaauaauuuugaagauaccuacagcauauuguaaguauaaauggcucagaaguuaauacauuuuaagauacauuuucagaaaauuacagguuuuuuuuuuuuuucuuuuaaguccacaacuaaguuugauugcuuuaauaucuuccucuuaggaagagauaaggguaaugggaaguuguagagauaagcuaaacuuauaccaacacuaguuugagagccauucgauuuuuuuuuucuugcuauuuuuuggcaacaagaaccgcacacaccaguagcagaguagauaauacaaccauuuaucaaccuuaaagaaccacaaguguuauucuuuaugcuuuauuacuuugcuucagaauauugccuuuagacugugaaauuguaccccuguuuauuuacgauuuuuauuuaaagauuuuuuuuuuuguuuuggagacaggaucucacuccaguugcccaggcuggaguacacuggcacaaucucggcucacugcagccuuuaccuccugggcucaggugauucucccaccucagccucccaaguaacugggacuuuaggcaugccaugcccaaccaguuuuuuuguuguuugcuuuuuguuuugguauuuuuaguagagacgggguuucaccauguugcccaggcuagucuugaacuccuggaaucaaacaaucugccuugcuucagccucccaaaguguugggguuacaggugugagcuacuguacccggccuaauuuuauauaaagauucuuaaucugucugucugguuuggacuuaagcucucuguauaauaaaguaauugauaagaugauaugcaguucuggauuuaugccagauacauguuuuauaagaaauuuuacaugguaauuacuuaaaauauaagauucugguguauugaaauacguauuugaguagccugccauuuuaaaguuauaaugcaaguuaacuucuaaauuuuaauaaaauuuugaguuuugugaauaccguuuucuucagcaaagcucaaguauuaggcuauucguguaaaacuauuauaucuuugggcacauguuucuuaauaugauuuuaaaaggaaaaaaaguagguuuuaagcaggucaugguuuauguuccagcauuuaguuaaaaaaaaaagaccucuaaucuuauaaugcuguuaauuugcugaacacuuuaucuuugcagaucaauuucacauacuuuuaucugguucauuuuucacagccuugcuccgagugagguguucuuaucaucaguugacaaugaugggacagagauggcucaaggauguugggcacccaggggugguugaacuggcaguuacgacuugauccagguuaucugauuugggauccagucugcuuucuccuaggucacagaagccuuuugauuuuguuuuucuucuuuuuuaauguuaagacagguaacugacuagggcugcaggucuggcggcugcuuguuuuggguuggucuucaaacccuguuguucccugacauccugccuucagcacagguugcuguacagcuuuuccugugggcccagcuccucccuccaggggccuuucuuugcagaagcugcucuuucugccuggaacucuguucccuuuccuuguuucucuuccuuuccuucuucgaauuuaagccuaauuacccuccacgucagcgcuuccucccaccuuccccacuguauacucuccaaacuccauccacuucccucugcuuggaacucuuuuucugcaguguauuuuuguggcacuugaguggcuuuguccuuagacuaaguucugggaggaugggaucuuuugccaguuuuuuacccauuguauucucagccuuagcaggaugccucauacuuaagagguacccacauauuuagguggauggauggauggaugaaagaaugaauaaugccgauucuuucauuauauggacuuuguuuccuuucuuagaccauuggaaucagcugaucgucuagcacuuggcuagauuugaacaaauuaggaauccuauguucuguuuaguuccaacuccaaucaauuaaccaauauuuauugagugagaggcagaaugugaagcgcuguaucucuguugucuucucuguuucucucucuuagcauuuuuucauguuuacagagcaucaagcaugauucaaguaguugcuggaagccgccaggucaaagugugcagagaacaaauaccaguaugaggggagcuacauaaacauaugcacacauauuaaacauaagcuaugucaucuguagaauuuaauaaacuaggcuagauuuaaaaucuuucccuuugauguguaauacgucaugguuuugaacauuuucagaaaauggggccacuucucaguuacuccagauaaaacuuacucuucaaauaugacagcauuuucuucaccaauguauuuucuucacucauuuuucaaaaucccuuuauugacccugggugccagaugagugcaaguuggggcacccauacaaacccacauuuuaaacuucuuuguuuguuucagggaagguuugaaauaguguaaauuuucucuuaguccaagaauaggcuauuuccagccugagcuauaguaccuuguuaaacucagugaaagcuacaccuuucaacuucguaagcuugguugccaaaauguaguucguuuggaaugaauuauuagaauaucacacacacacacacacacacauacacacacacacacacacauucaaaugugauuaucuacuggaaagucaguagauaaaucaguugacuagaaaguuuaugguuuggauuauuuuuguaauguuauuucauauuucccacccuuauauuccccucuuugggaaugauaauuugagaaguuagcuauguauuagccuuaguaagaaacuguauuauguuuaucagagaaugaaacgaaacaaauuauuccuccucuuuuagcuacuccccucccccgccccacacacuuuuaaccaguuuuaggauuuuauuaauuaaauacuuugccacaugucuggucaguuggugucuuuguauaagaaugguaccacuuccugguaccaaaacagagauauagaucaauggaacagaacagagcccucagaaauaacgccgcauaucuacaacuaucugaucuuugacaaaccugacaaaaacaagaaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuaggcaguaccauugaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacaaaaugagagaaaauuuuugcaaccuacucaucugacaaagggcuaauauccagaaucuacaaugaacucaaacaaauuuacaagaaaaaaacaaacaaccccaucaaaaagugggcgaaggacaugaacagacacuucucaaaagaagauauuuaugcagccaaaaaacacaugaaaaaaugcucaucaucacuggccaucagagaaaugcaaaucaaaaccacaaugagauaccaucucacaccaguuagaauggcaaucauuaaaaaggcaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauaugcccaaaggacuauaaaucaugcugcuauaaagacacaugcacacguauguuuauugcggcauuauucacaauagcaaagacuuggaaccaacccaaauguccaacaaugauagacuggauuaagaaaauguggcacauauacaccauggaauacuaugcagccuuaaaaaaugaugaguucauguccuuuguagggacauggaugaaauuggaaaucaucauucucaguaaacuaucgcaagaacaaaaaaccaaacaccgcauauucucacucauaggugggaacugaacaaugagaucacauggucacaggaaggggaauaucacacucuggggacuguggugggguggggggaguggggaggguuagcacugggagauauaccuaaugguagaugacgaguuagugggugcagcgcaccagcauggcacauguauacauauguaacuaaccugcacaauaugcacauggacccuaaaacuuaaaguauaauaauaaaaaaaaaagaaugguaccacuucuugcugaacaguauuuuuaucucuuugaugacuuucccuugaaccaagaacacacuguuuuguagcaggaagauccuauaacucuaugcugaguauuuuuguuuuuuaaaagaagauacauaaguacuggaggaacacagugcguuaaacuuauccugaggauagauguuagggugugucuaacccaugucuacauuuaggguacuuuguaaauaaagcccauaauugguacacaugaguaguuagagcaguucuaauugcaugaaaccugucugagagaaggauucauucuguucuuggugguugagaagauuauaaguguaggguagagcugugugucauuuagaaauguuuugcuaggguucagacaugcugcuuuucuggugaguggauauagggugagaggaaaggagcuggauuugcccugauucuugggaaaggagaggggguuggggauucuggcucagggucggggguucuggcucagaguuugggcauugggagcaaugauuaagcagaggaguuggcuuaugguguuuuguggcgugcagcugauaggccuucauggauagguauguuuccuguguagaugguggucuucaguuacagccuugccauggaggaaaucuuuuuaagguaaacauacaacacagaauuucugaauuucaccgucugagauagucuuaagguucucauaacuaaaugucuauaccuaguaagugcuuagaaauauuuguugaauaaaugaauggaugugauuuuuaaaugaaaugucucuauaaauugauaucuguuucugaagcaucuuaaugaaucaaagcuuuggagcaccaauucuuuccauuguaaucccaacacuuugggaggcugaggugggcagaucaugaggucagccccaaagaggggaauauaagggugggaaauauuaaauaacauuacaaaaauaauccaaaccauaaacuuucuagucaacugacuuaucuacugacuuuccaguagauaaucacauuugaauaugugugugugugugugucuaauaauucauuccaaacaaacucacagaucaugaauguaauaguaaacuaagugaugcacgguaguaaagaaccucaaugaaaaaucuuaaugcaaauauuauuuuaaaagucacauuuaauuuccagauuauuucauggauugccaguggaggagcuggcuuauuuuuagacuguuuuuacaugacuuaauguaauuggugaguaauuuucugcacaguaauuuaaugaguaagucaucuacuuuaugcucagucugggcugggugcuugcucucugggaucucccuaaggaguacugguggaaaugagguugccauauuugacacaagggccgaugguggcuguguggggugugaugacaugagacaagagugucaaggcuugaauguccaaggagguaaaacuugaggugaggcuugaaagauuucagauuuuaacagugagaggagaaaggaaggaauugcuagauaaucuucacuaacuuggagauugaauagugaagagggugaccgaccuuguuggagguugucuguuguuaaaagguggaaaugacaugauguuguggggccaggcagaggaauugggauuuacuaaaguaaguaguaauaggaaaucacugcagauuucugaagagaagagugaaacugcaguuuaaagaagcuugacuugcuauguucaugaguacuucucaugacacugguauaauuugcugcuuauauagccauauaccagauacugccuccaguagguuuugcuuccuucccuuuuuaguggauuaccagugacgauuuagugauucaaccuuuguaaauaucaaguuuuguuuugaguuuuauaccucugugaguuauagagugcaaguaggucuuguagucuccauucucuaagaagggaaaugaaacucaagaauucuucagcagaauucuaaccaaguguggaauccauccaggaauaguaagccagcuuuucucuuccacuuacuacugaacuuccuaaugugaaaugaauugucuguuuuggaacaaaacaccuaggcuaaauuuacauuuuugaguuuguauucuugauaauuugaucuuaaaaugacaaaauaucaauaauucauuugccuccuuaauugucaacugauuuuuuaauagcuguaaaauguaauuuacauaccauucauccauuuaaaaaguguccaauucaaugguuuuuagcauauuuagaguuguggaaccaucacuacaaucaauuuuagaacuuuuucaucaccucccugaaaaaccuguguccauuagcagucaccccuaccccuacccugucauucucaacccuuuccaguccuaggcuaucacuaaucuaauuuuugucucuauaguucaauugguaucuuucuaaacuaguauuuuacaaaauguuacucuggauuuuguuaucagaagaugguuucagccucagcuugcuaguacuaugaccuugagaaaauuucuuaacuuugugaaauuuauccccauaucuguagaacaugaauagucauaucuucacagauuauuuugacgauuaaaggauauuuaugugaaaguguauuaagugcuauaugaguuaacuguucuaccaaagauauguaacugaauuauuuuauuaaauggucucauuuuaaucuuuuaaaauaguugguggaacauaauaaaacacauaauaaauguuuggauaggaaaggauggaguuuuauguuuuuaaggcgaugguuuuauuauguaugugauuuuaugguuugacuuuuaagauggaaggaguuuuucugaauuucccuggagaacuuaauauaguuguacuuauauuauuuuuggaucauuaaacccuuugagaaucuaaggaaagcuauguacauauacuugauuuuccaaaaaaaaaaaaucaagagguucauggaucuuuaaaacuauuuacacagucccuaauaccagguuaagagccccuuuaucuaaaaagagagauaugccgggcgugauggcucacgcuuguaaucccaacacuuugggaggcugagguggacgggucacuugaggucaggaguucgagaccagccuggccaacauggugaaaccccaucucuacuaaaaauacaaaaauuagcugggcauaguggcacgccuguaaucccagcugcucaggaggcugaggcaugagaaucacuugaacccaggaggcggagguugcaaugagccgagauggcaccacugcacuccagccugggcaacaaagcaagaugcugucucaaaauaauaauaauaaucauaauaauaauuaaaagagagacaaaauaauucuucaaagccgggccaagugauuccacacauugggaggaagacacagccaaucagcccaagguauguuuauuuacuguccaauuuucaguauguucuguuguucauauaaaaguauacucaguauaugcuugcucaagcaagggggauuuucuucuagcuaugagauuguaaauacacuauacauagagaagacaugaagacagcucuugaagacaaagcugaggggaggaagaacaggcagccagagugccuuucauacuguagcaauacucuuugggcugcacauuuuagagcgcuuguauaaacaagcauuggauucccaaaggcccuaggggaaugcuguacagguuguguggggcggccugauugaguuuauucuccagauggcuauuacucacaggccacuuaauaaccacuguuguuuauuucauuguuguuagauggcccaacaguacagcaucccucaguccauguaacaaaaauguucuuaccaugucuaaaaagcaaauuucuuccuuaccaagucuauucccaguugcuucccuuaauuugagauguauuauuguggaagaauuuggauaccaguagugaaagaauccagcugagaacaaaacucagaggugcuggaaaggggagaaaagaaaugccaguuaauggaauggcuggaugguccuaucagguaagagggcagaccacuugccacacaaccuuuggauaacaguccuuugucaggcaugggguuuuuguuuguuuguuuuguuuuuccaaauauuuuuuccuagucugugacuugucuucucauccucuugacagugucuuucccagagaaguuuuuaauuauaaugcagucuagcuuaucaauuauuucuccuguggaucauguguuugguguugcauuucaaaagucaucgccauacucaaggucauuuugauuucccccccauugaucuucuaggcauuuuguaguuugccuguuacauguaggucugugauccauuuugaguuaauuuuugugaagaguuuuuaagaucuaugucuagauucauuuuguuuuugcauguggaugucccauuguuccagcucuauuuguugaaaagacaguccuuucuccauuguauugccuuugcuccuuugucaaagaucaguuuccuguauuuaugugggucuuuucagguccacagccuuucagugacuuaaugcugaaaagagguggcaucuuucccuggggcugccuccccugcuugcccauggcaggauuucugaaggccacagucagccugggaaguuaggaugccagggaguuggcauggagucccugugggacuugguagcucuggggggcuucugaggaagagacucauuguuacuggagugaacgucagaagcucugcauugguggauuagugaguccuuuccucauuuucuccucuugugcaggcuucuuguuccuaaugcacucauucuaacugaugagauaauuacagcaaaauuuuguauagcuacuagaaccaggaauuccgucgacacaauuagaauugguaauccuuaccuucaaaucuucauucuagugaaaccuaaaauaaaauuagcauugcuuucaagcagagcuuuugugcuuaaauugccccauuucuguuccauaucuuaaggcugaccuccauuccagauuucccauuuggggacuuggaugguucuccuguggagccaaggugaauuuagugacagguuagugacucuggugggggacauguuugcaguagagcuccacucuuuuuuuuuuccuuuccugacaauauuuccuaacuuuucgccuucagacuaucauuuugacgcacaucaccccuaauuuguuuucguggcucuguacuccuuucucuccaauuacuguuccauuguuacagcuaccugaaagacauuuucccuugacacacgcuguccguaucucagacaccucagcgaggugacuguguugccaagucuugucaaagguuccaauuuugaaaccuuauaaaucucucccuugccuguauucagccuugcugggaucagcugucuugacagccuuccaucuggcuuuccuagcccuuccuagcccaccauucuaacggccuuacuuccugccuccaaaauuuucaagagcucccaauuuucagggagagugcgggcuuccuaggcuagcacucagugucuugaauuuccuggcuuuuacauaacugucaucuuuaauucuagcacauccucucaugcucuuugcuaccuaacuaagcugagugcucucccuuccuuccauuuccuauaaauaucuuguacuuuuccacuuuuaugucuuuguucucagacuucuaagccagugguccucaaacuuaggaauguaucagacuccacauggaggccuuguuauagcagggaacacggggcccaacucccagaguuucugauucauuaggucugggguggggccugagaauuugagaugcugccggccccagggacugcaccuugagaaccacucuucuaaacaguucucuaauucuaauacguuuugguuaaaagaaacaucgaauucauuggaggccauugguuauucagaucugugcauuggauuuuacauccaacagugcuaaaauuguguuuugaacauaaaugcauuuugagcuccugcuuggugccagcugacaggcccuuuguccauaaaacuacugaugaauugaagguuauacuucuguuuccucucugcauguugggugaggacacuuacauauuuagcugugagccacuggcggcuacacucugucauuacagaccaacaggcccuacagccagucagcugccaauuaacaaacuacaggcuuguauucugcaggcaguuuagccaagggaugccagcaucucuguuguuccugccguuaccaggccuaggcauugucuugcagcuugguaacuccaccuuucuaaagacucagguguccccaguuguacugguaaaagguuuugcauuuuaguguuaugguuaaauuugggaauuaaaaaaauguaggaaucauuccuuugucucauucacaguguaauugucaaccaccuguaucauuaguguuggcggggaaaggaggggugaggagucacuguggccauggauacaugucaucuguccaggccuauagccuauuaaaggcacuugauuugaguacuuucaacuuugcagggggaugggauguccaagggugaaugugauuugaguagggcaucuggaacuuuuuagaagauaaucaguaccuaauagauuuuuuaccgcauagauuuuucacuucucauugcacuugcauuuugcugguguagaaugcaggccuugaccguagaguuguguggguugcacguggauuagccucacacagagagguaaagggucucuaauuuaauggaccuuugugaaggauucuaaaguaaaaguguacagagugcuuucugauuggcgaauguaccuaugauacguuuuauuugggcguauuuucuuguuuuccuuacacaccuguagacuucugauaucugacaugaaauaaaacuuuccaagaaaauaccucaagauuccagguuuuuuccuacaguucagcuuacacguguuaucacaucccauagguaagugaugaagucugccgugccagugcuuugggaaagcacccugcccaccguuuugggaguugaacuuugugauuguuuagaauaccagcuuuuaauuguuuguuguuaaauuuuagucaaucucuguacauucuucacuuugcuucauaaacuuugauaaguuagcaaugggauaucccuuucugccuagguauauuuauucuuuaaaaaauguacauugaggaagggaaaguaauuuuuaggaaaauuacagugugguaagcauacugaucacugagaccauccuaaauuugauuuuuuuuuuuuuuuguugagauggggaguguugcucugucgccaggcuggagugcaguguacgaucucggcucacugcaaccuccgccucccggguucaagcaauuccccugccucagccucccgaguagcugggacuacaggcgugcgccaccacacccagcuaauuuuguuuguauuuuaguagagacaggguuucaccauguuggccgggauggucucgaucuccugaccucgugaucugcccgccucagccucccaaagugcugagauuacaggcgugagccaccgcacccaaccccuaaaucugauuuaaucuuugauucagaagauaucucagagucuuacaggauccauguacaucuucauuuuuuuuccuccauguugaaaugaauuuaguuugaguuuuaacuuaauaggguuuuggauagaauaaaucuauauguauauguauuaggauagagacauaauaggaagugugguguugggagacagagaauugaaaaucugggacccuagcaacaguugcuucaauaacuauaguacugaauguguggccuuuauaucugugucucaguuuuccccgacuccagucauaccugcauuacacauaguuugggaaagacugccuucccucugcaaaguccaucugauuggaaaggcuggguagauaacugcaauaaagagauugaauguaacggcguuccuccuggggaugggaggugaaggauucagggauaggcaguagagugaucaaagaccuggaaguuguagaauucagaguucugcagccaguugacauagcugccuuguuaccccacagaagauucauauuguuagugaaaaauaugccaccgagaagaccugggcuugagucuugcuucuuuccugcccuguacaccacguaccagcugugugaucuuggggaggaccuuagaugaaguccuuuucccaucuguaaaauguuggugaugaccaccaucuggucuuccucacaugggcacagugagcacucacuggaauaguguucuuccugucauagauguaaagcagcaaacugaaaguucuggugguuuaucaugauuauuauacuuguuggcugacuuucucaugggcuucuuagauguuucucuuaaaggcagaauuuuaauuuaaaaaugcauauuauguaagaauauuguaguugacuuugagaauucaugaacugaaacacuuaaacucucucaggaccucuaaauauuucuugacuauuucagagcauuugauuuguccuaaugcuauggaguuauaaaaccauuaaugguaugauagcucuggaaacaaacauuaauucauuugaauucauuagaaugauaaagcauauugugcagggguuuucaggcauucaguucauaacuaucgaaauguggaucauaacaaauuuuguuuggguguguuuucaugucuaaagaggaucuuaucauaacucucauacuuauuaguuuuaugugaaauacaacuagcaagcauauauacauaacaaaggaaauugcagauuguaguuucucugagauugaucuauuuuauuaaauuauuuuuauuaaauaauuuuuuauuuuauuuuuauauuuauuuuauuauuauuaauuuuuuguuauaauuaagucauucugaccuuauaauuugagaagcaugugcccuguuuucaugcuuuaguuuuauuguaagcaucuauauuuagggaggggggugugguuauguguuuguauauguauguucaaguauaucuuuauuuuuauuuuauuuuugagacagagucacacucuguugcccaggcuggagugcauuggcaugaucucggcucguugcaaccuuugccucucaaguucaagcgauucucuuuccucagccucccagguagcugggauuacaggcagcaaucaccacgcccggcuaauuuuuguauuuuuaguagagaugggguuucgccauguuggccaggcuggccuggaacuccucaccucaagugauccaccugccucggcuucccaaaguguugggauuacaggcgugagccacugcgucuggccuauaucuuuauuuuuuaaaguuuacaaggugauaguuuauuaguaagcguucaugccaauaacaguuucuguucaaauguaguuaaagccugacuugaagaauucugguagcgaaaggggaagauuucauaccucuuaauugcaauuugaacagaaaguggcaucuuauagaagucuuaauuuuggcauguuuugccauuaaaaauuuuuugaauuucaauagcuuuagggauacaugguuuuugguuauaugaauuaaucgugugugacgaagucuaggauuuuagugcauuugucaccugaauaguguccauuguacccaauagguaguuuuucaucccucacccucuucucuuccccacucugagucuccaguguccaccuuaccauucaguaugccuuugcacacccguagcuuagcucccacuuaagaguaagaacaugugguauuugguuuuugauuucugaguuacuucauuagaauaguggcccccaguuccauccaaguugcugcaaaagacauuauuuugcucuuguucugccauuuuuaaucugauuaagaaucauaagaauaauuucguugucauagauauuuuuuugcuaaacuuauuuuuaucauaaacaccuaauuauucacccauagucugagagguggaguggaguaacaccuccguugagcaccuccguugagcacagugccaggcacucuuagacaaugugcaggcaguuauuauaacuccuguagaaugcaauggcuuuauccucacuuuuuggaagaggaaacuccuucaaaguguugcugucauuugaacccaggucugcugcacacuagaagguccguauuuucucccaugcuuuuguauagaggcauaauuacuggcucuuuacccuaguguauggcaguaaaacaaauucuugcguuuuagcaucaguaaacuuaaaggagaauugccucaauuuucuuugccuucuguuacaaaguuauaggaggguuaagcuaaguacacccucuuucuccagcaaagccugcggguuuuccucucuuccucagaaguucuuaauuacuguuggcacaucuuguggugaaagaauauaccuuguggggguggaaaaugaaauguuaucuguaaugaguaagauuguuggccaacccaaagaguugguuuaaacaaaaguggggaacagcuugaaugaaucugcuuuucauagguacuuuuaacacauaaccauaaccugucagacauaccaaucgacugucaguugcuuacaugauuguuuuagugucuggugguggagccccaaagcucugucuguauuugccagacaggcaugguaguuggagcgauguauguggucaaagagguccaaaaacuugccuaagugaaaaccuggaaauggagcucuugguuggaguucuugauuuauagguagaaauaaauaccacagaaacagugccacccuuucuuguaucugcagguuuggagauugugaacugauuaaauaacuguaaauugagcaugggugugcugaacccagagcugguuagugcagcccugucuaggacauaauucaggccaccauuuuagaaguaugggucuuuaguccuaagagaaacuaggggaaaagugaauucauucaauaaacauguauugcuucaugguagggaaacagguaaauggggaacuguucaucuauuugggauaggcagauguaacccagagugcaaugcaggugagcagugugaagaguaaggaaaagucacugggugucagggaagggaaauuacacauggcugcugcuuggauaagaaugguagauaagauagaauguagaaugcucacugcuuccuccuccuuguuuuuguguuuguuuuugaaacaaggucuugcuguuuuccccaggcuagaguacaguggcacaauuauggcucacugcagccuugaacuccuaggcucaagugauccuccucucagccucccgaguagcuaggacugcaggugcacaccaacacguccggauaauuuuuaaaauguuuuguagagacagggucucacuacguugcucaggcugguguugaacucccggccucgagccauccuuccaccuuggccuuccaaaguguugggauuacaggcaugagccaccacucucagccucuuccuuuuucuuauacucucagccuagauauccuuuccuccaugaaaugccuucccugacuuucaccccaguucuagguuagguucucuuacugggccaguguagaguacaguacaccacacuuagcagaguaucuaccuccuggauuaccacagcucuuaucucucuccuaccugacucuaagcuccuguaagagcaagagccuuauagagacaguccccaguacauaguagguacuuaaauauuugcuaaaugaacuaaaaugaagcuguaaaaguuggaguccaauuguggagagccuuguaauaauacuagaugauauuuauugagugcuuacuauguuuuaggcacuguaaagguacguggcauauauuaacucauuuaauuuuucaguaaccuauaaaguagguaccauuguuaauccauuuucuaguugaagaaccugaggcaugggaaguugggugucuucucaaaggucguucacuuugcucccugcuucuggcuccuccuguacugcugggaaauuuagaguggcuccuggaggcgguggggacuguuagugcuauaaggggcccggaggugugagcacaugugcucucugggaaaggaguccugacauuguauguagauggacuacaggaaggggagucgcuugaagcaguccagagucaccucugaaauggcaaugcaaaauauauucgugugauuuguugaucuaacacgcaggaugcuaagugcuaggcauuguugaaagugccuuaaauguuaacugauuuaaugcuuuuggcagcugcuugagguaggcacuaucacuauccucuccauuuuauagaugaugagccugaggugcagagagaucccgcagcugguaaguggcagagccaggcaagucuggugccaggguuucagcgacuaucccaagcucugcuuagucuuccuguacaaagggaacgauaacuaguagucuccagugauguuuuuguuccagauaguacaggaucaaagugauauuuuggagacagauccuuccauuuucaaaagcaucugccuuaaagacauuugucuagaaauauuuauaugauuguaucacacuuaauaugugcuuggcuuagagcaggcaaaaacaaaaaacaaaaaacccaaagacacagguccugcccuuggggaacucauacucugcuaaggggagauagagaaguauguagacuuacaaagaaaaaaauaauuucggcugagaaaggcaaaugaagaaaauaaaacaagccaaugaaagagaccugugcauuccacugugauagccacgaggugcauguguccauugaguacuugaaacauggucagucaaaauugagaaaugcucuaagggugaaguacacacuggaauucaaacuuaguaugaaaaaaauauauaaaauaucucaauaauuuuuacauugauuauauuuuaaguguucauacguuggguuaaauagagcauguuauuaaaaugaaugcuaagugaaauaagcuaggcauaaaaggacacuuuuauugcacuuaugagguaacuggaauagucaaguucauggaggcagaaauuagaacagugguuaccgggggaagggagaauagggaguuacuguuuaauggguagaguuucaguuugggaugaugaaaggucuagagauggaugugguaaugguugcacaacggugugacgauacugaaugccgcugaacuauacacuugaaacuaguucaaauggcaaauuuuagguauauuuuacuacaacuuuaaaaagccaaaaaauaugugucacacuuuuaaaaaaugugacuacuagaaaauuuuaaauugcacacguggcuugcgucauacuucuguuggagugugcuggguagagaguaauggguaagauggucaggaaaggccucuuuggagagggucacauuuguguccuaugaaaugagagggaacugaccacacaaaaggcuugagggaagcauuucaggcagaggcagagcggcugcaaaggcccuggaguggggaaaguguguaugcuuagggaggugggaugaaguuaggauggaaaggggcagguccccgaucaccggggucuuaugggcuugaauaccacugcucugcauaaaacuugaaaauagaaacaaagcaauaaaaaacucaaauuuccauacagauuaaaccaugcgaaauugcugguauucugaccuauuuauaugauucagccuaaucuuguguuugugguucugggguuugauucuuucccuagugauguacuuguuuggcuagcagagaaggcacugccuugcuuucuaauuauuugcuaauugguggguacccuaaagacagcacccccucuugcuggcuuacauaccacuuugccugacaacaaauuuguguugaaacggaaggaaacccagcugcucacaaacuaaaacugucacaaguaauaaaaaauccugaagacaguaccuugaacauuuucuauuucauaaacuuugucuuugucagcuugguggcuuuuggaacccagagggagcaauaauaguaucauuagcgccuuuggauccuggcgcugugaagucacugggagcauuuauuauuauugcacagguagacuuuucuuucuggaaaggucuuggcucaggacaaguaaauugaaggguuggcuuucucaguagggaaggguuguuaggaagguaaauugggguuuguuuauccuucuguuaaaggccaucagugcuggcucaagcagucucguggaggcugcugccacccuguuuuuuuucccaaguccaccuugguggccucauuguguguuacuacugcuuuuccuggagcagggggucugggacaaugagaggcaacccuacaggaggugcugcagaaugaauuguuuucuuagugguuuuugacuccagaaccccugguggaaaauguuuguucauauuaaaggagaagaugguuaauaccuaaaaucuuucaucuuauggaaaguuuuuuugggcuuugaaacaucucuggccaccugcugaggaccagugagucuggcaagugguaaugcccacugccugugcacuggucuuuuguggaggaguucugugccacauuugaacuccccagucaaaugguucuaguggugucucaggugguaugaagcagagaggugccugcauucgguucuccaggcuggcccaaguuuaaaaguugacuggguacuuugugcucccuugggauggcuagauauuuccucauaaccuaggugcuguguaagcuaauuuguuaaaaaaaacaacaaaggccccauguuauguaauuauugauaucugaaccacaaaccagaaaucugugcccagaaaccaucccacaauuucuagauuuccaccccugcacauaucgugguccauuucuauaggaucacuguuggugucaucuuuguuuauuuacuguccaauuuucaacugcuauaagucauuaacuacauuaguugaauacuuucuuaccccaaggaauuccuuauugcaguagguuuauaugaaggugggguuagcuuuagacuuagcugcagagucuucauuuauuuuucaguccuaaucagcuuuauuuguuuauuuuguuuuguucaugucaggauuggucagauuguugugaccaccagcuuaguuaugacacggaccaggaaaacugugugaccuccccagagcuggcuugagcuacaggaauaagcacuuucuuaauguggggccuugccugccugaaagaucagaugcaucugcauaaauauaaauaauuacuuguauucuuguuuuuuguuuuguuguuuacaguuuacaugaacuauuucacguuuuuucucuuuaaucuucaugugaaauuugggagaugggcacaauuauugucucauuuuauagacagaaaaacucaaccucaaaguuuuaguccaggugucugacuucaggauggaugcucuucgcagaccucccaacaacaauguugccugaccuucuggcaaguuuccaagagugccaggaccccaaauuagaaaccugggugcugugcuuacacuucaugugugggugaugaaggggaaaccaugggauugcuaaggcucagguuccaccguugcaaaauggggcuaauaccugcggcguuggaugcugggaggauuuugaggucuuauccauguaaagugauaacagcaccugacacacaauugcucuacgaggacagcagcgacuauugucauuuaaagaaauaaaucaucauauccucucacuuacccuucauucaauaaguuggcaagaccuguagauuuuacuuacuuuaauaccauugacucugcccuggcuuucuaauccuucugguuuggcacuucuuacacaauucccgccauaauuggauggaucacacugccuccagucaagccccucuaaucugucaucugcacuacauccagccugaucuuuccaaacacaguuuugaccuucuccuugaacaucccucauuugcuuacagaagaaauauaaaucuccuaguuuuucaccaaagauucuuuauaaucugacccucuucuuagucuuauuucaccuaucccgaacacacacccuacccuuuaucacacagaacuaaaacuccucucuuuucucauccugucuuggugcccuaaaugcccgcauuccgugugccucauuugacccuauucucccccugcccucugcacccccuccccuccacacccccuccccucugcauagcuagcaccaacucaccuucagcuuugggaucuuagcaccgugcacacacccugcacggugcucagugaauaaaugaauuaacucuugguguaaguggauacaguagccagcaucuuuagccuagggggucucgcaagucucuagccuuucuaagggguuggcaaggcuggacacagacuagaucuucauggggaaacccugggauggcagcagagccaccugaagaccuggagugugcaccugggaucugaggggaagagaaagaagugagaucacagucaccaaaacaucugcuuuaucagcagcaaaaaagccuaccugugguugaucugaauucaaauauaugccagcagcagcugucucaucagaaacuuaucuagagcugucauuuggcuauuuagaauuuaaaccacaauugcuuccuaaauauucucugcagaaguaacugcccuuccccaccaagcaacaaccaggcaagaucaguuaucugugguuaccagguacaaaaucuccauuagcugaaauaacagccaggccugcuaucuguguggucugcaggaccuuguucucugugguaggaauuacaccuguucacagucauuugacugcuuucuacugaagguguuaaagugcuaggcuugucuuacuguuguucugugaaaaagacauuuaaugccuccuaucuuuauuuuauguuuuaugucuuuggaaaaauggaagaacuauggaaaauguauugcguuaccuguagguucuagaccagugguccccaaccugcuuggcacuagggacuggcuuugugaaagacaguuuuuccacugaccgagggcaggggugggggaugguuucgggaugauucaagcgcaguacauuuaucauuagauucucacaaggagcgugcaaccuagaucccucacaugugcaguucacaauaggguucgugcuccuaugagaaucuaaugccgccacugaucugacaggaggcggagcucaggugguaaugcucacuggcggcucaccucugcugugcagccugguuccuaacaggccacggaucgguauuggucuguggccuggggguugggaaccccuguucuagacaaccagaaaucuaagccuuucuccuucaugaaaacuguagagaugcagagccuucuaaauauguuuccugagugagcacuggcaucucuuugacuucagugcucagauacacagguaacgaaugaaaaaaccugaaagaauugugagauccaccugguaggugucuuguaaauaccuguaauugcaaaccugcggggugguggggguagggugggguaggguggggugguggcggggagaguuucugagauucagguuacucucuuuauguuuguuuuagucaacuuuucacugaaguauaacacaaucagaaaaguacacagaucauaaguguacaguuugaauuuucaagucauccuuuuaauauauuaauauacaauacaugaauaauuuauguauucaugccacgaacaauuucuuucuuuaauuaaauuaagggguuggugaggauggcaguaggagccaaguucugaguucuguucuguugacauaacuguugaaucacuuccccccacucacuuguucaaggaggcaagguuuuguuuccuggggguaauaucuaagccauucacagccugaaauguuuaccucuaauuuuguuucuuuagcuaucugaauacgugaauuccauuaaaaccacacacauagaaaaaugauuucuguucugcaugucagauuuuuuguuuucccaaugaaagugcaccaaagaguuugcaaguagcucugauaaggaaguuccuuacugugacuggauuuguuuucugcccuuauaaagaugccucucuuaccugcuuuucugucuucccccuuaccguugucaaagaaaccuuuucccuuuagggcccuagcuuaucugucaaguucauagcugucuuuucuccuagaauauuaugugguuaccacccuccccgauccccacacacaaauacaucaugcagucuuuugugggcccaauuuauuuaagucagcuaacuacaggcuaguauaauuuuuagcagauuucaccucauucuuguaccugguaugaaggcgguacuuucuggucccauuagugauuaauaccagcucuggugucaccugaaguuuuuucagcuggaguuacccuacugccuuccaacuuuuaaauuaugaauuugcagauacacagagaacuugaaagcauaggacaauauucuccacauaaguucaauaauugguaguuuguuuuuguuuuguuuuguuuuuuuuuaccagauuugcuuuauuauucucuuuuuuuuuuuuuuuuuuuuugagacggagucucgcucugucgcccaggcuggagugcaguggcgggaccucggcucacugcaagcuccgccucccggauucaugccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaaguguugggauuacaggcgugagccaccgcgcccggccuauucucuuuauauacagcuuuuuuuuguuguuugguuguaccauugacaguaaauuucagugaucaggauacuugaccccugaggauucagcauuuauccccugggaaaaaggagaaaacacaaucucaccuaagaaaguuaauggugaauacauuucuaauauucaacccauauuuacauuucucaguugucccaagaauguauugagauguaguagacuuuuaauccucugcaguuuauuaauacaucagagaaaucccagugauugugcuggcuagguggauggaacgguggugcaacucauuauuuaauacuuguacacaaaugagcuauuuuccuagagaagacugaacuuuccauaucuguugcuggcaucuugcuuucuugcuugauggaacaguguaggcaagaaugaaugaaugagaaugaauguauaauacccauuacaacuguaaaugggcuacuuauaacuuccagaaguccaggaaugugucguuuauuugcugaagcuaauugagucugauaccagagagaugaggcagcuagguacauacaucauuaacaaacaagaaccaucucuugugugauucaucuaaaaccugguuucacuguagaagggaugguuggucagggcagaauauauggacaggccucaggaguucuccagguauuugucuuuuugaucaugaauagacuauuuuuucgguagagucuuagauuuaucaaauaauugagcagauagaacauuguguuccauauaccccccaugcauucccccauuucaccucuuacuguauacuaacauaucuuguauuaguguggcacauuuauugggauuaaugaaccaacauugauacauuauuacuagcuguaguccauaguuuacauuaagguuuacaccuuguauuauacacuuacaugaguuuugacaaaugcauaaugucguguaucuacuauuauauuaucauacagaauaauuucacugcccuaaaaauacccugugcuccaccuauuugcccacccccucuuccccugaaccccuggcaacugcucaucuuuguauugucucuguaguuaugccuuuccaacauguuguguauuuggaaucauacaguauggagccucuucagauuggcuccuuucacuuagcgaugugccuuuuaaguuccuucaugucuuuuugauggcuugauagcucauaucuuuuuaucgccaauaauauuccauuguguggcuguacucuaguuugucuauccaugcaugaagcuuacuguuuuacacaaaugauaggacauuucagcacauagcaguuguuugauaaauagucauuaaaugaccuaguuagauggacugcuuaauuuuucugccagauauguagugccaagggagaguugugauggaaaaggcaauuauguuguuaggcacugacuucuguuaauguacaguuaauguuuaaguggcuuagcccagcaaagguagguggcuuugauguguccaggcuuccaacagcaguuucuuaaauucucuuuagagcugcacuguccaguaugguagccacuagaaaagucuggaaaaauagccacaugugucuauuugaacuuaaauugauugaaaaguaaauaagaugaaaaauucaguaccuugguuguacuagccacauaucagcgacucaauagccauauguggcuauuugcuguuauuucggacagugcagauguagaacauuuccaucaucacagauuuuauuagacagcccuaaugcaaauaaaagcauucagagagaaggaugggauugaaauuaguugaccaggcugauucugguuucucuuuaaugcuuagcucuuuugugccacaauuuuacaauggaagagaugaagcucagaggucuguuugcugaagaacaguugcuuaagaugacuuuggggauaaaaaggcugccaggccagugaagcugugaaaugcccccugugugacagccccaggcggcauggcuugacaaugguuuaggcccuugaucagcuaguguuaaggaguuuuacagaacucucagcucuugcuuauuuaguuugguguugaaaaaauaaagaaagaaagaaaagaaaaagcaggggccuucucuaauuugaggggaugaugggguggguguggaaagggaauuaaacuucccaacuaauaaauuuggaaauuguacacccauuuccucaguaaacuccugcgguuguuggauaccaggaaugugaaaccugaaugcguaucagacacuugccacaggaauuguagcucagucccuuguaacugcaauugcucuuauuugggagcaaagcaaauagcaguuaaguuuuuuuguguuuuguuucuuugccagcacuucggauuugaucagaucuaauuucauucacgugguaggugccacgcugacaauaaagcauuaugggcugucagucuacuuagauuucaauucuguauucguuuuauguauggcauuuuaauaaagucuuaauuuuuuuucuucuaaacagauaacagacuagauuauguugugcuuuccuuuaaugucuaaucuggaaauuggcuguugaugcuagugaggguuuuuaauauaaguuuuaaaugaaaaugccaaauugcuuugucugugcauuguagcuuuuuaaauauugacuuugugccuuuugaaaugcuugaguuucuaagaggccuagcgugaaaaggcaaacuugacagaauaauauaucuaccauaauuccugugaaaagacuuaaaauauucugguauuuggaaguucagucaggaugugaccacuuggaaccaugacugucuauaaacacaggcuuagaauugauacuuuucucuaagaauaggcacagagaaaauaguauauuaucuugcaaauuaaaaauuggaaaugccagaucucaaaugaagacagaguuuuccucaaucuuuaagcuauugucaucugcuaaagaacucuuauaagaguugcagaguuuuaaucaguauuuaacaauuauugaauuuguucaacuggcauuuguuuuaaacaaacauguugucucuuacaugaaaggcaggauaacguauggcuuucuuuuaucugcuacaauuuuucuguaauuuuugaauauaacauuuuaauuuagauacuguuucauguuagcaaagucuagaaaaauugauuauaguuucuuagcaugggauuguuuucuuaaaagccgugaaagggaaaagaaucaauauuagggcuuuccgaauggcagcuuuuuacagagcccccccagcacgauugauuauagcugcuuuuguaaaggauuuaaaaagaacaaucuguauuaaaaacaucauucuuugguaugagcuuuaacagcucuaaauggguuaccaugggggcugcgcugcaaugugaccacuugaacggauuguggucaucaccggugggccagggcagcgaggcaggggaaaggcucuuaggugaggcauugcuggcaugcaugccaaagagguuaccguggcagcugcaaucauucagccgcauucuuuagccuccaaagcaggaggggcaagaagcgugucauuuuucuacaggcagaguguaagguuaagcagcaggaagggagagucagaggaugucuuuguuccagagcauuugccaaagccagguauguccagucaaagggauaaugcaaccgauagcucccaagccuccauauccucagcuguugcuuguugccacugagggguggacauguuuucauuuggcaucuuacaugugagcaucaugacuacagacucaucuuauaccaauuaaauaauaaacuccacucugugggcagagguucugucuggaggugagugugccugaagcaguuaaaucuauuaaauauuagaaacauuggucccauccucacagggcaugggacagggcccaagcaagagaccauuaauguggacugggcuuccagaguuuaacucaguaagacucugugggcucuagaaaauucaaauguaacagguaguccaggugcuuucauucuaaaagagggagcggggugcucauugccauuggcuacuuuacagaaggcauuuauuugcaggaaugggguacccuauuaauuugggaagaauugaauauccuagagaguauggggauuuuuauaaaauaguguugaauuuagcaucacuuuucauuuagcaccccugggugccaaaucccacaggggccucuguaguauggcuugccucagaacuaguagaaucagcuuuuuuuauuccuggacuaacuuggagaaaaaaaauuccugagaugaucuauuuuuaauuccuaacuguuuugcuuuucuucgucuuccauauuuuuagaaaaugaaauguuauaucucuuaugaaaugguacuuacacauguguguuccaacugagacuuuuaauugucacuaguaaauuacuauaaaucagccucauucgggggcaaaaaauaauaauauguguucuuguuuuaaacguauucucaaaagugcuucuuaaguaguauuuuuuaauuaagcauguaauuuuaucauuuugcaaauucgcuuuuaccuuucauccugugcgacccugauaucauaagaauaagaguacuauaugagggcugggcaugguggcucacgccuguaaucccagcacuuugagaggcugaggcgggcagaucacuugaggguuaggaguucgagaccaaccuggccaacauggugaaaccccgucucuacuaaaaauacaaaaauuagcugggcauagaguugcacaugccuguaaucccagcuacuugagaggcugagacaggagaaucucuugaaccugggaggcagagguugcagugagccgagauugcaccacugcacuccagccugggcgacagagcgagacucugucucuuaaaaaaaaaaaaagguaaaagaguacuauaugauucugucagcaggaugcuggaaugucuucauauauagauucugauggagguagauuagaaagacagaaggcagcacgggaguggauuagguuaccuuuuggauuuuugagggcuuuggccacgugucaguuuguacagcugaugaaguauuugucauuggugaaaaaaaaauuacuguccacagguuuccuuucccucuuauugggcaagaaccugaaugucuucuucagagaaaguacucauauacagcacuucagcacaccaacaggaguccuuucuaaaaugcguuugcuuugagauggcacaggucacgugaucaucaguauacucugcgugaagcaugucaguuugaccgggagcuaaugcuucugccccaacugccauggugcagcucggggaaggcuucauuuccuggggaauuucaugcauuuucugugauggauuucauaaugggcucuaauaccuuuaaauauuuuccugguucuucugucaagcaaaccauuucuuuaaaaguugcuugguuggccauuaucauuuauuuuacuugguuaaaaauuuuggccaggaacaguuccuuuauauacaaaaauaaauacagaacccagggcuaugagucuugggcagaaucaggcuguuuucccaguagauaucaggaauaugaauaaucucuuugacacacagugcagccacccuggugacuuggugcuagguauuaaaaacccuaccguucagaacaguuucuuuuaacuucagcuuugaaauugguggucucgucagcuuuagauuuauuccuucuuuuuuagcuuucuugcuuuuguuuagauuuuuaaauuuuuaagagagucuuugaaagugcugacacauuuucaggcucccaguauaaggaaccaacugcaagugucauuuucuucauuuaaaaaguccuccuagaucaggucacuguguccacuuauaggcuuuccuguaaucagcagaaggagaggcugccauuacaaacaggugaguuagguguaauagauuggacgcagaaaaccaggagcaguauggaacaucugcccagcucacuggcaugucagcccugcaggugugucggaggcacagggcucaagugcaggcaucucccuccucugguuggggcuaagcuggaagggagcuuguaugcugggaaacggagcaagcucaccuugacauggaguggcuuccuccacuugaaauaacccaggagcaaggaggcgcuaacaagacggguuauuagacccaggaauuuuuaaaaccugaaaucuugcaacugaauauccauuuuauuagaccuuuugccuuugugaccacaggugaaauggaucaggaguggcccaagcacuguucugugaguuggcauuuuucugaagugugauuuuuuuuuuuuuuuuuuuuuuaguacuuacauacuuccauaauauuugcuucuuuucuuaaaaaaaucuuuuguagagaugagaucuuacuauguugcccuggcugaucuugaacuccugagcucaagcaguucuccagccuuggccucccaaagugcugggauuacaagcaugagucacugcacccagcucaugacacuugcuuuagauuuauauauaauauauauauguaauauacaauauauaugauauauguaauauauauauuauauaucacauauaaaauauauauuauauauauuauauaucauauauaaaauauauaugacauaugugugugugugugugugugucuuguguuuggauguauucgcuguuaauuaauuuucaaaaguuuauuugcacaguugaugucugaaagcugguuccaagucauuugugucuaugacuuaucggucuugugcuuucugugcuuucagcaacauuauagugccaaaaauguagcuguaauaucaauuaggaaaaaaauuacacauaaauccaccacccuaaccaguuaucuuucuucuucauuuucuauucccuuucagugcuuggccaaauauauauauguauuugaaauauauguguguguguguguguguguguguguguguguauauauauauaugagaaauugcaauauaguuguaauauuagaaaaaaauuaauguaugcuuuuuaaauuuaauaugucguuacaaacacuuuuacuuauuacuaugugguauaugauuuuuaauggcuauguugagaaaacuaauauaucaugcauaauuauuuaccagacauaguacaccccuguagugggcauugagauugucucccugauuugucuuuaaugcaguaguaaacacccuaacuuuuauuucauuaggauaauuccugggagaagaaacaucuggucaaauaguauaaaagauuucauagcuucuuaaaacacauugccaaugugauuuccaaagggucugugccaauuucuguuaguuggcaucuuuuaaauagucaaggcuucuuuuuacaggccagcagcagaguguuccauauuccuauugacauucagacucaguucuagcucagaccucugaaacacuuggaaauucuauccauugacuguggcaagucucagaacucagauucuuucuccagccugagcugaagccuggaaagguguggucugcccuuuggccccaaggucuuucccauuuuucuguccuguaagcuuucuguggcauucugucagcccuuguauagggaggagaauauaugugguuaugccuuggggccuagaauuguagcaguugaaaaacccuuaaagugaauuauuaaaucuaaaccagagccuguuggcuuccugugcuugacuuggacucuguuccauuaugguaguuuuuacaaacacuucugaauacgaaauaaauuccaaauauuuuucccccuuucuccugccaaacuccgccaggaaacagaaucucauuacuucaguuagaauuuauuaaugcugacccucuccagcacuuggagcuuuucagguuaggcucacacagcuucuguuuuuacucuagucuaaacuguggucauauggauagcaaaauaaauacuagaauauucuaguuugggaaggggagaggcagcgaugccuguaauaacauggcugcaaaccucucgcuucucucuguuugauauuccaaaaaaggaagaaagcucaaugcggagcacaucuguaagucaugaacauuuuccuuuugugugucaugcauauucaacauaaucccacucaaagucccaggcguugcuuuaguauacauugccucauacaucccuacuguuguugccagaaaauuuaauucaagacaaagguugcuucccuucugucucuggaucaggaaucugaacccauuaccacaaacagaaguaagaauugucaguguguucugcuuugcuuuuauuuuguuuuuuucccccaguugccuuuuauccuuguggcugaggaggaagauuucuuguucguuuauuuguuuuuaguguaagcaauacaccaguuucaugaaguguauuuuuaaaaaacguauugaugggauuuuguaaugcaaguguuuugaaauucaaaagcaacaaaagggcauaaugugaacauucucuccaggugggauauuuggcuuuuaauuaguugucucuguaauuauuuugauuaaaaauguacgaaaugugucaagaguuugggugaaaagguuuaguuuccuuuuagcugguuuuauucaguuaagaguucaucaugagaugauggcuuggaacaccugaggguucggaugacaugaguuuguagaaugauaugccagugauacgaugacugggaggugagcauagacucagugaguguguguacccagggcugcucauuguugccaagcuuuagauugaagagaaaugagaaggaugggggcgggugcauccuguuuuauguguugugaugcuuggggacaggggaaggggacaucauucaguuaaauaagcauaugagaucuuucuggaucaucauaucugagaugcuguuuuaaauuuacccaacaaaccacuuacugcacuagguacuguucuguagaaugaauaagcaaacacuguaggaagaaaaauuguuuuacaccaccagaugccccaacguacauacagcaaggacccuuucugaaaaugauauugauuauauugaaucaugacuacaaguuuagaugugccaaguaauccucuggcaagagguuuuuuuuuuuuuuuuuuuuuuuuugguuggugggggucgcaguuaauguacugauuauugcgcugagcauuuuaugaaacagauuuuacuuggagcuuuguuggcuuaggaaaucuaacugcucugaagcaaguuuaguucuuuuuucaaacaaaagaggagaauuucugcaguuaaguacccuaacuugguguuacuuuuuaacacacuccucagccauuuaaauguuuuccaaagaccagagccaugccuggcucauuggaggccuucuucaugagcccaagguuucuuccaaggucacauuuaccuuuucuggcaguuccccucagaauaaggccgaauuccagcuuuuuaaaaaagagaccauguaagagaacauugaucuguuuuucucaguugugggguaaccagguaguuucuuuaaagggcuugguuauuuccuuucaccaaauggcguaaagcuuggauucagccccuuagaaaaaaggguuucuucuacuuucuguggagccuuuaccauauauugguuccuagaacacaacggcggucaagggagaggacgcagaaagaucaggcucaggccugggucuugggcaucuucaaggaacucgcuuucucagugguauaagaagagccccacucuauaagaggcauccaacaggaacagccaacaucaguggcaccuuccaaguaagugguucagacuucaaggacugugaauaauuacaguaggaauucugucaucucccagaccuugggucauuucagaagcuucauggaacuagaggaauuucuccaaaguugccuauuaccugacaucuuuaugaccagcccagucauccuugugccucccacuuuccacccaaaugugauucuaccuucauguaaccugauuauuuuuuuggcuuuggguuuguuuuccuaauacgcaugaguaaaucauuuaaauucauucccacucuguggaagggauguugaaguguuucuuaaagagacuuuagcuuucuauauaaugaauuaagaacuauuuaagauguuugaagcaguuuggaacugaagacccuucuuuuuuucuuuuuuguuuuugagauggagucuggcucugucaccuaggcuggagugcuguggcgcaaucucggcucacugcaaccuccgucuccuggguucaagcgauucuccugccucggccucccaaguagcugggauaacaggcaccugcuaccacgccuggcuaauuuuuuguauuuuuaguagagacgggguuucaccgucuuggccaggcuggucucaaacuccugaccucaggugaucugccugccuuggccucccaaagugcugagguuauaggugugagccacuguguccagccuaaagaccuuucuuaagaauuucuuauguagggaggguuaagaauuuucuuucaugugugaccucacuuuugauuuuggcuuuuuuccauggaugguuuguauguauauacaggauaauaagguaagccuaggaaauugcuacauacuaguuaguucucuguaaacaaacccuuaaaguaagugcuaguaaagacaacaguaugugcuuauaagucagccauaucuaacauauucaagggcaagaucaucuuuuucccacaguaaacaaagggcucuuuccuucuguuacauuuuuaguuugcaugggucaccugcuuguuagaauuggcguuacuaaaaauuaaugaaugacaauugguguacauggcuccaggcaucuuccauguaggaaauuugaggggcauuaggcagagaaguaacuguuaagccagaacucaaaacucucagugcaauuuuuuccccaucuaugaugccaagaauacuaguucugaaagauguuaaaucgauauucuggggggagaauuuccaugaucaaaguuugaaaaugcuggauuaagccaaguucaacacagcucuuuauuguaguucuuccccaguccuuuauuauuauuaugugugaaucacaggaaaagggagggacgagguaggcagcauguugaacaugcucagugacauacauuuugaggucccaagucccuacuuuuggagcuguaugauuucaggcaacaaucuccuggguaggcccuggagauuguugagaugauuagaugagccaaugcuuaauaaaaugcuaagcacaaaaugccuggcacguaauaaacaccuaacagccacagcuaauccuuuugaacccgaggcugaauggucugaugucacucauguuguggggcaugacagugcagcagaaagagcccacacuuaggugucaagagcuucgggcuccaguuuggccaccagcuagaccagaggacuuuugagcuacuuugcuacucugguguucuguuucuucauuugugaaauaaaucagugaucuuggugacuauaguguccagucaagcucuaaaauuguauguuccuuugggcuagaccuaagccagaauugacaaguuuagcuuaaggacagguauaucaucucugagugacugugugggugacauaaauuuuuagcuaauuauuauuuccuuuacaauguguguugcuaguaauaaaauaguuuacugagucaccuauggaaagauaagcuacaguuauagccuuuuuggcacuuuguaaucaucauaaaaguuaauauacauuugagucauaauuggaguuggacugccuuuaccguaaaacaggaggcaucaucuagauguuuguugucugugaugugauacagaaauguauuauuaggccacauggauauuuuauuuuuauguucaaaggcuaauuuucugaaaguugggucugggagucugaguuauccauaauuaaguuuucuaccuucugcuuucguuguuaaccugaguuaaaaccauaaaguaaauucgacauuuacuaauuugagcuuuaauuauuuugaccacuguguugguugcacugguugaaagcaugugcaggaccucugcuuaguagguaaggcguuguguuuuuuaaacaaggcuuugaauuucuaaauaacagauuuccacacuggcaguuugaaacaugguauuuguucaguguagguuuuaccuacaugagaaaaaucaaacaaauagauuuguucaguugcuauccuacaaauugucuucgcugagaaaauggacagguuugugauguuucugacuacaucaagacucuacuacacuugaucuuuuguguauugaauuaacacuuguucuugucauuuuuauuacaacuaccguauaaguuugggcugaaucauuuuaucaaacucuaaauuuuuaucaucaaauguggaaggccuaaaucaccaucgcuguccucaauuuuccaaccuaaagguguuuauuuccucuuagggguauaauacgaaggaaaguagugucaccagaucucuucuugguguuuuuguauuggugccugggguuuggguagaggaagcagcagcagcagcugagacuagaacugcagcugaggccacuugguaaagaacuuuuuuccaggcuaaggacuuuuguuuuguuuguuuguuuguuuguuuguuuguuguuuguuuuuugagacagagucuccuugcucugucucccaggcuggaguacaguggcgcagucuuggcucacugcagccucugccucccagguucaagugauucuccugccucagccuugcgaguagcugggauuacaggcaccugccaccacacccgccuaauuuuuguaauuuuugguaaaggaguuucaccauguuggccaggcuggucucaaacuccugaccucaggugauccgcccgccuuggccucccaaagugcugggauuacaggcgugagccacugugcuaggcccaacuaaggaguuuuuaugucauccucuauguggcagggagccaauaaaggcaggagagugauacgaugauguuugaguucaagaacagucccucugcaucgaauggcuucaaagacacggacgugggcagugacaaggucaggaggccuuaguccagguccaggcccaacaugaugaguuagccagagccggggggccagaggcaaagggguggagauaggagacaaguauguaucuugccuuccuucuaggcauuguggguuuacacaacugaaucagaugcgcauucuccucugggaauuucaucuauggaggcaguguagugcuucaguuucccuggcugaauguggcauuacgcagaacccucuaucugucugccgcacauuuuccucuuggucguaccuuguugcuuuccacagccuuccuuugcucuccuguauucacaucuugcaucagccaaaagggaaaggucugaaagaccagcuuuguuuuucucccagcuuguacucuggacccuguuagccaacaguauuggcacugccucacagcgauggucagucccaaauuaaacagccucguuaugacacccuacagccaggcugcagcucuggacuugugcuucugcacguuuccuuccaguugcuuucguccagcgucucggucccauugaguaagggagugugugcagaguaugucccgagguuuucuccucagucaagcagacuacauuucgccagguguaaaaucgguaguuucgaauucaccccuuuucauggccuugaggagaugcuugucuccuugucccaagggaauauuggugcauaaaucauuucccguccuaggcauguucauuccagaaaccuuucagaacagaguguggagucuucauaaaaggaauuugucaugagcgcagggguuuuuuuuuauuuuuuauuuuuuaaaggggaaggcaauagagguauucauuaucugcuacagagugaaaagggcccugcuuuauguuaaauuggacuucauggaaagauauugguaauuucuccuauguucuuugugcuccugaaaucagagugggagagaacuuugauuucaaaauuauuuucaccacccuggaucacagagaaacacacuuuuggcugccuuuaaacacauuaaacaucuggucagcccagagaccacccgggagcccuguagaccccaaguaacugaguggcugaggguaagccagcuucucuagacacacccugacuuccaccccaagucuuguugaaauacaggccugacggcugucccaggaagucaguuggcuugucagacugccagugugguugaacggugagguggcuagaauucucugggaggcauuuuuggcccaucugccugguagcaugacagauguguuaguccagacaacugggucaucgaaugaauugaaauucaauuuacacauagggauuaaguaucucaguauuacccuugccacaucaaacuucauugacagagccaagaggaaaaugaaagucauucaauguuaagaaaagggaaacaagauucuaacauggaaagggaauauuuugcuuacuuuuaagacuguagguuacuuaaauagaugcaaugcaagcuauaggagguuuggggcagauggucuccuaggcuuaaaauggagagauuuuaaacuacgaggauccuggaggucuugugacauguaacucugaaaccucaguccaaggccaauuugguuuaaguaaucucagucaaauauuuauuuuguggccaugcauuuugagagggacagagaacacaggucauucaaaacaugccuucaaugaguuguacucugcugaggggcaagaaaaaugcacaugaaacaaugaaaaguaacagugaggguuuaugucuuaaacuguucauaugcuacaaaauccuaaaauaguacuuuauaauuaggagguguauaaggaguggagaagucacagccuguuucauaguagccaggauuugagagaagaaaccaggagguccuccaggggaaguaaaugggacaaaguuuaagacaagcaggacggagaauggcuuuuucaugggagcacgaauggugguucaacccaagcgguguuuacugagcaucuacuauaugccaggcacugugacugggggagggaagccuugccuuuaaaggagcugagagccuaagaggaggcaguugaugauagagcuguagaacacagggcuccugacacaguucacaagcuuugggaauuacaaucuggaauggugauagccuuggaaaccagugaaacaggguggcgucagauugcagaguuaagcucugaccauucuacuagaaaaguugcagcacacucuuggcucagggugguccaggccacuggaacaccagucccuaagguuucaguucucagaauccaccagugugauagcucaaacaaaauagauucccaugcuuugcuuucaguuggcacugaggccugguggagaaugugggcucagguuuaaagugcuuuagccuugcuagccagcugcugaaaccugagaaaauaaagugguacuguuacagaggguuggaccuguccucuuaggaagguuccaaucacagcgacugcuggaagagaaaauuuuauuuuaagauuaaaucuaaugaaagccaguguaguaagggaaacauuauuuuauaauuucuguuaagagcaaacauucuauaugauuuuuaaaaauagagcaauaaugaguguugccuguuuccaaacaagcguuguuuaaaagcugccugucugcuuuauuauuuuuuuccugggcuuuugcgagauaaugguaguaaaauaucaauuuacuaaaaccauuuuuuaaagucuuauaccucuacucugucuccaguucaugcaaguucuucuuuuggcaggauuagguugaauuuuaauacuaaacucuuacugaagaguuaagaagcuguggaacugguauacuuagugacugaucccucuccauauuaagcgugugauuugcuauuaccaguugccaguaauagaaaaagaaugugcucguguggguuuaucuguauuugucauuaaggcuuugcuaagccaaugagcccuagaagcaggcgugcagugggcuuucucccugucaggugagccucacgggcgcugcuccucuccgggcacuguggcuggccucagcacaggucugggcugggguagaaaggccugcauggccugaggacccaggugacuggggaucucucaucuguagcgguaaaguucugaguauugccaggccugcaagcacugguaggauuugauggaucccugggugauuauuuagccuaagcuaagccguaauaccuuugcauacauccccaagaaaguccuaaguguuuuguucccuuuccaguaagggagugacaaagagaaugcccaagauggcuuauaacuagcauugggauggcugaaagucagguaaguuuaguggaaugcaacaaaauaagcccaagauaggaguuuagaucuccgaaauguuuucauucuacugguuuaagcuguguaggcuucccuugcagguuauuaguccgugcucaccucucaaauugcuguuaaguugucagggugccugaggaagacuguggccagagauguggauucagacuacugugggagugggagggguagucacugcaguauguaccugaacaaucagauauacaaguguguuucuuaaucucucaacauccugacucccuugucuuuccuuucucagagagcagagcugacaucugauaaagacauguaccuugacaacagcuccauugaagaagcuucaggaguguauccuauugaugacgaugacuacgcuucugcgucuggcucggguaagguggcugcuucuaaacacuggaccucauucuccaggcaugcacgcacacacauuuuacugugcuuacuucaaggagacaggcaggaugcacagugguuaagggcaccgucuuuggaaucaaagggccugggugcuaauucuagcucucucugccacuuacgcugugagaucuugagaauuuauuugcugagccucaguuuccuccuuuauaaaauggaaaguaacaauaguccuuaccauagaguuguugugaggauuaaaagggaguugacacaucuaaagcucuuagauuugggggcuuggcacauagugcucugucaacauuagcuuuuaaucguauuaagacuuucagagugaugucauggaaaccacccuucaagaaaucccucaaacacugguuucauaaaaccaccuacccuauguuaaaaauuguagaugagaccaagaaguuaauacguuuuuauuccuaggguauuguaggaggaaaaugcagcagccaaguaaaaugauuauguagugacaugaucagauuccuuaguauauuauuccuuaauaguuaucuguuaccacucuaaggcuacauaauaaaccaccccaaaacuugguggcuuaaaguaacagucauucauuuaacuuauuauucuguagguuggugauguaggcugggcuggcugggcucccucacaugucaguggucagcugccgguugaguguacagcuuuagguuggguuugcagcuuucggguacucauaucccuggggcagcugagcagacuuggguucuguucguguggucucucauucuccaguaggcaagcuauuuuuucacaguaacagcaaguagaagugugcaaagccucuugcagccaggccuuagaacugggcacagcaucacuuuuacuacauuuuacugguugaagcaagucagaaggccagaacagacuccaccucuuagugaaaggauucauaaagucacauuuacagaggauauguauacacggaggauuaagggauucuggucacauuuacaaucuaccauaauugaugaauauuuccccuguucucagaauggccccuguaugaguucauucucacccugcuaacaacacagggacuggguaauuuauaaaagaaaagagguuuaguugacucacaguucagcaugccuggggaggucucaggaaacuuacagucauggcagaaggggaaacaaacauguacuucuucacaugguggcagcagggagaaguaugagugaagaggggauaagccccuuaugaaaccaucagaucucaugagaacucacugucaugagaacagcaugaggguaacuacucccaugagucagugaucucccaccagcucccucccaugacauguggggauuaugggaacuacaauuuaagaugagauuuggguggggacacagccaaaccauaucaacccccaagaagcucaaaaaagggaagagcuuuccacauacuuaauuaauagucaagugagaaauuuguggucagcagcaugguaggcaagacuuauccagaccuuuuuugcuuuaggguuuuuauaacagauucaacagauuguuagauaucuauguucgguauaacuuuugugaucagauugagcugggcuucagaaugacccagaacagauuaaaaucaguugugucuuugguagaaaucuagccauguaagagugaauguuuuaaguugaaaagcagaaagucugagaaagacaagagaggugguugcugaccuaguaacaaugagcuuacaaugcaguccuaauguaaaaauaacucuaguuauucuugggagagugauauauaucacacacacaaaaugggugugaaaagaguuguucuuauugcccacaacucuauaaauaucuuucacucauggcaccucuuuuuuuuuuuuagcaccuuaagaguucuuuguaacugucaucuucaauaugucccaggaaauaauaacuauggacauuuuuuguuccuacuucgcagaucuuagaauccaagaguuguuagugggguguacagguuggcgaagucauuuugcugauuugcuaagguugaccuuaagucuaguuuaaagaaaccaguaugcuuaaaguaaguuuucuuuaaauuaaacuuaaggacagucuuagcaaaucaacacaaugacuuugccaaccucuacagacccccugcccccauccagguaaaagagaguuagggagggucauuugaaguccugaacccacugaucagauagaucaagcugaggguuaaaccugggcccacacugcuggugccauggcccuagccuuaggcagaucacugcugugaagaagugaaagagcuucguucuugacuuuggaaaccaccuuacacugagcugggaguguuguuuuucagcaugaagcagcaguacuuguaacuaaaauuugugaagcuuuuaacugugucagaaacuacucuaaccccuauaacaucucugaaacgauagauucuguuaguauuucgaugauucccacgagaaaaccugaggcacagagagauucacuugccucaggucacacuauuagaagguaauagaacugggauagugagaaagugagggaguugggcgugagaguguguuuucuuucauuccuuugcugugcugccuccuugugucauaaaccccuucuagaauuacccaguuccagcuuaaaaacaccccaggguuuggccaguguaccaguugucccuucuuucauccagcuauccaguagaaaagcaaauggauuggaaaaaauggcugaaggcccagaggggacuuccugggcaaggagauaggacuauguucuauaugugggcucaaguaugggcauaagcaaacaugaaacccuucauaagcauuugcugugugccacacacugugccaugcucuuggggcacagagauaagaaagacuuggucucugucuguaggggaccaagagucuaaugaaagaaauacaaacaugagaaauaaucauugugauacccggugaggggugacauaauauaggaaagggcuguauaacaaaaauguaagagguaaaauauagaccuuugguuaaagauggcagaucgaacacuacuaccuuucagugugcaacuaaauugacgauaaaagaauugggcaugaacucauaaggacaaacgaaacaguaaaggaaacaaaagccaugaaguuuugaaagcugggaagaagaugagcuaguggggacagacuuggcaggcuucagaaggccgaguuaguucgcaguggggagagccaaaaagcaacccaguuaacacagcagaaucucuugggaccuaggaauugguggcauucaguggagggugagagugauguuaaacucaggaugauuggcuggaagucuguuuaagaaauagauccccugguuccuuuccucugucauguagcaaaggggcucauguucccugcccucagagggaaaccuggagauuuauuaucuggagaggguaaaacagaacccggggguauuucaggaacagauggggcuggggguaccuuauguaagacagagaaaauaaguucuuagauuaagaauaauuuaauauggugugaucccaaguugucuugucuucucccagucaguucccagaacacuggcagucuguccauuuacccucuggguaggggacugggaggcuccccucugggaagcuggaccaauucaaagagaguggcaugggagcucuccagugaaacguacagcucuguauuacaaagaauaaaacuucaaugagaaaugaaaaauuucagucgaggggauguugccuacauuugacacaccucuccugugugcucaaagcuucuaguccucuuuucgguguuucccucuucaauauaaacaggcaaccaaggcuccccagauauuuaggaaaaacuuguaacaugagagaaagagaaacccccaaauugggagaggacagccacuuacaggaagaaaaaaauucacagaaaaacauaguaaauucagagagaaaagcagaugcucgaacaauggcacaaaaacaggauacuauaaaacaggaauguucugagacauaagaguucuuaagagugugggacugucgugucaaaaaugaaaagcucauuuggaaggugagaagacacagaggauauucauucauugaggaaguauuucuuaaucacuuaguacaugggagaacaggcaccauucuagguucuagggacacuucaguaaauaaaaucuaacaauguuuucucuggcgauaggcuaauuguauuuauuccuucuguguuuccaaauucauacaugcaaauguauuuuaaaaaguauuauuuuuauaaguugucuaaguccauucagguugcuauagcaaaauacuuuagacuggguaauuuauaaauuuauuggucucaguucuggaggcugggaagucaaagaucaaggcacagcagauuuggugucuggugagggcuuucugacuacuuuuuagauggugccuuccugcugcauccucacauggcaaaggggacaaacagugucccucaagccucuuuccgaagggcacuaauuccauuccaugagggcccugcccccaugaccugcucaucuccugaagucccucuucuuaauacuauugcauuggagauuagguuuuaacacauggauuuuggggagacacauucauaccauaaguaaaagaaaauguuauuuuuaaaaaagaaaauaaggcugggugugguggguuacgccuguaaucccagcaguuugggaggcugagguagguggaucacucgaggucaggaguucgagaacagccugacauggcgaaaccccaucucuaauaaaaauacaaaaaucagccaggcgugguggcgcaugccuguaaucccagcuacuugggaggcugagucaggagaaucgcuugaacucgggaggcggagguugcagugagcugugauugcacuauugcacuccagucugggugacgagcaaaauuccaucucaaaauaaauaaauaaauaacaaaaaaaaauaagagaaugagcaugggaacauagagacagaaccggugcccugguggagagaucaaggaaggcuucagagagggggugauauugaugcuguacuugauagugagagcaggaguuucccagagggaaacaggccuuggaguagucuauuucagacagggagaacaguaggaccugaaggaggagauauucaguggggcuucgagauuucugguuugagcaaaagaguuaauguuuuuaauaaagauauuaaaagcagcagagccaucugagacagauugcccaucugucucuaucuuuuuuuuuuuuuuuuuuugagacagagccucacucuguugcccaggcuggagugcaguggugguaucccagcucacugcaaccuccuccucccagguucaagugauucuccugcuugagccucccaaguagcugggacuacaggcgcccaccaccacaccuggcuaauucuuuuuauuuuuaguagggaugggguuucaccauguuagccaagauggucuugaucuccugaccucgugacccaccggccucggccucccaaagugcuaggauugcaggcgcgagcuacugugcuuggcccugucuuuaacuuuaaaagugccagcuuaagggggauuuucuacguuacaaaucucuucccucauacagauucaucccacuucuagguugaugacucauauugguaacucuugugaaacaagagggucuuuaaaagcccuagacugaaauuuuucauuucucauugaaguuuuauucuuuguaagaaaaugauucauuguaggaacaaauuaagcauauuauauguaaaauguugauagauaauuaggucaccugauaaaacagcauuauauuucuggacccaucauuauuaaugaccuauauuuacguaacaguuuauauagaaugcuuuaaauauguaucaugucuguuagauauguaucugugauauauauguaccuucguggguuaguuauuauuagccccauuuuacaaaugaagaaaccaagacucaaguauuacuugccuaagaguacagagcuaauaaaugccagaaccaguacuagguuuguuugcuuucuuaauaccaaacccuguauuuauuccaacaugcccugccauuucuucuguauaauaaugaauauauauguuuugaaauuaaaggagacaguugauaaauuaagaaaugaaccggccaggagccgggcacagugccucauaccuauaaucucaacacuuugggagacccaggcaggaggaucccuugagcucaggagcucgagaccaaccuggcaacauaguugagaccccgucucaacaacaaaaaauaauaauaauuuuuuuuuuaauauuagcugggcacaguggcacauauauuuaguuccagcuacucaggaggcugaggugagaggauugcuugagcccgcaaguuugaagcuacagugagccaugaucgcaccccugcacucuggccugggugacagagcaagaaaagaaaaagaaagaagugaaccauggccauugcacauguuuccagcauguguugcuuucccaccugcuuauuacauugaugcgauucuguggaaaauacccauuuucuuuuguuugaggaauuuagagguauuuaucaauguguuguccgaggaagccugguuaguuugaguuacagaguuggaguuuguuugaguuguuacaaauuugacaaaugaucaacuuaaaaggaauguuguauuugaaugucagaaauucucaaaugcuauucuagugaaaaggcaacaacaacaaacaaaaaucaugcucagguagaaagucacuuguugaacaaauaccagaucagagccuguuaugucuuagacacuauguuaggcacucaggggccuauuaggaagaaggcagguacaguguuucauggaaaggucacaguggcuuggauuggagugguggcccuggaacuguagaacgguguuaagaguggagggauaauaagaagauaagauugauaggacuggauaauggauucaaaaacaagguaaggaagaggaagucagaguucugguguguaggaacagagggcuucagucacugcaaggucacaggaggagaagacaaagggaccaugaguucugguuuggacauguucagagguguguuguaccuuugagucauucaagugaaaaugccaggaaggccacuggauaugugacuuugagaggggugguaaaagccgaugauguaaauuuagguaucaucugugcuuaacucaucauuuauugacauuguggacauggaugagggagaaaguguagaggaagaagaggccuagggacagaccuucagauacucuuugauauuugauguugagguagaggaggauaaaccagcaaaggaaacuuagaauagccagagaggugagggggaagccaggaacucuuaggaacccaaagaaauaggguuuguccggaagcagauggcacuugacagugugcaguggugcuaggaaguucuucuacuagaggaaggcgauucugaagagugccauugggugcuguggauacuggugaccuuaacaaaacaguauuaauagugaugacagggaaaaugcuccuggagggaguagaaugcagaguggagaagaugaugaggacaagaccuagugaguauccacccccacuggaaaaaucugccuguaaaaccaggagagggccaggcacgguggcucacgccuguaaucccagaacuuugggaggcugaagcagguggaucacaaggucaagagauccagaccauccuggccaacauggugaaaccccaucucuacuaaaaauacaaaaaauuagcugggugucguagcaugcgccuguagucccagcuacucgggaggcugaggcaggagaaucacuucaaccuggaaggcagagguugcagugagcccagauugugccauugcacuccagccuggugacagggcaagacuccaucuccaaaaaaaaaaaaaaaaaaagaaacaaaacaaaaacccgggagagagggcaaggaacucacaugaaauaaggagucagccauaggagaguuuuccuguuugcauuuuguuuuguuguggguuuuuuuaauuuuuauuuuuggcagagucucacccugccacccaggcuggaaugcaauggugugaccucugcucacugcaaccuccaccuccagguucaagugauucuccugccucagccucccgaguagcugggauuacaggcgugcgccgccacgcccagcuaaauuuuugaauuuuuaguagagaugagguuucaccauauaggccaggcuggucucgaucuccugaccucgugauccgcucuccucggccucccaaagugcugaaauuacaggcgugagccccugcaccuggacuguuguguucuuaaaauggaaauggagcacguuucaguguagaugggaaaaaaucuugucaagcagggagaaaaggaacaugcaagugaaagaagggcuacuugaauguucaggauaauacuauuaaggaaaaacuugcuagacuacccacagacaccuuugaaaucacuucuucaucauggugaagaccacaggaagcuuugugcugaagucuuaaagagccagcauuuugaaagaacaugauucugucagugucaacgucaggcaauagugccugauaauggagacaucugugucaugauugccaugcucaguucaucuucacuuacuuuuccaggagcugaugaggauguagagaguccagagcugacaacaucucgaccacuuccaaagauacuguugacuagugcugcuccaaaaguggaaaccacgacgcugaauauacagaacaagauaccugcucagacaaaggugcguucuauuuuccauugcauugcauuaucagguuauuacaaaugcuucacuuuacugacuguacacaacagucccuuuuguauuauuuucuucuuuuuggagcuacccaucaugaacuauguacacaacaguucuuuuaaaagaccccacuuaaaauuguguaaggacaaauggucuucaggugguguuauaaauggcucuuccuuacucuuuuugaucauuuuggcauuuacccacuuauaaucucugucauccaggcucaaauuauauacaacuauuuuucacauggcccuccuucuuaaggaacgucugaagcccaguuaagaaguaaagcccuguuucuuugguuuccugguuuguagguuacguaauuagaagacuccaggucacgucuugaggugguccuagucucacuaagucauuucucagucuuccuaggccgaccaucaguacuauguaauccuugaccucucucgaugaugaugaaccuggguacaucuguauauauucauuuugagagcugacuuauuaagaauaaggucuuuggccuuagaccugaguaaagugaccagcuaaugaaaacuuggagcuugugauuuugaccucguuaauauugcaguuagcugaccauccacuaauagguaacccacugaaguuagaacaugcauauuaaagucuggcaaagaccuaaguuucaaauccuggauccagucagguuucuuagcuucugaacccauuuccuaugggccuugaagaagaugaaaugugagugcauguagcauggcaccugagaccuagucaccauucuguaagcauuaauugaauugguggagcagaagagaccaagccaauucaccaaaugagcauguguaauaacuguagugguagacuuugcaaucagugcagggguaacauauggcuuaagaaaacucagaagcacaagcauccccuuuuagagcucacccaucuguugauuagaaaugagaugcugccaagcuuuagcagcagacaggguauggauauggaaggcuguuugaugaagguggcgacaggccuuccuuggaguaagaaucaucccgucuucaggccagaaugcaugugggcuuuucuuacccuugccccagaguaccuuuguucuuccuccuccuccauccucccagugccugugacuggaauggugaauggcaccgcuggauggguuucugcagauguggaacagccaggaagccagcccuguccaaauugaagugcuuucuguaggaccaagaagggucaauuacuauuagugguagacuucacaagccaggcgguaggaaggcagggagagcccuaugagaacugagaccgacucaccuggcaugugcuggauccaugcauaaaagcuacuguaucaauguuucaguugagugaaugaaacaaaaaaagaaagggagaaaugaaaagugcaggugcaauuggugguacgaugacugccucagaguguguguggcacaauuagcuacuauuuacuaaagaugcauuuggcucuuaccacauuuuuauuugaccacuucucuugacuaaaucugcugaagucagagacaauuaggacucacuagcuugagggaagcaacucuccugggugaguuuuggcuuguagugauagagaguucuauccuaagcaagacuuaauuugacauagaguucugucugguuuguuaacagcaauggauugaccacuaauuuaaguuuuuaaaaauugguuuuaaggaaguaauugcaucagaucgagauaaaaaauguagaacuuuggcaggugaauuuaaaaauuaaggagcccaaaagauuuuaauacauuuauauucuuacuaucauuuguguucaauauaguaauaguagaaauucauccauuuauaggagauuuguugagugcuauucauuaugugucgaacacuguuugcagcacugauaaugauaauauugaucaugaauaacaugaauaauaaugauuaaauuuuucauuuugcuguuuaugugguacagccgaauugaacauugccucuaggauaccauuaguguagauuuugcuuuucaauuggucucacaguggcauuaaugucacuguuacggauauccuaucuaguuuguuguaaauuuaagugacuaaaaugcacaaaagggaaucucguuauuuguuugagaagagcaucacucauaagcuuuuacuucuguugcauuuccauggcauccaaacaaccagacauggauguggcagaucuuuacuuggccucauuuaaucaucccugcugucuuuuugcggauucauuuugcacauacauucauacaagagugaagguauuucagauuaguuccauauuaccaaaugguaucuucuuagucaagccuuugcuuccauacgauaaaacauuuugacuuaaaaaaugaauuuuccacccagagccgcuugaggcuugugcaccuccagcugcagggcggcuccaguucuguggaguccuucaguucccacacucucagaucccuggauugcacgcuuuguucagccugccggaucagaggcugagucagaggaaacugaaaagaucaacucucuuaaaugacuuuagggacucaaucacauggugaaaccauaugauuuguaauaauaaugggacaaagaugauauggauauggaugaauuaaacucagucucucauauuacaguaacuacuuagguccauuucauuucucaccagaacuuguuuaccucucucccuagucacaaaccugaguauucaccuauuugagauuucucuucccuuuucuaacuuguaauaguaaagcaguacuaaugagcagugaaaaggucucuagacuagaacccagauaauccauucucugaccuguugucugucuuuccacaaggcagccaauuaaugaugggcuuuucaugagaagaauagaaaaaucucagcaaaaauacugccaaugagcugcucucuucugcuuuacuuugguaccugaaggccugggaaggccugucguauuuccuucucucauaguaauagaaaggacggugacauuuucagugcauauugugcaccagugaaaugaaauuucucuauggccucugcuuuuuguaagucauggcagguugaaguuuagguaguacaggguuucuugcaauuugggaaugacaguuacucuuuauuauacuuuauuacauaccaccuucaguagaaguguagcguucugcucacugagacagggaccuauugaucuuacauacccuagaguacaaauggauccaccuggucuagcuuaugguccuuccuagcaaugaggguggccuuaaggugcagaaaagaaguaugauguggucagggucccacaggagcuacuugcacagcccaagaaggugugaggucuuuucuucuuacacucuuuaagccucuagacuuaacuagcaggccgccauuuuggaugaacucuagccuucagaaagcaaucauuugcuuugcugagccaugguauguuagacucuguggaguccuaaugaagaugguaggaagcucucaggaacuuaggaagaguaguagagcugagaaggauuauugucugcaguauuuuuuuugagacagggucucacucuguuacccaggcuagaaugcaguggcacaauuauagcucaccgcagccuccaacuccugggaucaagagauccuccacagguacacagcaccaugccuggcuaauuuuaaaaauuuuuuuguagagacaaggucucaguauguugcccagguuggucucgaaugauccucucaccuugggcucccuacccagccaccuuuagccuuuaaaccucaaugaaguugacaguguuuucaucagugaugcuggccgacaagaacuucagacuguuagagaaugaacaacuccuuugaaugggacuucucuaauccacugguucuuaaacuauggaauugucuggagaacuuaaauagcaguaaaagucagugccagcuacauagugcccuguauagcucagaagugaaggaguaaggagaacuggggcagugcuguuggguuggagcagucagagggagauggugaccugaagucagaccaauugaaauggaaccucuaguaguaggacuguauuuuuuuuaaugccuuucaggugauguggaucagcguaaccuugggugauucacauaagauggccagugauggugcugagaguuagaaaggcaagagauaauuucuguguaaauaauccuggggguuuagugagguaaaaggucagagaaggcuucauuaaggacaaacagauaguaaaagaagugcaacauuuggacuggggauagaacugcaugaacuagagcagaguuccccacccgcuucuggggccacggaccaguagcgguggccuguuaggaaccaggcugcacagcaggaagugagugagcauuaccaccugagcuccgccuccugucagaucaguggaggcgugccauucccauaggaucuaggagcgcaaacgcgauugugaacugugccuguugugcuccuuaugagagucugagguggaauaguuucaucccccuccaucccccccacccucccauucauggaaagauuggggaccgcuaaacuacagcacagauacuaagaaccauuuuugauaaugaagaggugguggaaaugaccucacaggguuuucuacugggaguaagugguggguugggugaggacuggaagcuacccaacaccugcaguucugaggucgaugcgggaugggagcugggcugugaugugcuggccaccugaacgaagcuguggaaaugagaacccaagggaagaaguuaaugugagagcaagaugggaggcaaauugacagugcugugacauggaaaacauaugauagaaaaugugccguaauagauaacuugguaacaccccaaaauacagugccauuaaugggaauagaaaaggagguugaucugauucagcagugaauuaauuacuacuuagacuugacgaguagaguuaaaggugguacagccaacaguuaauguccugcaggcugcuggcuuguugggaauaaugcugacuagagaugcggcugugagagguauucccauagauuucugcuugagcauugugcaguguccgagacccagugagugucguucauuagacaggugaggaaaucaagguggagaaaagaaguaugaugugaucagggaggagcuacuugcgcaauccaagucccuggaaguccuggucuaggguuugcugaagguaauauaacuagggggaagcauuaggaguaaggcuuggggauugcuccccacagaguggggacaggaaaagcccagucaggcgugagagaauaucugaaagggaacuguuguccuagugcccuguguaguucagaagugaaggagcagggagaauuggggcagugcuguuggguuggagcagucagagggagauggugaccugcaguuagaagaguggugagaaaguagaaaucuuaggaaauguccacuaaaacaaccucaccauguccuuaggauuauuaugaacucacuagcucuccgacuugccugaucaugcgauggguguugugcaaaccaugaacuacauggguccaucaugacacucacccauugcuauaaacaucacacaagugauuauuccaguuauuuccuaaacucauucuuugggggaaaaaaaaauuuuggaauauacucaucuauuauuucuucuuuccaacacauuuccuuaaaucaauguaaucuuucccuguuucccauaccagucaccugaagaaacugauaaagagaaaguucaccucucugacucagaaaggaaaauggacccagccgaagaggauacaaauguguauacugagaaacacucagacagucuguuuaaacggacagaaguccuagcaggugaguagccuggugggccucaggugggagggugccuacauaggccucuguuagucuaagugauauucaaaagugcagcaaagcuugcugucaucuuucugcugaaagcagucuugugggugcuugauuccagagcgagaagcaagaggcucagcaaacauugucuuuauugucugccagcucccucaaccuaccucuucgccagccaucgggcaggggauaggagguagccuaaaagagggaaaguuaacaucugaauugauccagaacaacuggauguagagagauggcagaguguggagauccaucagucuugcucacaggcauucuacauuucaaaauaaagagaacgaaaaguucuuuaggggaaggcaguucauauaaguacugcccaaaguguuaagaacguuguuucuauuuuaacuuaauuggauggaagugcaaauauuuuaaaggggaaaacuuucaagauuuaggcacacuugguagucucaaauccaagaauagaaauaaauuugcaugcuuuuuuucauguauacucuuuaaaauuuuaagucaauuauacuauguucucuguugaaaaaaagcaguuagaaaauuagaauaugaaaugugaguucugaaaagacaaaaguaguuuucaaguauggaauuaguuaagaucaaggccagauuuuucuuaucgagguuuuugggugguauuauuaacacuaaccaaagaaauuacuguaccuuccugaggaguuucagauuugcauaguuaccagguugcuucauugaauccagcuuuuuuuuuauugggguuuucaaauuaagccuuuuauaaaaguguaaguagauuaggcuugacaauaaagcuaaugucugcaacccuugaaucucuucuaaaguaaucuuccuuuugguuguuucagcugucauugcugguggaguuauuggcuuucucuuugcaauuuuucuuauccugcuguugguguaucgcaugagaaagaaggaugaaggaagcuaugaccuuggagaacgcaaaccauccagugcugcuuaucagaaggcaccuacuaaggaguuuuaugcguaaaacuccaacuuagugucucuauuuaugagaucacugaacuuuucaaaauaaagcuuuugcauagaauaaugaagaucuuuguuuuuuguuuucauuaaagagccauucuggcacuuuaaugauaaaaucccauuguauuuaaaacauuucauguauuucuuuagaacaacauaaaauuaaaauuuaacaucugcaguguucugugaauagcaguggcaaaauauuauguuaugaaaacccucgauguucauggaauugguuuaaacuuuuaugcgcaaauacaaaaugauugucuuuuuccuaugacucaaagaugaaagcuguuucauuugugucagcaugucucagauugaccuuaccaaguuggucuuacuuuguuaauuuaucuguuguccccuuccucuccucugcccucccuucuugugcccuuaaaaccaaacccuaugccuuuuguagcugucauggugcaauuugucuuuggaaaauucagauaaugguaauuuaguguauaugugauuuucaaauauguaaacuuuaacuuccacuuuguauaaauuuuuaagugucagacuauccauuuuacacuugcuuuauuuuucauuaccuguagcuuugggcagauuugcaacagcaaauuaauguguaaaauuggauuauuacuacaaaaccguuuagucauaucuaucuaaucagaucuucuuuugggaggauuugauguaaguuacugacaagccucagcaaacccaaagauguuaacaguauuuuaagaaguugcugcagauuccuuuggccacuguauuuguuaauuucuugcaauuugaagguacgaguagagguuuaaagaaaaaucaguuuuuguucuuaaaaaugcauuuaaguuguaaacgucuuuuuaagccuuugaagugccucugauucuauguaacuuguugcagacugguguuaaugaguauauguaacaguuuaaaaaaaaaguugguauuuuauaagcacagacaauucuaaugguaacuuuuguagucuuaugaauagacauaaauuguaauuugggaacauaaaaacuacugaauaaaucauguggccuaauauugaaaaugucacuguuauaaauuuuguacauuuuugaucaaauguacaucuccccuuugcuaacggccgucugcucucaaggaugacguggguuugauuucuaaguguuucacagugucuguaaaucaagaccaaagagccugucgaugagacuguuuauuaccagauucacuucugaauuggccagaggaaaucugaauguauuauccugugugugucuagguagagauauuggaaggcugccaggggauuucgaaguuugcaaccuuuauaggauaacugauggcaauauuaagacagacgccugcuuuugcaaauaacuuacaagacuguaaauuccaaagaucugaauggggcuuuccugauguugguaucuaaggcuuaggccuauagauugauuuaccuuuggaauugugcuccaaaugucuacugaagcuuaaccgaagaacuaauaaauggacuacaguagcucacguuacagggaaggaggguaggcagggaggcucuguguguuaaaaugagggucucacugcuuuaggauugaaguggcuggaaagagugaugccuggggaaggagauggaguuaugaggguacuguggcugguacuuucuguacuaaacauuuccuuuuucuauuuuaccacuaauuuuguuuuaaacugugagccguccaagucagaagaagacagcaaaaaaagcaacuuuuccaacauacaauuuacuuuuaauaaaguaugaauauuucauuuugagaacauucccuggaauugccacauaauucauuaaaaacauuuuuuuaagcaacacuuggaacaguguuuacuuuaaauccuuaauggccuuaauuaauucucagauuccugccccaucacuuacagaaccaauucacuuuagagugacuaaaaggaaacgauagccuagcuuucuaaagccacgcugugucccucaauuacagaggguaggaauggguauaccucuaacugugcaaagcagagugaaauucaauucauagaauaacaacugcugggaauauccgugccaggaaaagaaaaauuucuggcaaauauuuugucacugcuguaaagcaaaauauuugugaaagugccaaaauaaagucugucaugccaaaaguaaaucauuguauagacugacauccaguuuucuucaacuguacacuuucugcuuaguuuuuuuuuuuuaagaugcaguaaauaauacuauaaaaaguguuaguaaugauuacugaguucaggaaaauuuugguaaaauguaaauauuaaagccaaugugaaaauuuccuguuuccuuaaccacauguaaacgauuucucuugagugaauauggcuuuguguuugagagacuugagauagucacacugucccauuuucagcccguagggggaauaggaagcacuuggguuuuauuuuuguuuuucaguuuuaguugcaggugcguagu

SEQ ID NO: 17746 - RNA, 1357 nt, Homo sapiens
ggugggguugcgcaugaucaguagcugcaccacuagaaagauggcggaggaagagcaaagaaaaaucccuuugguuccagaaaaucuccugaaaaagaggaaggcuuaucaggcacucaaagccacccaggcaaagcaggaacuuuuggcaaagaaggagcagaagaaaggaaaagggcucagguuuaagcuacuggaaucauuccuacaugauuacuggcagcagaaaccugacaaggugcaucucagacgacuagaagugaaaccucaugccguggaauugccagauaaacauuccuuggccuuuguuguacgcaucgaaaggauugauggcgugaguuuacuggugcagagaaccauugcaagacuuugccuaaagaaaauuuuuaguggugucuuuguaaaagucaccccccagaaucuacaaaugcugcguauaguggaaacuuaugugaccuggggauuuccaaaucugaagucuguccgagaacucauuuugaaacguggacaagccaaggucaagaguaagaccaucccucugacagacaacacagugauugaggagcaccuggggaaguuuggcaucauuugcuuggaagaccucauucaugaaauugcauucccagggaagcauuuccaggagaucucaugguucuugcgcccuuuccaccucucaguggcccaucaugcuaccaaaaauagagugggcuuccucaaggagaugggcacacuuggcuaucggggugaacgcaucaaucagcucauccgccagcugaacuagacccaggugccaaacugcaguauauuuuugaucaaugaaguggaagcauguguuuuguuguuuugggaauuuuuaucaagugucuucagagaagauuauuuccugcucugucuucaaaaacuggaaaggaagggucaaagaaaagacaguagcuggcugggcguuguggcucacgcccguaaucccaacacuuugggaggcugaggugggcagaucacuugagguugggaguucgagaccagccugaccaacauggagaaaugccaucucuacuaaaaauaaaaaauuagccgggcaugguggcgcaugccuguaaucccagcuacucaggaggcugaggcaggagaaucgcucaaacgugggaggcggaaguugcagugagcugagaucacgccauugcacuccagccugggcaacgagcgaaacucugucucaacaaaaagaaaagacaguagcuuauguucaugucaagcaccucucaucagagucuaguuccaaggaaaaauuccaguguuuucuacauugggugcugcgucgucugaaaucggcacauuccauggaggaaggaguccugcu

SEQ ID NO: 17747 - RNA, 4486 nt, Homo sapiens
cgcgacgguacaguuguacguucgugacgucggcgguugccguggagagacccgcucggucccgaccgagagcuggcgucaggagccgcagggucacagcgugucuuugaagcugccuccgccgccaccaugagcggccgaagucggggucgaaaguccucccgcgccaaaaaccggggcaaaggccgcgccaaagcccgaguccgcccugcuccggacgacgccccgcgcgacccggacccuucacaguaccagagucucggggaagacacccaggcggcacaggugcaggcuggcgcggggugggguggccuggaagccgcugcguccgcgcagcuccuccggcucggggaggaggccgccugccggcucccccuggacuguggccucgcgcugcgggcccgagcugcgggggaccacgggcaggccgcggccaggcccggcccggggaaggccgcaucucucucggagcgccuggccgcagacacugucuucgugggaacagcgggaaccgugggaaggccgaaaaaugccccccgcguuggaaaccggcguggcccugccgggaagaaggccccagaaaccuguagcaccgcggggagggggccucaggucauagcuggugggaggcagaagaaaggggcggcaggggagaauaccucggugucagcuggggaggaaaagaaggaagagagggaugcagggucggggcccccagcgacggaaggcagcauggauacgcuggagaacgugcagcugaagcuggagaacaugaacgcccaggcggacagggccuaccuucggcucuccaggaaguuugggcaguugcgacugcagcacuuggagcgcaggaaccaccucauccaaaauaucccgggcuucugggggcaagcauuucagaaccauccccagcuagcauccuuucugaauagccaagagaaagagguacugagcuacuuaaacagcuuggaaguggaagagcucggccuugccagauugggcuacaaaaucaaguucuacuucgaucgcaacccguauuuccaaaauaaggugcucaucaaggaauaugggugugguccuucuggccagguggugucucguucuacuccaauccaguggcucccagggcaugaucuccagucccuaagccagggaaacccagaaaacaaccguaguuucuuugggugguuuucaaaccacagcuccauugagucugacaagauuguggagauaaucaacgaagaauuguggcccaaucccuugcaguucuaccuuuugagugaaggggcucguguagagaaaggaaaggaaaaagaaggcaggcaagguccaggaaagcagccaauggagacuacucagccuggggugagccaauccaacugauccugcacaagucucccugcuaccuccugcugggcugcuccugguugacuacauauuuggcucucugccuucucuucauguuggccucuguguacuauagacccuuuggacuuuaguuacaagaauauggcauuuaugaucauguucuuuugccucccauagccucuugcuuuucuacguuagugucacauguuaugugaucgcacccggacuguucauauguuaagcacacauacuuuagaugugugcucccuguuaucuacauugccuggaccuuguucuuggcucuggccuuuccuacuugucuuuaacauggacacucaugagucauccuccaggacgaccagugcauccucaagcucugcuccuucagggccagugacuugcugggcuucguguucaugcuggccaugcaugucaucuaugcaagcguuuccauugccacugcagaaugaagccagugcacaugguauuagucaucagccagaacuuccuguucugugggucuggggucaccagcugagaugucaccugcuuuauuucuggcuuuggccuguggucugugauacccauccugcuugauguucugcagaauggcacuugacugcugggcaugcaugaaguuaagggcaagaaacaguaugccauguguucuguaccaucaugugucucuucuugcuucugggcccuucuacuggugaacuuucaucaagaucugcgccaugccgugucacuaucaagccauuaaguuuugucuggguugcugucagccccaguuggcuuccuggucaacaaggaccucaagaacugccuguggaccgaggcccccuaccagugcaugagacacacaccuacccuccccagcuuuccaggaacccuacuggcugccagacugaugggcgggcugguauguguggacauguguucacugucauuaugcuguggcuccaggugagggugaggacugggccuauauagaauccagauaccauugucaacuucccuuauucccgucuaagaugugagcagagugccauaguagggguucugggaagagguauuucugauuugugggccucugcuugcuugacuucaggucacuuauacuucuuauuuugcuugccugccuucaucccucauuuccucccucucauucuucuuuccucccucccuuuccugguagccuccuuuccuccucuucugccuuccccuuccuucuuuccuuauucuuuuuuauuuuguuuaaauaguaccacagagaaaacaacugaaaaaccacauuuuucuacauacagcuggggagguagcugagaacuuggcacugcgcacacauacuagguugaaagagaguugaggaaaccagaaggccaaguggaucugcuggcaaacccugaaccugucuccugcgcuugcucuacaguucugaaguugaaaauccuuuucaugccuagcaucugcuugaguuauaaaccccaaggcagccaugucauagacuaguguuuacucuuguuuugacuuuguuuuaaugcuuccuaagacccaagugccuccugcuguuuccuccuuugugguagccucuggccaucuggaccucaauccccagcuuucccacuuucagcaguccuuugcucucuuugcuucuaccucaaauagccccaggagugggcuuuagucuccaauauggagcaucucaagcuucuccugggggauggggauugggaugggcagaaucuguuuuggaucuccggguuauuuccaguggguguaaaagcagagcugggccuuucccucucuuaucccugaggguggguaagaaggacuguaucuacaccuguucuucccuaccuucucuuuuguuagggaggccucauucuaaguuccucaagagaguccuuggcuuaaagcuguagcaagggugugcuaggugggggauuuggagcaaaaccgucgaguaggcaugauacugguauggagugggccugcaaaaucagacagaaauggcuugagaagccgcagggggagcaugccugucucucagugauagaguaugggagggaccucccuagcuuggaaaaugagaauugaagggguuaugaacaaauaggaugccuaguugaggauguucccaaaguuuuguccaaucuuaucauuaguagauuuuauaagccacagagacaaaccagaaacggaauaauguuacuuuggaugcuuuauuuuuuuguucuagguguggcuuuguacaugcagaagaaugcuauaugcugcacauuuugccuuuaaagucuuacgacuuuccccauuuuagucuaaugggaagauacagaugugcaagucugcuuuuuuguuuuuuguuauuauuuuuuuuuuuuugcucuguguuauggacauuuucagacaugcacagaaguggagaggaugguccuuggaccccauguguccaucaccuagcugcaucacuuaucagcuauggucaaccugguuucaucuguaucucucucuuuucaccuguauuguuuauugaaaauccaagacacuaugccaaugcaaccgugacuacuuugggagauugguagucucuuuugauggugauagugauggggugcacuaucauaaucacaucaggucugcuuuuugcuuuuaauguuaacuaaugaaguuccagagaugggccuuagaaauguguuuuaagaauuaacaaggagucucaaaaagaaaugagagggaugcuuccuuucccuugcaucuacaaaacaagagagagacuguucuguuguaaaacucuuucaaaaauucugauaugguaagguacuugagacccuucaccagaaugucaaucuuuuuuucuguguaacauggaaacuugugugaccauuagcauuguuaucagcuuguacuggucucauaacucugguuuuggaagaauaauuuggaaauuguugcuguguucugugaaaauaaccuccccaaaauaauuaguaacugguuguucuacuugguaauuugacacccuguuaauaacgcaauuauuucuguguucuuaaacaguauaaauaguuguaaguuugcaugcaugauggaaaaauaaaaaccuguaucucuguua

SEQ ID NO: 17748 - RNA, 7669 nt, Homo sapiens
ccggccuggggcagccuggggagggacgcgggcggggacggagcucggcgugcuugcugcuggagggugauggcccugcaaggcugugggcuccgaccucaccgggagucgacagcgagagguucgccgaagagcgagguucugggcgagcgcugaacgccggccccaagcaccccgggucuuuacacaguccgcguccacagacucugacgaagacguggaucugcucucgcuuuagcugcucgcgguccuccagaucauguccgcgacuccugcgacuccgcgcggaaaaaaaaguuugccaggcguggacucaaugaccuuuccaagcugugcgccucgcugccuggaccgggucugagcgcggcugcccagguugaccuuucugcgggaggugaguguucgcucugggaaggggcuguagcugcccuuuggaaggaaggguuuggggguguaagaggcguucagauucucggucuggugugccccaaauucagaugugaaaauagaucauggggaugcaaucccagggcacuguauuucucacuuccuugggucccuggcacgcgacucccagcuaacacccaaccacacacauuucuacauacuguuucuuaauuuuguuuugggauauuuaaucuaagcggucagcaagacuucuuauaaaagcuggucuacguacacugagaucaaaccccacaaucccaugguguuucugcuccugcccuagcaagccugggucgacuugucccggggcagccgcggcagcgcagcguggacgggcccggacacccggugccugcccagccagcgacgcugaaggcacauuucaagagggaaauaguucaguccucgguaauuugucaaccucgugcuggcuuuaaaauucuccucccaccuucuaguccugacugagggggcccaaaagcaaacuccccgggggcuuaaacgcucggauuccugagaaacggcaagugagaaaggaguugcaguuguacgaagaaggagcgaggaaaagguguuuguggagggagccccggaucugucuuccuaccuguuagccgagaacaaaagggggcuggcguuucccgaagcgaaagggcgcagacagccacuuucucugcuaaacaaacugcaguccugggcagaacaagaaaauuacucacgcagggggagcaaggggagcacagagaaacagaaccuagauuaugcggaaggcaucuuaauuuaauuaacuccuugggaaggcagaggcgcucugaaggggcaggaacuucgcagccguuucucuauucaccugauacagucuggcccuaacaaucuguccuuuaacaauuuuuuuucuuuuuaaugaucuucuuugaucuacuuagucuauagcucucuaauuuauauaaaauucugcugugguuugggcugaaauucagugagccuaccuauccgaccaucagucauuuaucucauauaccagugcacagguuuuagcagaugaacccugacuguauauuauuuuuagauaauucaguguaauauuaccauuaccaaagagcgaaacuccuuaucaaguuacuucuuaauuuuuuucuccaauguuuugaaagcuucacugaacugaaauaaguguguacacaucuuccuuggugacagccagucaaguaaauuuuacaaaauuucuccacaugccuggaaauuccugugaagaagacugaugaaagaaaaguagccucagcuccaccaacauauuuaugacuuuucauugguuuaaguuucuuuccuugcaagauuaaaaguaaccaguggucugaaacgggacgguggagaaaugacagcagaugaugaucgcuguuauuuccugaaagggagugugggaacuacaaggcucagcucuagacaaaacgaaaguacuuuaggaucucugcauucacuuaaaauacuucuuuugacauacauuuccagcaacucaaugggaguguggaaauuuaaccuuccuaauuauuuguggcaagagccauugguggauauuuaagguuguucuguuuguaaaaggguuucaaaaggaccaaugguuugcucuuccucuaugaagaaacuaucugcccuacaaauuaaaacaaacagguacuaugaaauagcacuuuuuuuuuuuacuaacaugaaccugaauuauauuagucguuaauuucuguauuauaaaccauucagagaaaagggaaagaagauggcacucaacuuuguggcaguguaaccuuuauggcagaguucgcugugccuuugguauagaaaucacaggucacaacaguacuuuagccaacaccacucccccacaugcccgcuccccccuccccaacgcauacacccuguggugggaguugugcuuugccuccuguauuuauuucuaagaaaucuagucugggaauacacccaaauaauaauuucgguuuccucucuaugggaaagagguugcuuuucaacacgaagggaaaaauaauauuuugaaucucuggaaaauccucauuacgcaaagagaaggaaauaaagguauaaauuauuauuuuuaauugaaagggaaauaaucagguagauuaccaggaauguuaguagaauccuuuuccccugccucccuaagagacuugccaccgagcaaaaaugaaucgugauuuguggugggaaaguugauuacuaauggggguuugcaguugcgguugaauggucugacugagacccucugacuguuacccaccucucauuaacucuuagccugaacucccagaccgcauaccaccaagcagaagcgauucguuaauaaaucucugucccgagcccuuccagaggaaggugugggccccgcagaggcagccagauccugccuugccagagcgcucugucauuagcguagcccccuaagucugcucacagauggaaccauaggcaauacuucauaacgcgcuggagaggacaagucagacgcaggaagggguugggugggaagggaaggcuggagucucuccugccuuccugcuggguucaaaugccaggcuuggcgguugguggcacagacugggaaacgugacuccuacaccugggggucugcccucagagggaaggcccuggucccccgaacuggcagaacuccuuucuaaaaaggggcugguagugggagaaggugggcccgcugugaauguaggugaggugaucccgggaaccugggucugaaaucagaccuguguugccauugggagcacggagagaggggaagcgcccugcuuaggcccaggccgggcguccugguggugggaccgcagccgcacucaccuccaggccaacggacaagguuccugcaagccagcagggccacucugugcuuggccuacugcagcuccccugcagcuccuuuccucucccuccccggagcgcucuccucucuccucuccccucucuucucucuccucucucgucuccuggggcaucccggguggagggauguaggggucgcuccucggugccaggccgggaagcagcucaggccucccaagagcuuggcgcucagucugggaaaagggguuccucuggccucagggacguucuccgcccccaccccacccccugggagccugaaccaucuggaagggaucuuagucggggguugggaggagagcccguggauaggaggagggggcgauucuaggccgaauccagccccugaggugucacuuuucuuuccugcggcccgucaccgcugauagauggggcugagggcagaggaaggaaaaagaaaaccuccgaggucagugcggggcgaggugagccccucccagggcccucuggcccaggaggaugaagcgcgccggcuucgcucuugcacgccggcuugccauccggguaagcgcgggaaaggcggccacagggcgcggcggcagcgcagcgcgugggaucucacgacccauccguuaacccaccguucccaggagcuccgaggcgcagcggcgacagagguucgccccggccugcuagcauuggcauugcgguugacugagcuucgccuaacaggcuuggggagggugggcugggcugggcugggcugggcugggugcugcccggcuguccgccuuucguuuuccugggaccgaggagucuuccgcuccguaucugccuagagucugaauccgacuuucuuuccuuugggcacgcgcucgccaguggagcacuucuuguucuggccccgggcugaucugcacgcggacuugagcaggugccaaggugccacgcaguccccucacggcuuucggggggucuuggagucggguggggagggagacuuaggugugguaaccugcgcaggugccaaagggcagaaggagcagccuuggauuauagucacggucucucccucucuucccugccauuuuuagggcuuucucuacgugcuguugucucacuggguuuuugucggagccccacgcccuccggccucugauuccuggaagaaaggguugguccccucagcacccccagcaucccggaaaauggggagcaaggcucugccagcgcccaucccgcuccacccgucgcugcagcucaccaauuacuccuuccugcaggccgugaacaccuucccggccacgguggaccaccugcagggccuguacggucucagcgcgguacagaccaugcacaugaaccacuggacgcugggguaucccaaugugcacgagaucacccgcuccaccaucacggagauggcggcggcgcagggccucguggacgcgcgcuuccccuucccggcccugccuuuuaccacccaccuauuccaccccaagcagggggccauugcccacguccucccagcccugcacaaggaccggccccguuuugacuuugccaauuuggcgguggcugccacgcaagaggauccgccuaagaugggagaccugagcaagcugagcccaggacuggguagccccaucucgggccucaguaaauugacuccggacagaaagcccucucgaggaagguugcccuccaaaacgaaaaaagaguuuaucugcaaguuuugcggcagacacuuuaccaaauccuacaauuugcucauccaugagaggacccacacggacgagaggccguacacgugugacaucugccacaaggccuuccggaggcaagaucaccugcgggaucacaggugaggcgggcaaggaggauggcugggagagggaaagcgaauuuguccuggacacaccgaguccugauagacauucccagugucauuauaauccccugugaucuaaaauacacccucagucacgcuccucagcccgguucagcuaauucccaacaucuacccuuucuuucccccagcggcucuugcuacguucuuguuuggaaugagggagggccuuuccucagucuuggacaggaacaaucuguuggccuuaguccugggaugguuauccugucuccucccggugcuguggggaguggugcaggcagaacccagguacccuggggugccgguccuggcugcagucgggcuacuucuguuggguuucgucccuccccccaccccccacccuccacccaggugcgccccagagccugccguggggaccuuucuuuuaagcuguauuuguggguugagagggggaggaggucuugaggucaccgaauuuacaaacagcucccaccucccuuccgcgaccuuaaacucugcauuaauacaaggcaauugaaggcauucaauaauguaaguguuaucauuggguaaaaacuucucaggaguuggggagaccuuuuuagcgguaucuuuucuggacucuaccugcuguuccccagagaugagacuucuguacccauccugcgaggcuguuaagggauucacuaaaauuagcacuucuaaacucagccuugccuuacauccugauuuggccaauuuaaaucccagagaaaaccauggaggccaagaaaggcccguucagcgggguuucgagcuccagaauacgccagagagggcgaucaaguguagauaaagcccgcgggcuggugaauauuuugaagagaauuaguugagauuaaccauaaagagaauuacacaggaaaaaaaaaaaucuaaaaacguaaauggaaaucuuguuucuuuuguucuuccacgacuuccuuuuaaguaauugcuaaaaguaacucuucaccauggggcaaaguuauuucaaugaaaccuuauauugauuuucagauacauccauuccaaagaaaaacccuucaaaugucaggagugugggaaaggauuuugucagucuagaacucuagcaguucacaaaacuuuacacaugcagguaaguuuguuuucuuguuuaaaaacaguggcugguucguguuaucauuacugcuuugcaaaagguguucaauggcagacucuuucucuuaaaaggcucuauuuagauuaguucucuagguggggaaaagcaacacuugauuucuuuaauacauaaaauuaaucuuguuuaacauaaagcauuuuuauauuuuucucaaaaaacggccacuuugauuaucauaaauccuaauuuuagaauuuuuuucauccaaucuguccugcauuuaaagcuuucguguuuaggaggaaauaaagguaauuuugauaauggaggcauagugaaaucccauacguucucuuucccaagggccucauaauuuguagcuuucaggacauugaggaauaguuuaguuuuccagcaaagaggagccuuauuacccaggagaauguuguuccuuaagagaggauuagaguuuuuccuucccccuuuuccugccuaugacauggugaugaaaugugaagagcuggaaaucacaaagcccaccgagguggcugcgggucugccuccgaaguuaucaguguaaucgggccucuguguaugccugcacguguauuuucaugauuggaagauuaggagcacggauuuguuccugcaagucuccucuuuuguugucaugagaguguuauguuaacgcuugugauaacgauaagacagaaacuauugaaaagggugcagugguggugugaaggauuaauccuuugcuugcuucacaucugaacaggaaucuccacacaaaugucccacauguggaagaaccuuuaaucagagaaguaaucugaaaacucaccuucucacccauacagacaucaagcccuacagcugcgagcagugcggcaaaguguucaggcgaaacugugaucugcggcggcacagccugacucacaccccgcggcaggacuucuagagaagcccaggaucugucccgugccgccgcugcuccccuccccagacaccucuccacgucuccuacccagggggucgcaucccuagcccuucacugaccccagcucuucccuugcugcagccgcaccugcagcuccagggaguuaacucuucuucugggggacugagaacuguagaaagccacacacuacuacaucccuucacaaagaguauaugcuaguuucuuguagauauucacagcucauuuuagagcucuguacauaauguugugggucuuuguuuuguuguuuuguuugcuuugggaucuuguuggaugcacuuagauauggaaaauggaagccaaauuuuaucuuuaaagacuguauuuucaaaauaaaacuuuuucuuguuuguuucaa

SEQ ID NO: 17749 - RNA, 821 nt, Homo sapiens
caugccaaaauaaugccacuuaaagaggaaaacuuuaguuugcacaauuaauugaaaggugcagcagcaucaugauugcucaaagucgaaggguacacagggugcaugccgcagggauuauuccuaacacuugagaaggucuaaaucauuuugaauuuccuucagcccuccagaaaauaguuaucuuaauauccuuguuuucuccagcuggacuuagacaugaguaaacuucccaaauucggguuccugaaaaggcagcgugugcugcagccuggcacugacucccccgaggagcuauggcgggcggguggguaacggucucaccagggcgucaaagauccgcuaggcccagaaagccaagggcagcaggggaugggcuggcgucaccaggagcggaggagugagggcugccgcgcgccucccuaggcccagcaccuggaagacacagggcgacgcggggccgggccgccgggagacccgcuaacgggcacucgccuggggucccgccgccugccuggaggccgcggggccgggcgaggcgccgaagcggacaggugggagaggagccgggcagcagccgcuggaugggccggggagaagccucggccucgcccccugggaugcgggcuauggcaacccccacgccagcuucgcguggggccgcugccuuuaccuccuuagguuugaacggcccgcccgggguaaccgcuaagcgcagccccgccccgcgccgcgcugucccgccccuuccuccggcucugcagcgcucccgcccggccgcccgcaggccuggguccucgcuugagcgggaggagcgcccc

SEQ ID NO: 17750 - RNA, 682 nt, Homo sapiens
agaugaaagggcuauugcuuccaaauugcauaaauugcuauuucuuuauugcucuccuaacaagggcugcccuaaaauuggcgugaagggcuuccaguuugcauuuucccuguuuuccaagccuugcucauuuuucacaucucuugaacucucucaauuccagccugcuugaguggguggcagagcagaggguggggcggggguggagggggcuaauuaacccaggcuaagagcagccuuggcaagaagccaggggagggaggccuugcuagguggagcuggcaccuggcuuguuguguggauaaugacucagggaccacaagagaaccuggguaaggugcaguuugggcagcagcaaauaucuggcuugaaucauggcuggauguuuacuguauuauuuagaaggaaagcuggagcugugaugauuccuaaauagaauaagacaggcugacacagacaugaagacuggcaagucagaauaagguaugccugucagcuuugucucuaggauguuguguucuuugauuugucacagaggauggagcaguucugaacagcagaucacuguucagaagcagccuagcauuaagugaaucagagagugcccuccuagguggagaggggaagggcgaauugcuucagggagaggugaugacauugucuccuucuuggaggccaucuc

SEQ ID NO: 17751 - RNA, 682 nt, Homo sapiens
gagauggccuccaagaaggagacaaugucaucaccucucccugaagcaauucgcccuuccccucuccaccuaggagggcacucucugauucacuuaaugcuaggcugcuucugaacagugaucugcuguucagaacugcuccauccucugugacaaaucaaagaacacaacauccuagagacaaagcugacaggcauaccuuauucugacuugccagucuucaugucugugucagccugucuuauucuauuuaggaaucaucacagcuccagcuuuccuucuaaauaauacaguaaacauccagccaugauucaagccagauauuugcugcugcccaaacugcaccuuacccagguucucuuguggucccugagucauuauccacacaacaagccaggugccagcuccaccuagcaaggccucccuccccuggcuucuugccaaggcugcucuuagccuggguuaauuagcccccuccacccccgccccacccucugcucugccacccacucaagcaggcuggaauugagagaguucaagagaugugaaaaaugagcaaggcuuggaaaacagggaaaaugcaaacuggaagcccuucacgccaauuuuagggcagcccuuguuaggagagcaauaaagaaauagcaauuuaugcaauuuggaagcaauagcccuuucaucu

SEQ ID NO: 17752 - RNA, 19955 nt, Homo sapiens
gugcacuguuuaaggaauuuuuauuaaagcaagaauuuuauaauccaaauuacguuuccuugcucaguuaucaauucuguuacuuaaaacagaacugacauucugagcuauuccacaguaaagaauuacaaaauuaaagaaaggaaugcuuuaaauuuuuguacuuugcugaaaauucuuuuucccagggucuauaaaacauuaauuuguuuuuauauuuuacuauuuuuuuguguuuuuuuguuuuuaaaucaauaaguaaucuaggacuagcauuauguuugcuagaccuggcauuugcucgguacauaagguucaaaguuuccuuuccuuuuuuuauuuauuuuauauuuugcaauguuuuuuuuccauaauauuuaaguuuuucgauguuuagauauuuuucuucggugaagcacaaguuucuuuucauggucccugaucaaucuguaaauguuaaaaaaacaaauuaagaccaggacuaucacuugucaguagcaaauuaaagcccuuagccaaaugcaaugugguuguuuuuauccauaguuuuacuggaacacagccauaccuguucauuuguauacauacuaucuaugguugucuugacaugguaacacuggaacaagaucauuucagagauaacacaguccucaaagcccaaaauauuuccuaucuggcccuuuacaaaaaacauuugccaaucccugguccugauccuggcugcacuacucaauuucuugggagugaugaaagacaguaguagagacccaagggcaccacccaaaaaggaaagguaaaacuaugaaagccaaccugugacaggucauuuuauauauauauuacuauacaaaaucuggcagggcgcaguggcucacgccuguaauuucaagacuuugggaggccgaggugggcggaucacuugaggucagaaguuccagaccagccuggccaacauggcaaaaccccaagucuaguaaaaauacaaaaauuagcugggcacgguggcaggcaugggccuguuaaucccagcugcucgggaggccgaggcaggagaauugcuugaaccugggagguggagguugcagugagccgagaucgcgucaaugcacuccagguugggcgacagaacgaaacuccaucucaaaaaaaaaaaaaaaaaaaaacaccaccugaaaguccugggauuuuaaaaauccaacaguuaacggguaaaauuccuuuaauuccucuauaguuaguuccacuuuuccuugaaaaauuagcaauacauuuaaaugaacuguaaaaugaucuuuugcuauguacauuucaaaauaugcucaacaaacuuuauaaaagaugaagaaaacaagcuuaaaacaacaaaccagagggaaaagcucacuuuaaacaguuggaacaccgguggcacuguuaacugcuuucugggcagccucuuuagcuuggugggcuuguaguacagcuacagcuucaucaaccuaaaaaaggggaaaacagauaaacugguucaggaaaggaauggaaauaaagaguuucauaaugguaacauaccaauucccaacaaagauaaguuucuucccucaaaugaaaguauaaauuguuacacuaaacaacuauauccauucaauuuugaguucuauuacaccacuauucuagaauuaugaaucgcuccccugcacuacucuuuccuuguccuccccacacucgaaaaauauuucucuuucuccacuagagaaagcagcagcaguugagaguauggcuguuggagcugaugggauuugaagccaggcucugccacuuaagagcugugugagcauuuggcaaauuauucagccuguuucaguuuaccuaucuauaaaauggggauaaauagcgccacagguuauuaugcagacuuuacaacuguacauggcuuauauauaacacgauguaaguguucuguacaauuaaguccccauaaaaagccacguaauaacuguguaagaggcaacuugguaaauaaauuuaaaucaccuuagaacggagugacucuggagacucgagcauaugaagaaguucugaauuaucaaucuccaacaacaugccagugauuuuaccagcaagaguagggugcauggcuugaauaagaggaaacagccguucaccuaggaacagaaacauucaaaaacucccuucaauaaaaaaaaguuuuuaacugcauugaauuaccacauuaaacugggguuuaagaaccauacuucugucucacguauauaauaacccauaauccacaauuucauuaugucuucaugggaagacagaauaaaaucugccacaaggcaauuaacucuugauauuaucagcuugccaauuaagcaauguuaccauuagguuguuaaaucgguguucaggcaaagucacaaguuuucuucucauuugcuucaaauuccuucucucaaaaauguagugagggcccauggugaguaaugcccuacuacccuauuuauuacuaacaauacauuuucuuauuggcuuuccagugguuuuaauuaggcagaccaacuguacuaucauaaucauucaugccaauucagaucaauuccacugcccuagcugucaauugauugaccuagugccuaagugauuccuauauuuucuagucuuucugaacugacaaggugggacagaaguacucacccaacauuugcuuuugcucuugaggaggggcagaugccaacauggaagcagucaaagguuccugaccuuguacaugaacagcaggcuagacagaaaaugagaacucuuaaguuuaaagcacagaaaaagauggcaaauacaaauagucaucaauggacaucugcugaagugguagacuuccaucgaaacaugagguggagaaguugagugagcgaauuagaaagaagccaaaguaguuauuauauacuauguaucacagauacauuuuuuuucuuuuugagauggagucucacuuugucgcccaggcuggaaugcaacggcacaaucuuggcucgcugcaaccuccgccuccggauucaagcaacuuuccugccucagccuccccaguagcugggauuacaggcaugugccaccaagccuggcuaaucuuuauauuuuuagagcugggguuucacccuguugaccaggcuggucucaaacuccugaccucaagugauccaccugccuuggccuccugaagugcugggauuacauagaggugugagccaccacgccuggcccauagcuacuuguaauaguuguuucagaccaggcguggugauuuaggaugugaauuucucgcugcuuguccaauuccaaaagcguaagacauuuuacauacuaucauauuagcagaauguuccagauaggcuaagcucucaagaaucuaucaugcagcugucuucacauuuuuucuuuugagacagagucuugcugucacccagcagggauuacagcuugcugcagccuuaaacuccugggcucgagcaauccuccugccucagccuuccuagcagcuaggacuacaggcuuaugccaccacacccagcuaguuuucuuuguggagacaggguccuguauguugcccaggcuggucccaaacuccuggucucaagcaaucugccugccucaaccucccaaagugcugggguuauaggugugagccacugugcccagcugucuucacaccuuugauuucacccaagaaaugugauuuuuauuaagaaaucauuaaauccauaccuguugcauuguaacuuguggcugugcauuaagauguugcugaggauugcgaacuccugcagcauauuuauacuguggaacggugcggacagcaggaguagcugcagcggcugcagcugcaggacguggacccauugucuguguugauguguuagcuaaaaaauaagaacauuuuguauuuuuaucuugcucuuucaaauuggugaucaauuuuuaaaggaaggauuaagacucaccaacacgcuguguugacaugacucguggaaccugugaagaagcuggucucauaguacuaaaugguggucuaggagcagcugggcggauagcaccgggcauauuuuggaaugcugcauuuuaaagaugugaauauacauuaacugggaaaacuuacugagugaaaaguguuuaugcugucuucuucgaucugagguuugcauaaaagacuaaaaagugacaaaacuuuuuaaagcugagucuuaacacuugccauuuucccagacucagagcaucaauaaguaaaaacauuaauucauacaaggacgaguacuuauauguagcgaccagccccacagggucggugggcuucucccuguaugcagcgacgagagagugcagaaauaaagacacgagacacagagauuuaaaaaaaaaagacagcugggcacgggggaccacuaccaccaagacgcggagaccaguaguggcccugaaugucuggcugcacuguuauuuauuggaaacaaaacacaaggggcaggguaaagagugugagucaucuccaaugauagguaaggucacguggguuacguguccacuggagagggggcccuuccccgccuggcagccgaggcagagagggagaggagacagagagaaagacagcuuacgccauuguuucugcauauuagagacuuuuaguacuuucacuaauuuacuacugcuaucuagaaggcagagccagguguacaggauggaacaugaaggcagacuaggagcgugaccacugaagcacagcaccauagggagacgguuaggccucuggauaauugcaggcaagccugacugaugucaggcccuccacaagagguggaggagcagucuucucuaaacuccccaggggaaaagcagacucccuuucccggucugcuaaauaguggguguuuuccuuugacacuuacgcuacugcuagaccucgguccgccuggcaacgggcgucuucccagacgcuggcguuaccacuagaccaaggagcccuuugguggcccugucugggcauaacagaaggcucgcacucuugucuucuggucacuucucacuauguccccucagcuccuaucucuguauggccugguuuuuccuagguuaugauuauagagugaggauuauuaugauauuggaauaaagaguaauugcuacaaacuaaugauuaaugauauucauauauaaucauaucuaagaucuauaucugguauaacuauucuuauuuuauauuuuauuauauuggaacagcucguguccucggucucuugccuuggcaccugggugguuugccgcccacacuuauaaauauaccugaaacauaaucaugauaaaauucuaagugcucccagccuggccaacagggcaaaaucccgucucuacaaaaaauuuaaaaaauuagcugggcgugguggcgugugccuguagucccagcuacuugggaggcugaggcaggaggaucaccugaacccgggaggugaaagcugcaguaagccaagaccaugccacugcacuccagacuagaagaaagagugagacucugucuaaaaaaauaaacucuaagugcucuuggaauauaacauacuguuccacaggacaagacauaaaauaccacgacucugauucucauacaugauuaaauggaacgagaccuuuaaaacuguggccugacaaaauaugaaauuggcugggugccauggcucacgccuguacucucaacacuuuaggaggcugaggugggcagaugaccugagaucaggagcucaagacaacccuggccaacguggucaaaccccaucucuacuaauaaugcguaaguuagcugggcgugguggcgggcaccuguaaucccagcuacuccagaggcugaggcagggagaaaucgcuugaaccugggagguggagguugcagugagccgaaacugagccacugcacucgagccuggggcaacagagcgagacucugucucgaaaauaaauaaauaaauaaauaaauaaaaaaugaagagcuguaccuauucccaaaacuuuuauaaagggaaaucaaaccacuguagacauuacuaucuuagcacugcuuuuaaaugcuauaaaaaugaacauccauaaccacaaauuaugugaaaugcaauaguuaaccuaacauugacauagaagagcugauuuacccaauguguuauuuuuaacucaauccccaaccuuaauuaaaagaaaaaagacuuacgaugaggucuggcacccugagcaguccagcgaggacuuggucuuaguugagcaauuuggcuaggaggauaguaugcagcacgguucugagucugcagggaaaaaaagcacaugaguuuaucaguugaagaaaaaagcaaauaaugcaauaaauuauauguacuuuuucaaaacauuuaccaggacuucacacucaagcauuuuuuccuacucaaucauaauuccccuuucuuaauguuucacauuugcggggcgaggggcacaaaaaacacuagaaaugaccaaauacgaaaaccuucaugguucugguugccuucuaaaaccuaccugugggauagcugccaugaaguaaccugaaggaggugcuggcugguagggguugauuacaggguugggaacagcucguacacuugccauucucugcauauacugguuagugaggugagccuggcgcucuucuuugcgcugagcuaaagcuacauacaauggcuuuguggccacaauucuaccguucauuucuguaacugcuuuaguggcuucuucuggggaggagaaacauacaaaaccaaacccuuugcugcgaccacccuccaucauaaccuauuaaaaaaaagaaaaaaaaaguuaacguaaugguagaaugaggagcaaaaaaagagcguuacaauuuagacaauuauaaaucacugaaucaaauaacuaaacccuguuaaugcuuaaucaucuuguauuuacccauugaguucacaauuuuuccuuaauacccaauuauuaagggcaaacuacacauaugcauuacccuagccaggucagagaacugacagaagugaaggcugcacagaaacuuuuaaagauuuuagauacugaauuugauuggauuuucaauauugaaauuuaauuaucuaaauaaauacaucccaggccuacuaaauugacuuuugggcaccacuggaagcauuucccaauuaaauuuugacuauucuaacaauucaagcugacaagaugcuucacuaugccuuugagaaaaaaguaguugaaucuuacaauacccacaucuuaaaauaaaaguuuuuacauucaagagcagaggauccauaaauauuacgguauaaagaacacucaagaggaagguucuucuaaaauugauugcaaagaccuuuuaaaugagcaaugaagacuugcaaagaaccacucgcuaggccagcaauauauauaagcaugcuauaaaacuacauuaacaguaugcgaguggcauaggaacaaacgguaauaaaacagaggccagaaauauacccaagcaauuaugggaauucacugugcuaaaguuaacauuuuaaaguacuggggaaaaaggacuuugggcuacucaauacaugacacacugggacaaaugaaaaaauguagaacucuuaauucacauuacauugaaaaaucuuaaaugccagguagauucugaaucugaacauagaauguagaaauagagagaaaaccuuucuaagaugacacacacacaaagugaggucuauaaaguggaaaauucgaagaaaauauuuccaauauaaaacaaauguuuggccgggcgcgguggcucacgccuguaauccuagcacuuugggaggccaaggcggguggaucaccugaagucaggaguucgagaccagccuggccaacguggcgaaaccccgucuuuacuaaaaauacaaaaauuagccgggcaugguggcaggugcauauaaucccagcuacucgggaagcugagacaggaaaacugcuugaacccaggggguggaaguugcagugaacugagaucacaccacuucacuccaucucaaaaaaauaaaacaaauguucccuuaaucaauaaaaagacagacaaccagccaggcacgguggcucacgccuguaaucccaacacuuuaggaggucaccugaggucaggaguuggaagaccagcuuggccaacauggugaaaccccaucucuacuaaaaauaccaaaaauuagcugggcguaguggcacaugccuguaaucccagcuacccaggaggcugaggcaggagaaucgcuugaacccgggaggcggaggcugcagugagcugagauugcaccaccgcacuccagcccaggcgagagugagacucgucuuuaaaaaagacaaaaaaaaaacaccucauaaguuuaagaauuuguguugcacugcauuaaaagcauucuugggccgcauguggccugcaagcagcggguuggacaagcuuggcuuaagcccaggaaaggcugaggcugcagugagcugugauuguggcaugccccugcacuccaaccugggcaacauaaugagauccugucucaagaaacagaaaaacaugcaugcuucauacauucaaaauaugcugaugcacaacacucaauuuaaacaauauccagggaacacacugaagacaaaaacauucaggaauaaauucuaucguacuccaauacucuuacauaaaaagcauaaucugaaacacaagacaaccauggcacuuccaucuuacuuguauucaaccaccuuuccccuaacauuuccucacucucacagaagcuuccucggacuugccaggaaaagcugacuagaaagaucagccacagcgucauuccaguucaguugaguuguaauuuuuuucuaugcacucuuccccaaccccagcaaaauuauguaugcacaaaaccuugcauauagggggacucuuggcccacggaugcuagacaaaaacaucuagaagagaacuucuuaaaucaagauuucagaauuuguacuagaauacuacugcuuuguuucuuaaucucugauuucaaauaaaagaaaauaugaucucuauucuuacugcuagggggcaggggagggaacuggggcuugacuacccagaaugaauuguagaaaugaauaaacagaucagaacuauaguaacaauuauaagucccuaauaaauugcuugcuuuagcaaaaugacuaguuguuggaauagugcauaucaugugaggauaucagccuuccuuagcaaagaguucagugcuugccauuuuuaaguuaaccauuaggcuaugacaaccaguucaaaugugaauuuaaguuuuagaaguaacgaagcaaacaccucucuaguggcuauaauaauacaaaauuuauauacauauaucuacauguaugaauuuuuacuagaccucaaauaaaugaaccauauguuuucuuaccuuugcacuagugauuguaccaaauggagaaaacucuuuccggagacguucaucaucaauaccaucaucaagauuuuucacauaaagauuaacacccuaaaaagaagaaaagaaaacuauagaaaaagaaaaccauggugguaccuaaguacaucgggucuauuauuuuaccccauauuucuucuccuauuccccucucaaacccuccagcuaccuggaaguaacugaaaucaacguaaaauagguuuccucaucccugucuuauuuugguuguucaauuaaaaaugaaccugguaucuggugauccuaucuuguuucaucuguucaaauuugcgcuuaaguuccgucugccguuccaccuuuuucugagcucgaccaacauaaauuuguuuuccauugagcuccuuuccguucaucucauccacagccuuccccccaaaaaaaaagaaaaaaaaaaaaucacaaaacuuucaacuuacaguucauuuccuuaacaguuaagacaaauuuguuaagucacaaaagcuaaagacaaacccaucccaaaaucucaagguuuugggacaauauagguuaccaauuuauacucucaaaccuaaugcauaaaaugcaaauaacugaaaauauaagaacaugucaaauagcuauuaguaugcacauagacuucaacacaagagcaacucaacuuuguacccccuucuuccugcugaauacagaccacuuacuuucugugcaucuucaugccuuucaaagcuuacaaauccaaauccuuuggauuuuccacuuucaucagucauuacuuucacacuuaaggcaggcccuaaaaaauuuuuuuacauaaaucaaagauauuccauacaacauucacguuauacauuucaaauuucaacauacaaagccaugaaaaaaauuucaaagcuccguaacuugacuccucccucccagccuucuaugccccagguagguauacuuuuccauugaaagaccuuuuauuauuaagaagguaaacaccuucccuccccugaaggauuccuccuuccauuuaaggagguacacuuuaaacggcuguaaaaaguuuuauucucagcucuagcacaaaagaguugcauuuuuuacccaauaauuugauuuuuucccuuuucuauagagacaguauaucauuccauugcccaggcugaaguguagcagcacaaugaauaagcucacuuuaacucaacuccugggcucaagugauccuccugccucaacuuaccaaguaucugggacuacuggcccacauaccaccaugccuggcuaauuuauuuuuuguagagauagggucuugcuauguugcccgggcuagucuaaaacuuguggcuucaaguaucuucccucuuugaccuccccaagcgcuaggguuacaggcaugagcuauugugcuaagaccaauuugauuuucuuuguaucaauuaagaaacaaguauuuauuaagccuuggccuacccgacuuucaacaggaguggaaggaauacauaguuggacucuuugguaagacauagguaauacaggaauuugaaagacagggaaaaaaaauucuuuuuaaagacacaggugaacuaccuggaagaggaagcauuuauuucugaagacauguuuuccccuaacucccucuaaaguaggagagacagguaacugaggcgggugguaucucaggcaaguggggcagaaaagguuaaaaaucacauuugauuacagaaauuuagaagauguaugggccaaggcagauuuucuucugaaugugccucucuccugaggccaaagucaagaaaauaugacauauucacauauuuguggucaacuuaugcagcauuacucauacgguagguaguuaacaucaacuuuuacaaacagcuucuaauuauaagacauuaagaagcaugacaguugaaauauauaaaaggcaguagcuaaauuuggggguugagauguaaacaugaugucacuuucuauguuuuauaucaucuaucuuugugcaaaaugguacuuuuuugcucuaguggagggcuugaugugacaugcuagcauggcaguaagauauuagauuuccuggccaggcacaguggcucacaccuguaaucccagcacuuugggaggccgagguggcuggaucacuugaggucaggaguuggagaccagccuggccaucacggugaaaccccgucucuaauaaaaauacaaaaauuagcugggcaugguggcgcacaccuguaaucccagcuacucaagguagagauaggagaacugcuugaacccgggaggcggaggcuacaaugagccgagaucacgugacugcacuccagcccgggugacagagcaagagucaaaaaaaaaaguauuagauuuccuaauucuuuauuauuugacauauuaaaaaaagcaagacaccucuaaguucaacacaaaaugcaaaggguggggucaagcaaaucaucugcacaugaacacuuaaaaguuauuuuaucuguuauaccccuaccuaaacuaaggcugguuugugcuucaucaauuucaaguuuuaugaaguuauuuuuaaaugcaggaaauaaguacuuugaaucacuggaaaaucugaauuuuugguuucaucgcugaaagucauuguuuuaaacugcucaaacaugauguuacuuagacugaccagcuuuauuguucuaugagacugcauuccacuguaggcuggcugugucaaauauaugcuucugaugacaugggaucucuaauuacacacacacacacacacacacacacacacacacacauauauaucuccagccucuuaauguaguaaaauauuuuaaaaucuguucuaauuacuuagucauaccuuacugugcuaaucuaaugcuauuaaccuuuaaccuggauagaauucuauuuauuugcauuauacuacuuuguaguguaauagauggccagcagcuuaauucaaauaaccacaaauauuuuaaaguaccauguaagucuaauuuuauugacuuuuuuaguauaaaguaauagcuaaaauuaacacugagcacuaauucagagcuuuguguguaaaaauuuaauuaagacacauuaccaaacuugccaaagagauccuuaaggcgcucaucauccaugucuucuccaaaauucuugauguaaacauuggugaauucuuuugcccuagcuccaaguucagcuucucguucuuuacgagacuuaaaucguccaacaaaucuaauaagauauacaaggacuauaacauuagauucuauuuuauaaaguucagauuaaguaagccugaugguugguuuuguuacuguuaaugagaauauucagaaucccuaauaaaaagcacacuacaaaauagaaauagggccauaauuuaagauaugacaccaugaaauauaugaauaagccucuaacuacaaucacaaaaaaaaaaccacuucuuuuaauacacacuucucuucucuagcuaaccuaggguuaaagggaucacucccaucaauacaaaugaguggaagugcauguguaccaugccaauaaaaagaccucuaucaaauuaaaaagcuuucaucgucauuuuaaaguggcgcuugcgcuuucuuugccaucuccuagaauaaaaauuuaaacuucccaaucguguacucuaacacacaacagccugacauaacugcagcauuuucaacaaaaugacacuaaaacuuaauuuuuucugaauauaacaguaguaauucagaacaaggaucacugggcuaggcaguggcucacaccuguaaucccagcacuuugcaaggccaaggugggaugaucacuggaggccaggaauucgaguucagccuagccaacauggugaaacugucucuacuaaaguacaaaaauuaguuggguguggugguguacaccuguaaucccaccuacuugggaggcugaagcacgacaauugcuagaacccgggaggcagagguggcagugaguagauugcaccacugcacuccagccugggcaagagagcaagaccaugucucaaaaauauaaaaagaacaacgaucacugaagaaaaaaagguagcacaugugucauagcauauuauaauacacagcaaagcagaaggaaaaaccaucuuacauaaucucacccuagucaucuaaauuuccuuaucucuaacccagcuuuagaauaaaaaguaaaauaaaaauaauuuccuuaucucuccacaaaauaugguuggucuucgcuaugcuauuaguuucauaaauguucucaaagggagcguauuucauugugaccaucacuuucugcuuuguaaauaaugcugcaacuuuuuuaagagacaaggucuugcuauucugcccuggcuggaguguaauagcuguucacaggcacaaucacaacacacuacagccuuggcucaagcauccugccucagcuucccaguggcugggaauaaaggcacacugcaguaaagcugaaacuuuaugaaagacacuuuguguauuucuucuuaggacaguuacaaauuuccaaaagaguuauaucacuuuuacucaaaacagcaacauaucauucuuuucuggauccugccaguguugggcuugcuuuuuuuuccuccuaaagcccugguaacaggcauuugugaguauuuauuuauuuuuuuuaaagacaguuucaaucuugucgcccagacuggaguacaauggcgaaaucucgguucacugcaaccuccgccucccggguuuaagugauucuccugccucagccucccgaguagcuaggauuacaggcaugcgccaccaugcccagcuaauuuuguauuuuuaguagagacgguuucuccauguuggucaggcuggucucaaacucccaaccucaggugauccgcccaccucggccucccaaagugcugggauuuacaggcaugagccaccgcgcccggacuugugaguaauguaugucucucauuuuacaguacauaaaagcaaauuacuuugaguuuccucaccuauaaaauggguuaauuuaaccaguaccucaagaauuaugaauauuagguuugucugaauuccugauuuuucacuaaugcacucauuuugaaaaagcuacauuuuucuguuuacuuaucuucuguuuuccuuuuggcaugaauguuaauuauauuaaaccuguuauuuguauguuacacuuacuguguagaaaauucaauuguaaaaaucaagauuagcuuauuaauuuucacuccaguacaacuacaugaauuuuuguuauucaucuuuaaaauguuuuuauucuuuuaucuuaugugcaucuaacuucucccugacaaauauuaacuuaaaaugaauggauuuggaauuauuaaaaauaagauucaaaauaugauuagcuagauauuuauaacuuacacuuugcgaucauuuaggagcauuccauucauuuuuucaauagcucuuucagcugcuuccugcgucucaaaguguacaaauccauagcccuuggaaccauuuucaucacaaaccaccuagggaaaaacauauacccauuuuucuuuauuugcuauugauuuaacauuuguucaguguugagagacaaucuguuagccaucuaaccuggauauuugugaaauaaagauauccauuacugcacaguuccuauuucaagcacuaaacuaaauguagcucaacaauguaaacauguguaucggacauuuuuggcuuaccuuacaugaaaggauguuaccaaaagcagaaaauguaucauacagugcuuuauuaucaauggauuuguccagauuuuuaaugaauauguugccuacuccacuuuugcgaagugauggaucacgcugagaccacaugaugcguacuggcuugcccuuuauaacaucaaaauucaugguguccaaagcacgcuccgcugcaggaaggacauuuucagagucaauauuacuucaaaauuuuugcuggcuacuuaagauuauauaaacuauggugacuggagugggaggacacauggucucacaguugaacgcuuccucuuuaagcuucaagauggcuagaccuuucaaguaucacacacuagugugggaccuaaguuguauaaagcaaagacaaauaccagaagcccccgaaauuucucacauauaaaagaauuccauauugcuaauaauuaauaaauucuugacgcaaucucucgccuuaauugccauuaaaucuaaagcacuuuuuuuccuaguuaucaaaauccaaauuccuucacauacaaucuguuuaauaagcaguauaaaagacauuacgcaacagauuuaucuacaagcuggaaguaguuuauagauuuaaauauuuuaacuucuucccaacuacuugcuaaaauuggucauuucauugcuaauaacuaacaauauuauaugaaaacuaguccauuuccuaaaaaaugaaaguuucuuaauuauuggggggagggaggguuucagugauucauggcacaacuuccauuuaagaaaaugaaaggcuagaccaagauuugaaucaugcuuucaaaagcuaaugugaaguuagacauauuugguuucauaaucacagaauuuuaaaaacaccaggucugcaauauucagaaaucaccauuaacgcucucuugacacauacaaucaauuucacuuuagaucgcugauuuucuuaacaacugauuuaguuauuucugaauacugcuagaaaauuucaaaaucuacaauuaauuucaggaucuauaaaggauugaauuauguauaccuguaccauuaaaggcucuaaaugaaauaacacauccuuaaauaaaaagacuaguccccgaagagagggaaaacggucccuuuuaagcccugaaacaauuccuacaaauuccaugccaauguaaauuuaaaaguuauugacaggaugaauuuuccggccaccucuuuuuuuauaaaugaaaguuccaguuucuagaauauagugauaaucagcuguuagcucauuaucaauugaccacaccuacucagcuucccuaguuuuuuuuuuuuuuuagcugacuuugcuugagcuauuuuucaaugagucaccucuuccuaugaaauugaaaacuggucacuuucagaagcuauucugccuaucaauguagcaauaaguuuuuaaaaaagaacaagaaauccacuuaaguaauuaauuggauaguaaauuguacauacagaaacuagacaaauggaaaacugccauauucuuuucaguaguuaggguacuggucuacugguacagacugauaauauauacuguacacuguaaccacggcaaccugaaguucaacucuucgaaucccaagaaauguaaaaauuguuuuuuggauuuaaaaacguuaagcugagaaagaguaacacuuucaaguuuucauuuuguggucucuagaauucauucccauguuuucuccaccaacucuuagguugugauaaccugccccaaaguuaucuacccccaucugacaugcauugauacauccugccuaagguugacaagaacuguuaugaagugacauuuggaguuacugcuuacagagcaaaagggcaggaaaccugcagugcaguuuuacaacuucuggcucugugucacucaauauucugcuuccaaaaucaguaucaacuuuacacagugaagagcugaucaguaaccuaaguucuacugaaugaauguuaauaggagcuuaaauuccacccuuaaggccuuuucuaauaaaaaugaauucuucauauuucgauuauuugacauguauucaaguggccagccuguagggggggaaaaaggcaaaauugggccguaaaauggaauuaagcugacuucucaaagccaauugaucuaaagacaaauccuagcaacucaacagaccacagauauuaucuguuuacaaaauuguguuucuguuaacuguuuagcuucaaaauaaaagcacaaaguuagcugcauuucccccauaaauuucaagcucaauuuaaucuccguuauuuuguacucagucauuucccaagauuuacagguaucaugggccacuuuuaaaaauaaaagagaaacuugaacuucuugcaugcuacagauaagacugguccaguuggaauuacacuaaaguaacauuuuauagccaaaguugacuauuuuauaaagaaaagccccucaaaacgacaggaacuauuucagaagguaacauaauauacucgaaaaccaccaguacugugaaucuaagauaaaauuugacuaaaaauggucuaaguugccugagaaaacuggccuucaaaguggucggcugccacauccccuccucccacucugcccuuuuaauguuagagaaaugcuugaucuaggggaaaccccaaaugcaugucuccgguaaauuccauuccuagauccaucagucacugaugaguucugggaaguggacucacaagccugaggaccaccaccacaccacacaucgccacaggaacuuuauccuaaggccugguggcucccccaggcgacugggccaggagcaggagcagaagcaggccucgggccugcgagguuacaggguucaacacgugguauuuuucgagcacagaacugcacuuccuccccaggcuggggcgccggcaggagcuccggguggugggagcgccuccaccucuuacccacggaaggagcucagcguucaacgccccagaaucccggggccacuggcgggagcgccgcggaggaaccgaaucucacccacccucccggcgcgucaucacccuaaaguuugagagcgucugaggccgagaaaauggucgcaaaggaggaaguagccgggcguguggcugccggcagcgcggguccccgccggcucgggaaacgcggcuccagggaccccggcgccuucccgccggccgucgcggggugacaugcccucccgccccccuccccgggcccgccggccuaccccgcccgccgccgccgcccgagccucauggccgcccgcccgcccggccgaccgcggagcccggcgcucaccguccgccggcugcuggaaguucacauacgcguagcccaaggagcggcgggugaucaugucccugcagacccggauggagaggaugggcccggccgggcugaacuucucguagagcaucgccucggucacgucgggguggaggucccccacguagagcgaggccaugggguagcugggggcacugggguucaucucggcacggcugcccgcagggccacaggccgcgaccuuuccgugagaggaggagagcgagugccggggcugggggccggagccggggggaggggagcggggagcaagcgcagagggacaaaaaucaaccggaauugaaaacuacucaacggccgcagaacggggucgauccacugccgcuggcugccggcugccggcggggagcgaggguggcggugucggguccgggcagcgggaaggccucggucucuugguuccuucuuggagcugcugcggggccgcgggcgggcgggucggucucggcugcuucaccggguuauuuuauaaaagaggaagaaaaaaaauaaaagucuccggcgggggagacgcggauuuuuuguaaauuuuuuugggguuuuuuaaaagauuuuuuuagauuuuuuuuggauuuuuuaauaauaaauguguguuccgagcccggagcacacacuccgcacucucagcacuaaccgccggggagaaggggaagcaccgccuccugcacccucuacuuauaccccgcgccgcacucgccccgcccccgcgcgucugacgccagggccccuacgcgagcgucagcgccggaguaggaggagacgcggaggccagggggaggagggaagagaaaacaggaggaaagagcagagaggaagggagagguggcggcgguggaggcugcgguguggggguggggcucgggcgaaggggcggggcuuuugcgcaggcgccgcggccggggaagcggagcccgcgcugcgucgcguccguggggguggggaggacggcucgcgggcgguccucggggguguuggcugaggcguccccgccuuccgccccgcccgccccugccuccaccaggaggagcguuaacccgucaccgcggcggugggcggugcaaagggcuuccggguuccuccgcgcuaaccaccccccacgugcgcggccgccuguggccucuucccgcugcggccggcccggcuccucuagccccagcuccgggggacgccgggcacgggugagcgggcgugguccccuccgggcccgguuuccgaaacgugcguagauggagccagcguggcccccugcucucuccuacccggaccgcacuacgagucccagccggcaccgccgccacgcgcgucggccgcagaagcggugccugcugggagcuggaguccccaacggccgcggcgcucgcugacaccaacuggcugcgcggguccuggccgcccgcuccgggaccccccaaccguccugcgcgcugga

SEQ ID NO: 17753 - RNA, 1733 nt, Homo sapiens
auuauauuaaaauaguaccugcauugucuuaaaauauauuauuucuuuaaaguguguguuuauauuguuuuuuaaaaauacaauuuugaaauuuauuguugaaaauggacacauggaacaaaccaaaccuuguuuuaucauguaauuuucagaaaauaugugauccauaaagauuaaaagaaaguuguauuaagucuggcagcuuuaguauuaacuugaaauaaaauauggcaagcuuuccacguccuccuuuauuuccacaauccauauguacgagcuagauuccagucagaacuuccacaaauacuucacucuuugguagcagcgguuauaaauuacgccuuugcuaauuugcguuguucccaaccaggagaaacauuaccacaaaaaaagucaguuucauccugcaguguucccgcagcaaccauauuaagcuggaagaauaaagcuccuuuguaguaguagcgucuauugaauuacaauguaaauguugaugccugccuggaaacgucaaaugacaacagguuuacagaacgaauucagugguuguuugcagcucuggaaucccaggcugcagaguugagaucgaagaggugcgucuggccaucuuagcguucauucaaccaaaucuccucacuccaucaaaaccacgccacuccccaccugcccagcucguaaaaggaugcucaccuguuugaaaaucuguaauauaucugaugucuuuuacacagcaggacacgaaaaaguguuuguuguggauaagaguguuaaaaauucaauuacgcaacagaccaaacuuugugcuucuuucccccucucagcacaaaguaacuuuagucccguccucuucugccacugucaaacagcccuguuacugugggcauuaaaugccuuguggcguacugcgcauuugauucugguugacuugggauaccugagcucggcucucauuagcucuuccgcucgacccacaaucccuaguguuugcagguguugcauucccccaaccccuuucuucucuucaaccaguagccuccaccuucccaucccugcuuuggagaaggaggaaaacgcagcuugagaucuacucgaagaacugacccucagcucucacaggcugccgccgagcugcaagcaugccgccgcuccacucggguaaacuucggagugaguuaccugcacucggagaagggccuuaccugagcgcgccucugccaauggcagcucaccugagggagcuccccagccaaucaucgcgcagcucgucccucgggcuuguacccuuuagugaaagaauucagcuccuugcgagaaaguuaccuguggccgcccaaguccgccacuuucugcucugugucugcccauugccacgauccaggaggacuccgcgccgcccggccgccuccgagcucgggccccaugugaggggcccccccuuaucccaccuuuccggcuaggugagggcgcgagcgggcgagcgagcgagaguggugaggggggacggaaaagcagaauuaccuguagcucuuguucugccaucucgggcgcucucacacaccuucaccugcacagacuugaaaguccaguuucaccagaggcugaggcuccaggaaaagcggagcaaguucauuggaucaaacaugucacaagagucggacaaguaaguggaucacacgcgccggcugcugcuacuacuaccacuuugggcugauggcaacugguuuguuauguuu

SEQ ID NO: 17754 - RNA, 159388 nt, Homo sapiens
uacuugacauuucuucuguaauuucuuuauuuaaaaaaguaaauguaacaagauacuuaaaaaaggcuagauacaaaaguaguuaagcugcucacgaacauuuaaaauuuuccaaaauguaucuucaauaaucaugaucuuauaaaacauuuuacaguuaucagaaagugcccaggcugaguuuacauaacugaaauaccuuaguacaaaugucuaguuagaacugaagugcaguaaccucuugagacugacugcucauugaaauagggauacaaagaaaaaguugauugugauaaaaguauugugcauuggccccaucauauguacaaaaaaagugcccucacucaaaugagcaaauuacaugcaaaauauuagugauaucauuuaauauccuagagcucaaugcagucaaaccgcaauaaaagugguuuuuauagguaaaagugauuucaucucuuaagaucugaaugucgagaacuuuuuuacaaguuccauauacaugauacacaguugcagccaaccacaaauuaaacaccauaaaaaaaguuaaaaugaaaacacagaacauacuuaauuuuuuauuuugaaauucccuauucccucuauacaagaaccuuugcugaaacaguuuccacaaaggcagcagugaauuuucagaacauuuacauuuuuucccccucagcaaaaagauaaaucacaguguaaauuauguuguucugcugucaucuuuggcugggguuagacccagaaguuggugacuagcaaaccaauauagccaaauguugcuagugcuccuuaggccuuuaagcuauaaacucagcaaggaaugucugcauuuuaucucuuuaagguaccaccagggggguaugacagcauuaacuuccauaaacuuuuauagacaaauggaaaaaaaucuacaaaauuugcuaguaauauuacacagcaauacacacuuuuuauacucuacacaaaaccaaaauucuuggucuuaauggcgaguaacaauuucuguuugagaaucuguuuagaggaauagagugggacguaaagucgagaaaugcaaguauuugcaguaggaagauguuggucaucugguggucuuauugugauugagggcauaggcuggaauccuucuucacuggcuggcagugaugggcuugauguccaaaaguaaaccugaacaggaauuuaacagguuaauauuuaacucuuaacucuggcaguauauacacaaagcccuauuguuauguuaauaaccuaaaaggagauauuauuuugaacuggauuuuaaauauauuuucuuguacuaaaaaggaaagggaucauucauaccucaagacagguuuuuguuuuuguuuuuuuuccccaaaggaguaagucuagaguuaguagaggaaaaaaaggugacuuucugucacagagccucaguauuuucaucuguaacaugaggcuguuggacuaaaugguuucuaagagccuuucuugcagcuaauuccauaaagugucuauuaguggaaaaaaggcugccaaacaaaagauacggucuuagguucaaaacucacacagguuaucuuaaaaaguuauuuugcauuaaggagcaaaauaaugcaaauaauaaaauaauaaagcaaaaaaaguauuuacugcuacauugugauacagaaucauuuuauaauaguaauuauuggggaacaucuaucuaugcaucaaaauucaugcaauaagccauauuaacacuaaguuuuaucauaccucuguaauaaaacuuugugcaacacaguguaaaugaugcucaguaaaugugaacuuacacuuuuuaacuuaaccaaggauaugccucccugaaauaguuugcugaacauguaacauuccucaucaauccaucccuucauacauacgcaucauucuucagugucugucucucuuaaggaaaagcuuuuuuuuuaaucuaaucauuuuauaaugcacaacaaugaaguauauccaauuuccuagaaugacuaggaaaccuaaacaaacuuaagauuuccugaagcacaguuguaugggaaagcucaucuagaauucuauauaaagggacagaaaaaaaaaaaaaaaguuaaguaucaggaucuauaaaaucugaaaagaaauagaaaacagguacucuagagaugaaguugaucuaaaccacucauuucauagauaagaaacaagcuuaauauaaaguguuucuccaaggaugaaugugguuaaccaggguagaugaccucacugcuggaucucuaagaaguuggaagagaaauacuuuuacuagugaauuauaacacuccaagagggaaauaaacuguaguuuacccaauaacucuggaaacccuauaaguugcaggacuaauuaauucaugggagaacuguuucagaaaccccauucuuauguccucuagaugcaucaggaugaaaccaaacaauaugugaaggaugacuucccaaaaagaggagaaggguaagggggaggaagauaccaugauaaacugcuuacacccuaaacauagauuuucaauaagaguuuaagguucacaaacuaaagcuguugacaggaaauuuugaggucuuuauagaaggagauuuucuuuuuucuaagauugagucacuagcaaauuuuucuuucaguagaaggcagaaacucaugagauuuaaguuggcugacuggacugaggaaauacugguuuaaaaacggcagaauugggaggccaagacaggcggaucaugaggucaggaaaucgagaucauccaggcuaacauggugaaacccugucucuacuaaaaauacaaaaaauuagccaggcgugguggcaggcaccuguagucccagccacucgggaggcugaggcaggagaauggcgugaacccgggagguggagcuugcagugagccgagauugugccacugcacuccagccugagcgacagagugagacuccgucucaaaaaaaaaaaaaaccuggcagaaauuaaaacuaggaaauagauuaaaauagaugacuuagaacuuauaccagauagccaauccuuucuguuuuuggugguucuuacagacuugagauggggcuugucuuaaggaaacaaggugcccugaaucuaaagacugacuaaaggugguagaacuuaagcuauuuaggugauccugaaaccaacagggacaguuaugguauugacuagugggaacuuuuaagagccauaagacuggagaagucaaaugcugaccaauuauaucaaacccaccuggggaacaaacuaagucaaaauuacuaggguggcuaaaagcugagaaaugaacuagguggcaguuaggacugcugaacaaacccaucucaccauagcagagaaauauuagaauacaccuagagccauguaaagauucaggagugcuaaaagcaugaauuccccuccuucccuccaccacccccaaaauaagcuucugccugaaugaagguaacugggaaucugcaauuuuuuucuuuccugcacaaauaaccacuuccccuuauucaaauaaaauaaaggauauaucuagaaaucugaucauuuuuaaauauuuccagaaguggucuaguuuagaacuaaggcugguuagaccggggcaauguuccaggaguacagaaaggaucuuccagggucuucuagauaaggaauguccuucaaauuucuacaagaaagucugcagcauacugccuuucaagauuaauggacaggaugauuugguuaugguuuuacuugauggguggacguaaguuccacuaagagguagacuuuccacuaagaucaaagcuucuguuaucuaauuuauaauucuaaguuagcuggggcucuguacuaauaagauuuugaaagacuuaguacccacauaucacaauuaagcuacucucuuccuaguaugcagauaacaaucaagauaauacucagaaauucugucaaggcuuggcacuagucaaaaggauuaaggauguauacagggagaagcauauguaggcagugcgauaaagauaaaaagccauguugcaacaguaaacugguaucuucugggacuaaggacagcauauuaacagcuaaauguacuucacucugcuuagagcuuuaguaauacuucagauauuguuauagagcagaaaaacaaaaacugccuuauuugugaccuucuauaauugcccuacccaaaauuaaaaugaccaaccauuacaaacuuaaaaggccaucauacaugguauuuuuaacuucuguauuuccuucuacaaaucuugugaaauuuuuaacuuacaagaucuugucguucugucaugcucaucuucucuacuauugaccagaaccaacgcuugaacugcagaagcuucucagcauuuucuccuaagaaugaagaauguaaauaaaauauacuauaccaguuguuguuauuaucuguagaauauuacuaaucuucuuauaauaaaaggauacagauuaaaacauuauuuaagacuugggggggagcgucuaauuccuaauacaagaaauuaagagcauuugcauaaugcaaaaccucuacaguucauuagucaauccugacucaauaugaccaaaacaaaugaaccaccagccuuaaaacugauauucacaugaguuuuaucucaucuguaugucaguauucuuaugaucucaagaaaugcagauucucauucauucacuggguggggaaugcagagaggggagaccagagauucugccugucuaaaacgcuuucagaugaugccaaugcuacugaucugaggaucauacuuggaguggcaagaucuuaggcaguuuauuuggauacuguuuuccuuccuaaauuuuugguuuguaaaugagacaaauucuuauuaguauuaaaaacuguauuacaagguagcacaaaaacuauuacaauauauaauuuggcugaagcugcuugcaaaauaggaaaaauaaaggggaaaaaaaucaguaccuuuguguacauaauaaucuuggaauauagguauaauccuuucacagagaacuucuuggagcuucuaauguacagucacagcuaaaaagccuauuccuagaccauaggacuuucaaaagaaagaauugcagcaaaucaaacacuggagauaaaaguuuuucuuucaagaggacuuucacuaccacuccuuauucuuccuagauucuaggaaucuaggaaguguuugugugcuacuguguuuuuagaagugugauuuggguccagcucuauagagcaaucaucauacaaauucuuucauuagggaguuuaagcaacaugaaucagaaaagcccagagaguugucacauggauuacuuuuucuuaaccacuauauacaaauccuuuuuuacacaguugcucaccaugaaaaauuuuuguuuguauucauauuuuuugaaaccuagaaaaauuaagcaguaaaagaguuaagaauagccuaaugcuaagccaucaaaauacuauuuacuucaaacauaccuuuaaaaacaauguaaaaaauuguuuuaaugcuugaguaauacagcaauuucccaaacccuauaaacaggccuuaagaacuagaaacucagaaaaugcugacugaccuaucuauauaguucauucuuuaaacauuuuuuuuaaauguccuaccugauucaucauugaaagagguaaaacugaucagcauuugcacauugacuucaccgcagccauuuaccaaaagccuaaaaucuucugccguuaaaucuucuaaugaauuuuuuggaagcacaucuaguagaccuuuccucauugccuagagaauuucagaaacaauaauacuucauuuuccauguaacauuuauuuauauuauuaaagcacaagacauaauuuuagcagccuucucuaacaaugcuaguucccauuuuaugccagauagcaaaaaaaauucaguccuguauuuuuuauuucuuaggauucaaaagagagaaaggcaggaaguggggagggaaggcauagugaauaagcuauggguucaauagugaaguaguauuauaucccagugauuuaacaauuuuaaaaguuuuguuaauaacaaacaggcuagucauuaagaauagcuucaaucuuuaaaaagugcuacccugucaguaucucaggaaagauaaauugacaacaacaaaccucccagacacaaacucaaaagcuagaugcuuacugagaaauuaugaugugccaggaauugucuuaguaccuuaccuaauucaauuuaaucuuauccucauuuugcagaggagggaaccaaggcacaaaaaacuuaacuugguaacaucauacagcuagagggugguagagccaugauuucaacucuaacaguaugacuccaaagccugcacaauuauuguagcacagggaucagaaacacucaacaccaucagucauaaagcuauauaaacauuuuacaggcugggugugguggcucaugccuguaaucccagcacuuugggaggccaaggugggcagaucaugagaucaagaccccgucucuaccaaaaauacaaaaauuagcugggcaugcuggcgcgcgccuauagucccagcuacucaggaggcugagacaggagaaucacuugaacccaggaggcggagguugcacugagccaagguugugccacugcacuccagccuggugacagagcaagacacugucuuaaaaaaaaaaauauuuuuuuuuacccuggauggggaagacauuaacauaguaggauugauguuacucuuuacaagggccugacuaguagggcuggcauuggcuggugucugagaacuugguuuuugcaauauuccaacauuacuaacugguaaggcuguuuugaaugucuggagcaaugaaccaugcuguaucagacugccuggacuauuugugcaaacaaugcaguucaagaugaacaugugcuuucuucagggauucuggaauuucaguaaucauggcugguugugcagauagaaaaugcccauggaacuagcuuccaauaaaaacacugagcucugacucuaaagugggcuucccuaagcacaaauaauguauacauguugauacauuucacuaguggaagaaguguguucuuugcaauaacucauuccccugcuugagacagaacuuugaaagccugcaccuggauuccucaagacuccgccuaauguuuguuucuuccccugcugaucuugcuguggguccuuuugcuacaauaaacaauaacuauuaaguacaacugcuucugaguccuguugaguucuuuuagcagguuacccaaaguagcuuugguaaauaaaacuaaagcuguuugcaguaccaaaaugauuguuuuaggguccuaccgcuaauacaguaggacaaaggacuaagauauauuauuuuaugcauacauuuuaaaauauaaagacaauucuuuaucugaccagaagcuaagugauggaaacauuuugguauaaaaagccuuuguaccucucagucugucucaauaacucuaccacuaaaacaguaggacccuaaaacagucauuuugguaccauaagcacccuuuccacacuuuuguuugccaaagcuacuuucucacaaugacgugguuuuuccaaguaguuuuaucaaaaagaaaaugaguacuuggucuggauucuuaaacuuagguguaauuuacauuguaaauaaauuccuuuugguuuaaaaaauuuguccuuuuauaaauaagcugaauauacuuagcuaguuuaccacacauuaagacacaaauagccucauuggaucacacaacacuuucuagaaacacuuacauguaagggcuguucugcaacuaccaacauucuguguucugcguauuuccgcacauacucauauacauucuguggagugacugguauauuuacaccauuaggaaugaguucaaccugugaaaaauuuaccagugcuauuuaaaggcaauuuugucaaagcaguaaaacauuacuguuuauaaaacuaguuccuaaaauuuuuaaauauaaacacaauuauuuauuugaccagaaucuaagagauggaaacauuuuaggccaaaaaaaggacaagccgccaggcgcaguggcucacgccuguaaucccaacacuuugggaggccaagguggguggaucaugaggucaggagaucgagaccauccuggccaacauggugaaaccccaucucuacuaaaaauacaaaaauuaggugggcgugguggcgcguaccuguaaucccagcuacuggggaggcugaggcaggagaaucgcuugaaccagggagucaagagguugcagugagcugagauugugccacuacacuccagccuggcgacagagcaagacuccaucucacacacacacacacacaaaaaguacaagcccuucuaccucagucugucucacuaacucuugauccaucuuuaacaccgacaguauccaucucuccuauguguacacacacguucaucucuuucauucccuaacuaaacugucuauacauaagacaagcacagcaguuuaaccaaauucucuugccagaaucagaaaaguguauauuugcuuuaccuguccuccaccuucuucuuuacacaggucaauugcaaaugccaaauccauugcugagaaaacagcaucagcaucugaacucugagacgcgaggauuaguugccgcaaacucucauacauuacaggaucaaaaaaagcaaaaucaugccaauugaccuaaaaaaguaaucauaugaaacucaguuaugaaagaaacagcaucuucauucaauuaauuaguaaauuaaaaucugauaaagaauuuuaucuaauuugaagauacauugauauagaauaauuucccacuggguauauaacuauuuaaagagauaaguuuaauaaaucuuuggcucugacaauauuugcuuuucaaaguauaagaaggguuauauuuugaaaaaauauaaagccaaaagcauaauaguuuuaaaguuccaaaacugcaaaacuuugcacuacuuauuaaacaccaauuauggggagcagccggcucugaacuuaauauacaucuuauuaauucuugauaguaacauaaaauauagauuauuaaauccagaugauaaaucugacacucaaggaaauuuaguaacuugccccaaggucacuuuauuggguuaaacuugggucuauuuaauuagcuguuuccuaaacccugcugaagacucaauauaucaacaauuuuauguugccaagcuuugagucuaguucuuuaaauaagaacauuuuagcuggaacacuuuaagaauuuaauagggucagaguuaaaaagaaaaaaucauaauaugauauucuuguacuaauagaaaauuauucaucaguaggucugauuaaagagaauuauuaggaggcuacagcuuuaacaugcuuauuuaucagaugugugacauguaccuccggaaaaaacuauaacauaaauccucaaagccauuggcuggauguggugacucacacagaggccgagcugggggaaucacuugaggucaggaguuugagaaaagccuggccaauauggugaaacuccaucucuacuaaaaauacaaaaauuagccgggcaugguuguaugcgccugcagucccagcuacuugggaggcugacacaggagaaucacuugaaccugggagauggagguuuacagugagccaagaucacaccacugcauuccagcacgggcaauggagcgggacuccaucucaaaaaaaaaaaaaauuaauuaauuaaagccguugauagguucuuagcuguaacuuugaaaugacaaacagcagguucucaaauaacaucauuucauuauaauguugauaagaaaaaacugguuucauuucaauuagaguugcaguuuccaagaaccuauugacgacaauaagaacuuacucaaucccagcuacucgggaggcuaacucaugagaaucacuuaaaccugggagguggagguugcgguaagccgagaucgugccacugcacuccacccugggugacagagugagacugucucaaaaaaaaaaaagaaaaaaauaaaggcacuuagucuauuccauuuguuuugugucaaguaauuucucuaaaauauuuuuaggaacguggguaguuuucuuuuaaaucaaaagcugcauaauuagcauuguauauuaauuuuaaagcaaacgguuuuucuuuucccccugccaucauaaagggaggugcaggcuaccaaacuaucaaaacacauaaagauaagcuaauuccaucauccagagaucaauacugagcaugcuguguuguacuucuuacauucuuuggccacccccauguaccucuuauagguauuuuugaaguuagaaugcucuauuuuuuuuuuguuuuguuuuaugagauagggucuugcucugucacccaggcuggagugcaguggugcaaucaugccucacugaagccucaaacuccugggcucaagcagauccuccuaucucagucucccaaguauagcugggaccacaggugcaugccaccacacgcaguuaacuuuuaaaauuuuugguagagucagagucucguacguuguccaggcuggucucaaacuccugggaucaagagaugcuucugccuuggccucccaaaguguugggauuacaggugucaggcauaagccaccgugccuggccuggaaggcucuuuucaauaccacuaccuucucuaacaccagguacaacuaauaauaguggauacaauuuaccaaucacuuacuauuugccagguacuuacgauguuguguuucuuaccaauuuauaaauggggaaacauggcagaaaugucagcauauuuguuugcaacaggacguaggucugucagaccccccagccccacuuguguuaucuacucugcuaugccaucuccccauagucuuuuucugucauuaauuuauuaauuuuauuuuuguugaccauaauuguauaauuaaauguuuuaaaguuauuuauaauggcuguaaugcuuuaagauuuaauaguaaaugaauguuauaaacaguaugcuagcguuugauuauuuuauaaaagaaaauuuuugcaauugugaauacaauuagguucaucaaaaucacuuacuuuucuaccaagcaauacuuuaauuacaugucuauucaaugugauaggacauaguucauucuguaacagacauaguccaagaauccuaaaaacaaacacagagaaauaagauuuaaauaauucuagaauacauauauccccccacacauaauacguauuaauauuuugagaaauucucuacagccuccuuucuauucagcauaaaguacagcacauacacuuuuucaaaaaacaaaacaaaacaaaaaaaaacaggaacaccagccugagaauguuuuguuuuugagacagggucucacucugucaacccaggcugaagugcagugccacagucaggucauccuccuacgccagccucccaaguagcugggacuacaggcauugcagcacaaugcccgcuaguauuuuuuuauuuuuaguaaagacaggguuucgccauguugcccaggcaggucuccaacuccugggcucaagugauccucccaguucagucucccaaagugcugagauuacaggugugagccaccgcacccagcguacauacauuuuaaaacaaauauauuuuagaaaaucucauaaauugaaauguuuuaaaaaauucaaacccaagauuaaaguucuuuuaccugccaauguuucugaaacaauucaaccuugcuucuguguucuugccaggccuuggaguauaaaauccucuuuucccagguugguaaaacaaaggggcauugucaucaccaucaucuguaucaucuaaauccauaucuacuacacuucgacuagagccauggcgcuuucgguuuuccugcuaacagagaauaucagagaguaagccccaagauucacugaaaaaacaaaacauaugaaaugguucucucaaaucauucaaaugaagucagguaggaagagcaacauaaauauuuaaauauauguguauaacaauauuaaagguaaaugaacuuuuaauuugcccuuucagaaugugacacacaaagcuuguguauuauuaggucuuuaacgucucuguuguuaaaauaaagucauuuaaugaaacucggauaagcuucuuucacuuuauugccugaaaauucuuuucacuggauacagaauucugucaucacuuugaugaguuuguugacuuuuggcuuucauacuuuauagugagaaauccacucuuucaaaucacuguuucccuauagguaaagaaccauucuuuggcugcuuucaauaacauuucuuuauuuuacagaaguuugauuauaauguaucuggacauaguuuucuuucaguuuauucuguugaguucacugacucuugaaucuggaaaucuaugucuuuuaccaaauuuaggaagugcccagccaugauuuauuucuucaaauauuuuuucuauagcaauuucuucucuuccccugaguauuucagugacauauauguuagaucuuuugaaguugucccacaggucucccugaaacuguccuuuuguuuuaaaauauuuucucuaucuguucuucagaaaggguaauuuccaucuaucuucaagcugacugacacuuuccuccaacaccuucauucagcuauugaugcauccugugaauuuuuuucuuuuagauauugcccuuuuaauucuaaaaauuucccuuuguucucuuuugaaguuccugugugugucugcugagaaccucugucuuuccauucaccaguguucaccauuaucuugcagaacaugggauagucuuugauaauuccaacaagugggucaucucgugguugccaucuauugguucuuuuccugagagagguggauccaguuuuuccugguucuuuguaggcugaguaauuuuagaguguauccugggcauugugaauuaguugugaaaacucugagucuuaguaaauuaauaugaauuuaguaggcaaucaaccuacuuagguucaaauuggaagucucaccuucuaugugcaauuguuucaaugccaacuaaaaaggcuuccuuaugcuauagcaugauaugucacuuguuuuugcaauguuggcaccagcuacuucuuugaagaaugagucccaggaguccuagaacuccugaucucgugaucugcccaccucggucucccaaagggcugggauuacaggcgugagccaccacaccuggugaauuaguccuaggauucuauacaucuuucccucucuguucuucaauuuguuacuuauucaaaguaaagcuuaauucaagcugugcucaaauggaugccaaccaaugggugggauuauacugagcccuaauuaagccaagcuuauuauuugauucuaugcauaauaccgauauauuuaucuuugcuucugucucucuacuguaaacauucauuuuauuuauaaagacaguuucuucagaaauccugcuuucauccccuuuauugaaauuuccuuguaauuuaaauucugugauuaucagcacaugaauaaaauguuccuuaccuguaccuuuucugaggagucuacuaauccaagauccaggauacuaucagcuccauuuucccuaaaaacaaaaagccuuucacauuccagauaacggagacuucuagaauuuagcguauaauuuaaauuuaaaaggacuuacuuacaaaauacauucaaguuuuggagucaauaaauauccaaugcaccugcuaguacuaaugcaguaugagcagagaaguugguaauacaaaucuuuaaaaaaguguaucacuagauccuucauguaugauucaagauaguggacuaaaggcucccugacaaaaugaauguggucuucauaggggugcuggaacacuucuacaaugcucagagggagcacuacagaagaacagaaaaauguucagaaagcaauccaaauucacuagcaaauucucuagcgaauuuaaugauucuagaacaccaauaaauucacuguuuacuccagaaagccaggugaaagcugucaauauuguacauugguugcauucaacagaaaacaugacuaaauacgcaacucuuaacauauacucacaaaaaucuuuucaccaaaaauguacauuguucuugauuuuucuauaauggacuaagcuauaccaguaugcaguagcuccagagacagggcagaggaauaaacgaacaguacauaaaauccagagaagaaaagagcaucagcaaagaaaauacaguucucucaacagucuuuggcuuggaccauuaaaaggcucuagaaguggcuguuuagcucuagugcccagccuaccagcuuauacaucucuaggaguguaucuaaucuaaauuccuaacucauuaggaagaaaaaaauacaacuuuucaucuaaaauaauaaacacuucaaaguuucaaacuggguaucagauuagccccaggauagaaacuacagcauaaaugugaccuaucuucccuuuuuuuuucuuuuuuuuugagacagaggcucgcucugucacauaggcuggagugcaguggcgcaaucucagcucacugcaaccucugucucccggguuuaagcaauucucccugccucagccucucgaguagcugggauuacaggugcucaccaccacacccagcuuauuuauuuauuuacuuauuuauuuuuugagauggagucucgcucugucgcccaggcuggagugcaauggcauggucuuggcucacugcaagcuccacccuccuggguucaagcuauucucuugccucagccucccgagcagcuaggauuacaggcgcccaccaucaugccuggcuaauuuuucuauuuuucguagagacggguuucaucauguuggucaggcugguuucgaauuccugaccucgugauccacccgcuuuggccucccaaagugcugggaucacaggcaugagccaccgugcccagccacuuuuaacuuuuuuuuuaguagagauacgguuucaccauguuggcuaggcuggucuugaacuccugaccucaggcaaucugcccgccucagccucccaaagugcugggauuacaggugagagccaccgcacccggccuuaucuuccuaagucacuuuuacuugucaccuuggaaaaagggauauguaaucuguuagauauuuuuuagauuuuauauuaaauucauacuuuacagaauagaaagcaaaaacuuccaugaauuuuuaagacaaaucaggaagccuaaaagaaaugucaugguuauggcaagaacacaguauaauauguauggccuuugccaggaggguauucugauaagugaauuugagauguacuuucuuucaaguaauuuccaaauaaccuugguaacuauuaaaacccuaccuuucuaauacaugagaagaaacuaagcugucucauucauggaauuuaagcuaucauuuaaaaaauaaauaaaaaugcauuuaaagucuuauacuuuaugacauaaauuuuaagauaugauggcacccacauacugaaaguaaguagcugauguuuaaacugaaaugccuucccaauuguacacauuaccguccaugugcaauaaugaguuccauggccucauccacucuugcucucagagaauccucacuugcuagaaggagaagcagcugagcuggggauaauuccaacaacaugccagugauuuuacuugcaaaugccuguaaaugaugaacaaauguuacuugacuacucucuaaaaccucuugucuaauuacaucuacaaucuuuuauuuaaaaaaaaaauaaaauaagaaacuuggguaacaaauacaaaauuucagaaccaguaaggucuuuuaugaaacuggaagaucaauuauagagaaacuuggcagggaauaaacaguccaugcaguaccacaucuuguuaaggcuacuuauaauauuuguaugacaaguuuucuuuuuagguuuuuuuauaucucugaguuaaacauacauauacucaauuuccauauuuuuuucuucaucagagagccagaaauaucuuuuauuuaggguagaaaaaaagaaggggguaggguagagaaaaauauaccuauguuuaaggcugaggacuugcuggaagaaauaauaguuuucuguuauucuuucacuauaaaauguguacauacaguuaugcauaaagacaaaaaacauaacuaauuuguguuucauaucauauaaagaaaaacucuugauagaacauucaaaauaaaauucuuccugcaauacuaaucagcauuaauguguuccaacuacagcuugcuaacagauaaagucugcuccaaaaguaguaauaauuuguucaaaugaagauacaauaaauauaaugcacagcaaauucuuuagcaugcaaggaagguagaauggagacagugucccaacauaagguggguggaggaaaaaauaaauucaagcuauacaguuacccuucaguaaacacugccuuauucucuccugagcuuccuucuuacugcagagcuaaaaagaguccucaaucaugugguuuugccaguagcugacaauuuuuuuuaaacaccaucuuuaauucaaaagcaaaaaaauaacacagccaguuaagagguaacuaaguacacaguacacacugguugcauugcuuguacacgaggauaaagccucucuccaagugccugccgaugugcuggcaaaggcucaggaucaucgcuaggauucccuucagaggcuggucuaaagggccuagugucgauggaaagcugucuucuaaagucucuguaagagaaggaaaacuauuaugacuucauuuccuuugacuaacaaguaaaaauauuagcacaacuaguaaaaaaguuagaaaaccagagcauauagguuguucaguuaugguaccuaggugguagagugccaaaacagaugaugguuaggaaauaaagauuaucuagauuuuguuacuuaauuuaaaauuuuuauuguaagggaguaggaccuuaacauaccagauaucaagaguccacacauaauucuggaaauuuuagucaaaaguaaaaugcaauccaucuuaacaagagaaaacuucaaagauucuaaauagcacaaucugccaaaauuaaauuuuuuuuugccagacagaauuuugcucguuucccaggcuggaaugcaaugcaauggcauaaucucggcucacugcaaccucugucucccaggcucaaaggauucuccugccucagccucccaaguagcugggauuacaggcaugcgccaccacaccuggcuaauuuuuuguuuuuaggaaagacagaguuucaccauguuggucaggcuggucuugaacuccugaacucagaugauccacccaccucggccucccaaagugcuggaauuacaggcgugagccaccgcauguggccugaaaaaugaagacuuuuuaagauaaacuuaggagagaaugauauggguaaaaaaauucaaauaggaacuugagucagauaaaaagaauauaauuucaaccgccucuggguuuuuaaagcagaacuuuuuauuaguuaauagacuauucuuaguuauuguauuuuauuaacagacuauucuuaguuacuauacauauguucaaaauuaaaacuuuacuuuucuaaaaaauaauccauaauuaagauucuuucauuuacaggccuaucucuaauucauccaaaaaggugguauugaaucaaagauacaaaauuuaccuaucccggucccuccgagaaccugcucgcaaaccacuacuccuccucauuucccuuucucucucccuuucccggucucucucuccucgguuccuuaaucucugcauuaaaccuagaagaaaaucagaaauauacuguauuuagaugaaugcaaauucaacuaccuuaaauuucaaagucaaugcaaagaaaugagacaaauguaagaaaacaugacagcuaaagauuauccuucccuagcaucuguguuguuaaugccuuucucucccuauggguuuucaggguuggaggugauuguguagaauauaccuggcacgaaauagauguucacucaauauuuguuaaucaauuuucucccuugucaugucaaagcugugaaauaauauauagcaaguaagguuaugauagugucacuauaaauaacgcugaaauuucuuacaugacuagacucauuuaaauauccucuguucuuaguuuuuggcaugaaagcauuaaaggccaccagaauauuaccuauuauuauuuuuaaauuccuaagcccaagccagaguaugguuuccuauaaguguacaaaacagauaguuuggaaauguuaagacuucccaguuuccucauucacaucuccuaauuucuucucauuauaacauuauagaaagugaaauggugaaacugaugaaaagcugaggaacucucacccauuuuuucacccucaauccuuucuacagcucagucagucuccauccaccuacaagucugauaaucuucugcuccuacuugaugugaaucuccuaaggcuuuuguaauuuucacaaauuuuaaaauuugauccuuguaaucuuaaaacuuagcuaagaguccuaaccccaaaguguugauccucagugggguaauaagcuugcaccaggauuuuuuguuuuaagucuugcuaaacagugagcuuagugacacaguggauuugcauuugguuguaaaguccuuaucucacuggggaccaggagcaaguuuggaaaucauaaugugaacagcacugcucuuagaauagcauuuucuucucaaauaucccuguggguuaaauauugaaguggaggaaaugcugcaauuugaucggugaauuuuuauaucacuauguauuuuacaaccucuuacccacccacaacauguaacaauugagaugaaaaacuaguacaaucacaaacauuuaucaaaauaaauguguccguagaauagcaaauuguuguccauuagaauaguuuaaacaagauuaaaucaaucuagaauaaaaguauguaaaaaugcaaauuuaugcacucacacauauagaaaccaugauuaccacuguugguuugaggaacaaggaaagaauuuuaagcugcuuguuauuuguagaguacuuacuugugugggugccuuuguuggcauuuuggauacacucuagauuuggcaauuuuucauuugauaaaaaugcuugugcaauggcuguauaaaaacuucgugcuacaccacugcccucuccuggcucauccuuaaaugugacuuuuacucuguguacagccauugguguaguagcacaucuucgaccaaagugauuguuaagcugccucauagucugcugaaugagaagaucucgaucccgaucaaccuauuaaaacacaucaagaagucaaaaaguaguaaauucaauguuggaaaguagcuugaauuuuucuauguacaaucugaaaaucuaguuuuagccuuuccuugagaguuuaaaaaacaacaaaguaauuggaguucucagaagcuuauccauuacaaaauacaauacuuuaaagcauacaagaaugucuugcaaauuaaaucaggacaacagaauuuaauucaauucuaacacuuucuuucaaaggucuauuggaaaacaauaaucuuguucaauuuugggauacaccaaaauaccaaaugaucagagauguuaaaaaaaaaauacuagaaaaaaaacagauuccuugaugacaagcuaagugggcgggaggcuggagggggacuaaccaaacuggaaaaauuguuugcaccuuuugucacaaagauacauauuaauuaaugagugugucuaucaccuacagcuacauaaaaagccucugaaaucugagagaaagccaacuuagaaaaaugggcauaucaacugaguuaaauauaacuauccuaacuauaugaaauaauguuuaacuuugcucaaaauaagauaaauucaaauuaaaacuauacugaggugcuauuucuuaccuauuagauuagcaaaaaucuagaaauuuaacaacugcuggcgagacugagcaaucaggcauucucacauugauggugaaaaugcaaaauuaugcaacugcuuaugcagaaguauuugucaaugucuagcaaaauuauaugcacaugcucuuugacccagcaauuccaugucuaagaaucuaucucagggacacacuagcaaaaaaaaacacgaggccauucaucacacuaucuguaauagcaaaagacuggaaacaagcccaaauaccuagucuguaagggauuagcugcaaaaacugcgauaacaaccauuaaagugcaguacauuaagcagcuauaaaaggaagguagaacaucucauauuuucucugggauauacuacuaagugagaaaagcaagauggaauaaaauguauaguauguuuggggaggugggaggagguauguaauuaauacauacauaugcuuauauguuuuaaaagggagggaaggaaauaaacuugaaaaaaugguaaaagagacaagaauggacuuauauccauucuuuuguagaguucacucugccacacuguagauauuuuacauugauuacaaaauaaaaccaaaagaggaaaaacgaaucccuaaaaucugaaagcaaaaugaaacaaaaggcccuaauuauauagagcugguagcaaaaccuacaaagaagaauuacuucaagugacuuuaaaacaaaccuaauuuaacuguguaucucuaacugcauaugaccuaaggacaaacauccgcaaauaaaucuucaauuauuuugaauaaucauuuuguuagugguaguguugauguuauaauucuuuguaagagacagagucucucacacuauguugcccaggcuguccucgaauuccuggacucaaaccauccuuccaccucagauuccagugauguaauucuaagacugcuacuguguauguuguggcauuaaaacaaaugaguaauuugauuaauguuguugggaaguuggcuauucaguuugaaagaaaggagauaaagacuuaagaucuaagaagcaaggccaggugugguggcucacaccuguaaucccagcacuuugggaggccaaggcagguggauuacuugaggucaggaguuugagaccagccuggccaacauggugaaacccugucucuauuaaaaauacaaaaauuagccaggcaugguggcagacaccuguaaucccagcuacucgggaggcugaagcaguagagucaccugaacccaggaggcggagguugcagugagccaagaucaugccacuaugcucuggccagggcgacaaagcaagacugucuccaaaaaaaaaaaaaaaaagaaagaaaucuaagaagcaaacauaacaaaaacaaccuugugguccuaaauccugaauuugaauugggaguaucaauauuaauucauuauuugauuuuuuaaaaagaacaaaaaaaaugcauucccaaacuguuaucaauuaaaaaggccuagaaaccaugaucaacccaguagcaauaugcaaccuuagagcacagacuguaaucucauaacacaauuuccuacuaaaaggaaucaaagcuacuuuaagaaauggcugauuuaaggucugugacaggaaauacccaagaugaaacauaccagaaaguaagaaaguuuaucaaaaauuauuggggccaugucaaaagaacucaggaaucaaaacugacucaagacucccauuagccaaagaagacacaaucugagcaucaauaugaauaauaaucucaauggaauuaaauacaucaaaaaaaguuuaaaucaaugcaugcauaaugauacuuaaaaacuaaaacaaaaaaauucauagaggaugcuagggaaccaaacugccagagaaaacuacuauucuaaauuuggugguuacaauaagaaaaaaauaaaaagaaaccacacacacacacacacacacacacgaaaaaauaaauuugguaguuaacauuucuuuuuauuuucuuuaaauuuuuaauuauaaguacauaucccuaagcaaagcuauuguuauuuugcauguuuuaaaauuuauauaaauagcauacuacagguauaguauaagaaaaucuaaauaccuuuaccucuagugacaaaucucuugacugcugguuucucaguuuuuccauuucucugcggaauuuugauucuuuuaccucaaaaccacccaauucaguuaggaucuuaaaaaaaaaaaaaugcaugacagauuauucccugaaauacaugcuuaucaggcagaauggaauuuaaggugcacaaaauacauacugauccagguucugcuccaacaucuuccaugaauacccugccgaacaguucuaaagaaaggcgccaacguccuagcagcauaucaugggaaauaaccauucccauaaagcuacacuguggccuguaagaaguuuaagggaaggggugggggggagaaauaauuuagccaauuucaaagacugauugguuuuuguucaaugguaguaacuuacuuuuuuuaaaaaauauucugaggucuuaacuucuucaaacuguguccuaacagagaacuuuuccauagcuacuuguucccgacaacuuauuauuuuuccucccuuauuccuucuguauucuacauacggauaaaucccugggcuaugucuuaucuucgucuuucauuuuaccuccucuccuuaaaguccaaugucuaucuccauuuaggugacucccagauccaccucuaguucaaacuuucaccaugaaccagaaucuccauuuguuaaauaaauauguccacgucaacgaugcucaauucaaacucagcaugguuaaaacuuaauauggcuucuucaccacaaugacaguucuccugauuuuuuuucaguaguaacaucucuuucccuaaugcccugacuuagaccagauuuuaauuuuucuuccuccucuuccuucaaagugaucaaguccaucuuaaguuucucuuccuuuccaugauguccuuucuaaagccaacauucugccucagcaucuuucccccaacuaacugaaacuauuaguaauaacaaacagcuuuuuagcuggccucccuaccucuaauucucuccagucuguuucugcacauucuaaccaucucaauucaauccauauugcuucuaggaagcuugggccacucaaguccacaauucuccccugucuuacaucguuauuagacaacguauauacaguguaucuuauuuucaaacuagcuuuuuaacucccaucuaagcaaaaaaauuauuaugccauguaaccaaaaaacagagucaacaaaucauacugagccacaguauauacuaacaaauauuuguuagauaaacaaagaaccuaccucuuguaagagaauuacaaacuuggaaaaggagcacagauaagugugaaucacaaaucuagaaaguucuacucuuucuaguuauucaguuuccccuuagcugagcugcuaauagcaagucuauaaaugguaacuagacauggauauauauuuuuaacgcuguacugaacaauaaaaacaaagggucuuagcaaauaccugaaagaugugagagguggcccuucacuuucaguaaguccuauuucugcuaguaagcuacuuuuuaauugugcagcaagaucaugagcagauggcccugguuuugaacucucaguuucuucuggcagcacgggcuguucuuccccuucuuuuuuuugccgguuuugcauguucauuacauuuuucagauuggcagcauaagacauuuuuguuggaagaaccuaugaauauuuacauuuaaaaguuacaaaugaagggaaaaaaacuaauuagauuuuguccucaacuuaguaauacaggaaucauacgcaaguuuuuuuucccuuucuggagcuucaaugguccuuuugucugauggcccuggcugaccaccaauuccaacgcauuaccaaaccaaccucagauaacuacuuuuuuuuuuuuuuuagacggagucuugcucuguugcccaggcuggaguguaguggcguggucuuggcucacugcaaccuccaucuccuggguucaagugauucuccugccucagccucccgaguggcugggauuacaggcgcccgccaccacguccagcuaauuuuuuguaauuuuaguagagaugggguuuggcuauguuggccaguauggucuugaacuccugaccucaagugauccacccaccucagccucccaaagcgcugggauuacaggcauaagccagcacaaccagccuuacccaccccccuccuuuaaauucacuucuuggccugagcgcgguggcucacgccuguaauccuagcacucugggaggcugaaguggcuggaucacuugaggucaggacuuggaaaccagccuggccaacaaagcgaaacccugucucuacuaaaacuacaaaauaauuacccaugcgugguggcgggcacuuguaaucccagcuacuugggagacugaggcaggagaaucgcuugaacccaggaggaagagguugcagugagccgagauugugccacugcacuccagccugggugacagagcgagacucugucucaaaaaauaaaauuaaauaaauaaauaaauaaauucacuucuugccuuggaacuucagagaacuuuuaaagaaaucuuuauaauacuggugguacuuaagucucauauauuuuuaauauuuucaguacugcauucuccuuuuuaucacugagauaauaaaaaauauucuauucaacuacaugucuucuaaaccugcuuuuuaauguuuuacuacuuuuucaguggacaaacagaagaguauaauuuuaggcucccaaaucggaucuauauaugaaaacuagaucuaccacuuaacuaguugugugacacagacauucccacgugaaauuuacuuacucucuucaagacucuauuucucacccaaaaaaucagggugauaaugcauucuaccaaacauaguuauaaagauggagaccaaugcccaggaaacagaauuagucaacaaauauuagguaucauuauuaaugcuauuuaucuacagucuugauuaaaauuaguucagcaaguaaaaguuguagccaaaauuacacaugcucaucuauauauuuuuauuauacaugaaaaauucaaauuuucagccacauacagcagucagcucugugaaacagacaaagcacauauggaggcugguauuuuauggaugaagugaucugacagcaaguuaaugacaguguuggaauucuuccuacauuauaccacaaggcaggaauuucugacacuucauuucagaaaauauaauauucugaauuaacgcauuucuaaaaaucuauaugcugggacaaguuguccuuaauaaauguuauauugcaaaaaaacuuuuacugucuuaccucuaggcaguuucuauccacuguaaccuccauuaaacauuucccacuacuggcagaugaagaauaaagacccugacuuggacggccaaaaagauccuccuuucuagcauuuggcuggaauuuuaacagaaauauucuaguuacauugaauacuuuaaagaaaauaaacccaauuagaaagaaaccuuaagacuaacuuguuuaauucaccugcaacagauguggcugaucagccaaggggauggcuucagccagaggcacuucaaauggauuuggggguauacacccaaggaaugucauggagucugaacgucggaaaaauggaugguuuuggccaguuucugcaggaagagagucaucauccuuaucauucaaaguagcaccuaaacauaaaaagauaaaauguuuuguuuuuuaggaaaauuauuuaauuacuggauuaggguaacagaccuuuaaccugcucaauccaaaauuccuacuaccucuuuuauaaaauuuuaaugccacacaaaaacaaguucauaguccaaaauucugguauuuuuuaaaguaaauguaacaguuuaauaugguuacaauguaaguuuuauguuaugugcaaauuuuacguuauguguauguuacaauaaaaaaugcaaaauaaaaaucagcauuuaauaauauugugccauuuuguauuggacaaagguuucccauauccuccucuuuaucuuuugagauacccaccacccaaauacaguuagauucaugaguauacucaggacccaacucacugacaaauccaaacagaggagaugaucaggaacugaaaccugagcauuugcuaagcagaguaaugucugagcaauuuacauaucucaauaguaagucagcacacuagcaccaaaucuccuuaauggaauaaaacuuuggcaguaccuuguuugcguauaaacggcagugagcuauggcuggguucucaaaaaacagcaauuaggccaacugucuuuccauaggcugaauaaaaguacuaguugauaauaagaaacuggagaaugcauuauuuagucccauuugaaauaacugcaacccacaaauaaacuccacuagaccccaaagugugauauuaaaacuuuuggagaaaagucuggaguugggauauuuucucuuuucauuguauuaauugcuagcguucugauauuugggagcuguaacugguaauucucauuuucuugauuaaaucuauuuugcaucaauauuaacaacgguuuugcuaagauuuuauuaaauguaauaagaguauauuaagaguaaagguaaacauaauacuaagacaaauacaagaaaagauagaagaaaaaauauuguuggaaaguuuauaacauuucuuuaauacauccuuaguugugaaauguauaacgcaagaauguguaagcaaaaauggacagaaaauguaagaaaugagacauagagaagaaaagagaaauucccacccagacagaaaauaaugaaguuaaaaagcuugaaggggaacuacugaggcagccauuucuugaaguagauuagcagauuuucugugcacuaacuuugauuggugucaucaucauuuucauguucugaaucuucauuaucaauacccaguuccaagaguucucgcguccuuuaaaaagacaagugagucauuuuacuugaaguauuuguauaauaugaacaggagcaaaagucagaggaaauacaagcaaaaacacacuaaaaaggucgcuaauguaucuaaccaauuucaaacauuuucagaaucugggaaaugguagagugaacagguuuagguacuauuauuacaaaauggacucaacagaagaaaaagcaaaucaccuaagaaauaacgagcaccuacacaaacucuaacagaaaacaugggcugagcaugguaacucaugccuguaaucccaacacuuugggagacuaaggcagggggaucacuuaggccaggaguugaaggccagccuggggaacaucaugagacacugucucuccaaaacauuaagaaauuagccaggcaugguagcacacgccuguaaguccuauauacuuagaaggcuaaggcaggaagauuacuugagcccgugaauucaagguugcagugagcuuugaucgcaccaucacauuccagccugggugacagagucagacucugucucuuuaaaaaaaaaaaaaaaaaaggaaaaaauaaagaugauaaucaggccaggccaaacuaucucaagcaugaaguuuaaccagauucuuagguuuccuauuuuaagugaagaguggcaauggggaaagguuggauaaauucaagcccacuuuccuauaugaaaugguccugugcuaguucucuuuugcaaugcuauucuccuuacuccaaauguugacaauguacuaaagaagaccauaccaagcaaguauuucuuaaaucaaccucauggcaagaauggauaccuuuugcguucuaguugagguguauccaauguugucugcugauucauugccuuaauccaguauauaagugcuugaaaaacauaugccacaugcuucaaugagcaaacauccaaaacuggaagaacaucagaaugcucaucauuaugagaccgcauuagagacagagcauaauuuaggaagucuccucgugcagacaucauuccuugacgggcgcuaagcaagguggcacgucuauaagaacagaaaggaaaauguuuauuagaagaauacaaaugugaaauucacuaucauaaauaugcaaaauuaggagcugagaauauucauaaauacaaaguaguuaagccugcugcucagcuuuagaaauauaaccacugugcaugauuuacagccuuauacuuuguauagaaaaggaauuccaguauccuuuggaauggcaaaaugaauucuuucccugaagacagugauucucaaacuucaggguccaucaaagucaccuggagggcuuauuaaaacagaccucuggucuaauccccagaguuuuaguaggucugggguaaagccccaggauuugcauuucuaaauagcucuuaggugagguugaugguguuguucuagggaccauacuuugagaaucacuucauuaaaaugacaccaaaagcacaagcaacuaaagaaaacacagauauccugggcaacauggugaaacccugucucuacuaaaaauacaaaaauuagcugggcaugguggcgggugccuguaaugccagcuagcugggaggcugaggcaggagaacugcuugaaacugggagguggaggcuggaaugagccgagaucacgccacugcacuccggccugggcaacagagcgagacccugucucaaaaaacaaacaaacaaacaaacaaacacccagauauacauuggaauuuacgaaaauuaaaauuguacuuucaaggauaccaccaagaaagugaaaagauaucccagagaaugggacaaaaucuucccaaauuauauacuugauaaugggcuuacaugcagaauaaagaacucauacaccucaauuuuaaaagacaaaccaauuuaaaaaaugggcaaggucaggcgcaguggcucacaccuguaaucccaguacuuugggaggccaagguggguggaucaccugaggucaggguucaagaccagccuggccaacauggcgaaaccccgucucuacuaaaaauacaaaaaaauuagcauuguggcgggugccucuaaucccagcuacucaggaggcugaggcaggagaaucacuugagcccgggaggcagagguugcagugacccaagaucacaccacugcacuccauccuggacaacaagagugaaacucuauuuaaaaaaaaaaaaaaaaagauggagggggugguggcgacgggaggauccaaauaagacauuucuccuaagaagauauacgaguggccaguuagcccaugaaaagaugaucaacaucacugaccauuagggaaaugcaaaucaaagauacuaggucacacccacugggaugguuauaacaaaagacagauaauaagugcuggugaagauguagaaaaacuaaaacucucauacacacacugcuacugagacugucuuccuuuuuggaaaacaguauugccaguucuucaaagaguuacaaauagaguuaccauaugacccagcaauuccauaacuagguauauauucaagagaacugaaaacacacaucuacacaaaaaucuauacacaaaaguucauaugagcauuaugcauaauaguggaaaggugaaaacaacccaaauguccaacugaugaauggauaaacaaaauauaguacgcucauacaaugaaauguuacuaggaaaugaaaaagaaugaaguacugauguaugcuaaauauagaugaaccugaaaaucauuaugcuaaauuaaagaacccagucacaaaagaccacauacuguaugauuccauuuacaggaaauauccagaaucuauugagagggaaaacagauuaacaguugcuuaggaaggggaaggcgggggggggggggggugaguaggggaaaaugaagaaugacugcuaauagguuuucuguagagaggauuaaaauauuccaaaauucauuaugaugaagggcugaaaaacuauggaauuggacacuuuaaaugggugaauuauaugugauaugugaauuauuauauuaaagcugacagagagaagggagagagaacacugccaccaaucaagauccgcuaucagaauucuguguucucugggguaacaacuacagccuaacaaagauaaggcuuucgucuuugugaagcagcguuccuaggacaggaaagcugcuaccucucaaaucacuaucuucaguacagcuaucuuugccaagcauucaauucugcacauuugacauuucuaccauuuuuuuucccccaguucucacauguucaaaagcaaguuuguccauuauacuacucuuagguuuuucucuuuaauuuuccuauuaguuacucaggaucaagguuuaaauauaaaugaugccccugcuacuuaaucccucaacaaggcccuaaauucuguuuuuuauuucaaugcuucucuccccuccuuuuggucuucacugcccuacuuuaguaacuauuaccucuacuguagaugccuaucacugucuuucuaaguaaucucuuagaccuuugucuuuccucacuuuaugaucugcccagaguaacaaaguuguuuauccugagguagagacagaaccaaauccuuggauuuugacuucagguaugaggcacuuuuacuauauuacugcuauugcucugauguucaauauuugagcugauaccuacuccugaaaaaggucacuuuauaacugaauagaaagaacauaacaaauacauagauauauauuuuauuuuaauucaacagacuaggggaggcagaaaaaaagaaaugugauuugagaaaaaaagagcagcacugguaaucacacauacuuucccccuccugaguacaaaguacauucauaaccaauuauagucaaaauaacuuccuaagaggagagggggaggucuuggggauaaugagacaaagauauagaccaauaacuucaaaaauaaaaaggcuuuaguaucagauuccuacgauaugaauggauuuuuaaaaacagcuuggaugauaacuagccuauucugccucaacaauuuaaguaaugcaagcaagucauuucuuucucccuucacaguaagaugaggucuuacauaauagcaacuaaaaagcuuuaaccuucuaggauacaaagauucuaucuaaacaugcaaguauagauacuccuugacugaagaugugguuauguccugauaaacucaucauaaacgcauaaagucuaaacgcauuuaauacccccaauaaacccaucacaaagucaaaaaaaaaauguaaguugggggucgggcgcuguggcucacgccuguaaucccagcacuuugggaggccagggugggcagaucacaaggucaggagaucaagaccaccauggcuaacacagugaaaccccgucucuacuaagaaaacaaaaaauuagccgggcguggguggcaagugccuguagucccagcuacucgggaggcuggggcaggagaauggcaugaacccaggaggcggagcuugcagugagccgagacggcaccacugcacuccagccuggguaagagugugagacuccgucucaaaaaaacaaacaaacaaacaaacaaaaaauuguaaguugaggauccauuuuaaguuggggacguucuguauauaugaagaauuucauaccgucugccuucaaguguucguaagcuagcuucuucucgcgcagucauccucucucuucucgcugaauucugagaagcgugaagaggaugauuuggauguccaggaucaccagcagaugcuaaugcagaaccauaacguaauugagcuucaguagaauccauaauacugaccauccaguuccaagugggaauaagcuuuucuucuacauaguucuaugaagaccaaacuaaaauaguuaaaacuauccaaauagagcuaaauucgauacagcagcaguaugucaauauguaaacguuucuaacauuuaauuccccuaauacuggaauucucauaauugacagccaaaaaaaaauaguggaaugggaaacuuuucagugguuucauaccuguaaguuuacugcaucuugguaagucaauuucacagcugcuggaaucugagaguauacuaggugauuauacuuaggaauaaggcccaucaaguccgagauuugucuaaugacaaugcuguaagcccuggcuaaacugcuugcagauguuagguaacugcuggcguugcuagcuuccaaagcagcugcugcagcugcagcacuuguacugaugguaccacuccggcguaaguuugaaggaucaauauaaaucaaacccgcugaacuugcuauaaggaaaaaggacaaccacaaugagcuaaugucaguugcuaauuguguuucucugggauuauauauacuuacguaaaucuaaauggucaauugugguacccaagcaaaaaacuuugccuaaaccacacuauuuuggggagaggaguauggaggggacaagaauuaauauaaaguucucaaccaggggaaaucugacccccacgccaccuccccccgccaaaggggcuacacauuuggcaguaucuacagacauucuugguuaucacaacugugggagccaaggggaggggaagaagggugagagggguuucacuggcaucuaguggguguaggcuagggaugcugccuaacaucccacaaugcacaagacagccucccacaauuacccaguccaaagaugcaauaaugcaaagacugggaaacccugcuauaaucauauguacauauuuuuuauauuugaaacucaacaaaacaaugaggaacuaucauaaaacuaauuuuauccccagaugaacaugcauaauuuaaaaaaucuaucuaaguauucuuagcaauacuaaguuuucagacuugccugcugguguagauguacuggaaggggcuguacuggcugcucgcugaugcuggguguugcggacagcccacugcauugaacggggagcuugggcagcaccauuggcaugggagcuauuugugguucuuucuaauggcucaucaagcauaaaggucuccuguucuaugucgucacucugacuacuacugcuaucagaaucacuugagucauucgauugagaaucaucuucagaaaagaaggcaggaacacugcuugcuccuaaaauuuuuauuuuuaaaaccaaaaacauugugaguuuaauaauuaaaauuacaauguacccccucauucaggaaaacauacauauuaaacagaaugccagauuguauucaauaauccacaaaaccuaccauaaaauaguuuuuauuagaaaauaacuuucaagcccagcucuguggcucaggcaggacugcaguggcaccaugucggcucacugcagccucugccuccuggguucaagcuauuuguaugccucagccuccugaauaaguaacuuuuagcugggugugguggcacaugccuauaaucccaacaacugaggaggcugaggugggaggacugcuugagcucaggagcucaagaccagccugggcaacacaguaagaucccaacucuuuaaaaaaaaaaauuagcccgaugugguggcuugcaccuaguagacccagcuacucagggggcugagguaggagcucaggaggucaaggcugcaaagagcucugacugcaccacuggaauauccagccuggugacagaaugagacccaauuuaaaaaaaaaaaaaaaaaaaaaaaaggcaagaaaauaaaaaucuuuuaaagaaacuuuaaaauucauucauuauuuaaugaccagaaaagcuggagaaagaguuauuaaaauaauacuuucuuuucuaauacccagagaacaaggaugaaguuauaaaaaugcuuagcuacccuugcguauaucacacaaaguaugacccaauccacgcugaauacacacacacagccuuagcauaagcaagaaaguaguugggauaaggcaacauaccugcuucugaaccagcaguugcugcagugacaacgcuucugcgcccacuagcauuaucuugguugcugugguuacuuucacuaucacuuucuguuucagcugcugcuaacaaguccagcuccauaucacucccuaaaaaauacauuuaaauaagaaaaaagcacaaacucacuaugguuuaaaacagggucugauaagccagaauaucguaagggugggaacuaagaaggcauaggggguaggaguuggggagaaggggaauggugugaaagagaagggauaacuacuaaaauaagacuaaguaacuacucaaccuuagaagaauggcuagggaaauuaugguagucaacagacuaguacaucagggcagugcaggggaggacugaaaguaaauauacaagcuauuagcaucuggguguaauuaugggugauuuauuuuccuuuucucuaauuuccaaauguuucauaaugcgacuaugauuauuuuaguuuuuaaaagucuuuuaagaaacugacuuaaaaagaaaaaagggaaacuauuuuauauauguauuauauauagcgccuaaauuuucuaaauagaugcuacagaaacccuuggcaaaaaauaaguuugaccauuucacuauacauucaaaugagguuucucucuguauuuaauaucucccuuuaaaaguaccugauuuacucauacugaguaauuucucaaauaaccugcauaccgucuucaucaugcucaucauguugucccucugccucagcauuuucuuccccguguucuuccuguucaucaugaugauccucuucuccagccacacccuccaccaccucaaccuaaauccagaaucuuauuuguagacaaucaaagcuaguuaacuaaaaugcgaagaccacuaacuauagagaauuugaaaucauauaucaagcaguuuugaaaaucuucauuuguuagugacaauuugcuaucaaaaauuauauccuggccgggcacgguggcucacaccuguaauuccaacacucugggaggccgagacggagaugggcggaucacaaggucaagagaucaagaccauccuggccaacauggugagaccccgacucuacuaaaaauacaaaaauuagcugggcauggugcgugccuguagucucagcuacucaggaggcggaggcaggagaauugcuugaacccgggagguggggguuguagugaggcaagauugcaccacugcauuccagccuggcaacagagcaagacuccaucucaaaaaaauaaaaaaauuauacccacagaucccaaaguucauuacugagcauauacagaacccucaaguuagaaguauaaaaauuauacuaggggcagggaggagagaauuuaccucauaaauauguaguauccucuuucaaauacauuguacaaaacuacuaaauuuuucuaacauuacgaauaucuuggcugggcgcgguggcucacaccuguaaucccagcacuuagggagguugaggcagguggaucacgaggucaggaguucgagaccagccugaccaacauagugaaaccccgucucuacuaaaaaauacaaaaauuagaugggugugguggugcgcgccuguaaucccagcuacucaggaggcuguggcaggagaaucgcuugaacccgggaggcagagguugcagugagccgagaucacgccacugcacuccagcuugggugacagagcgagacucugucuccaaaaaaaaaaaaaaaaacccagaauaucuuugcuguuaacacugagaauaucuccacccuuaauccuuaaagacaaguuuguguccaauuuccuaauauccaguaagucacaaauuauuaaaauaauuuuacuauguauaaccacaaaugagaauauauaauaaacaucuacaaacuggaugcaaacgcauauaguagucucaagcuacuauuaauguaauuucuacugacuacucuucuuuucucauaaaauaaaagcuuuuuaaaucuaccacaauuaaaaucaccucuuccacaucugcugaaacaauaucauccuguucuucaucucugccccgaacgggcugugacuggcugaugcgccucugcuguggauuccugaugauguaggaugacugagacugacuggagcuguaaagaaucagaagcuuaugagugggcuccugccacagcucagauaugcaacacauauuuuuauuuaacucauuuauuacaugugagacacuugcuaggaugugacuuuaaaucugagcugagaauucuuagaaaccaacaauacuuaaucuauauaucagaaaauauaaaucucagaauauguuuuuucuuuuuaagucauuucaaaucuguguugaugcacauuauuuguaugaguccaucccaucgaaaaauucuacaggaagauuuuuccuccuccaccagcaguucuauuucuaaaaacucugguagcaccaucuguccauuaacagcaaguguuuaauagaagugaucuaacuuuuaagagaucugacaugauuucuauuuugaaugagcuuauuaacuaaugacuugcugauguguguggggaaaacaucaguucaaaagcaugauuuuaaaguagucauaaccaaaggcaaaguggcaaaaguuucacuucccuaaacaccugauuuggagacaaccaagaaaagacaguugacuggauuauaaaacaaaaagggggaaccagaaaauacagcuuaaaauacaggccagaaaucugaaacugguggcuaaauaacccugucaccuauuauuuauagauuaugaaacgggguaaaagauguugaagucaaaagaccuuuaagugauugcacugacagguucuuuccuaucucaguugcuaugagaaaugagaaucaaaccaauuagaccugagaguugacugaaacaccaugccuucaaacaaacagauaaguagucucaauaugauguuuaacacuagaacuauaaguaacugguaaaacagagaucguggauuacaaaagugggaaaggcuaagagaaaaucuguagagaugaaaaaggguauuuccaaccacuaaagagauuucaauauuaaaacauaaaagcacugugugaagccacaacuaaugaguauuucuuuuuuaaaacaaacauccuagaacaaacauccacaagaacuauaggccccucaaagugguuacuuuaagaaguuaugcaguuaguauguauaauacugccaaaacagacuagguauaguggcuaaugccuguaaucccaauguuuugggaggcugaggugggaggauugcuugaggacaggaauuuaagaccgaccugggcaacacagcgagacccaaacgcuacaaaaaauuuaaaaagaguaauuuaaaaauaccaauacauaaaacguauuacaguugaacaucccuuaccugaaaugcuugggaccagaaguguuuugaucuuggguuuuuuuuuuuuuuuuuaaauuuuggaguaucugcauuauauauauuuaucaguugagcauccucaaucccaaaauccaaaaugcuccaaugagcauuuccucugagcaucauguuggugcucagaaaguuuccgguuuugcagcauuucagauuucucauuuucagauuaggaauacucaaccuguguaacuccccaguuagugugacuucaacuuuuuucccaacagacuugcuggcacaaugaagcacaacaguccugaagccuagucuaaaaagccccguuaauacacuacuaaguuuuggggacuucuaguuccagcaauuuggcagacugugcagagaaaccacucuuguuaaggaacacauauauaugcuagauauuaaaaaaaaaaaaaaaaaaaaggacagcugugcaggugauaaagagaaacgacuguacuguauaaagcuuggagagacaagugccaccauuuaucccaaagggacccacugaugucucuugggcuagaagggcuucaaggaaccacagauuucacaugagagucuggaggcuaagcaaagaauagaaagucaucacaggaaucuccucuucugucccccucacauauauaaagcuaaacauaaaucuuaaaagggcaacaccaugaaggagugaaacagaaaaaucauaccucgagagauuuaccuaucucagccaugaauagaugcagaauggaaaaaggucucuuuugagaacuucuaacuacaagucugcauuuuggagaguuuuggacugcacucuacacuauaaagccugguucaguguugguuaacugugugguggcucaacacuaugagcaagcaccaaguagucuuccucucuacucugccaucuacuauucaggagaauacaaaaaaaaaaggaaguaucugucaagguaaguccagcgucuaaacuuuaauuagcuguguuacacuggagaaguugccuaacuuuucugagccguaguuuccccauuugacaaacuagaaugauagugguuaucuaugacauauugggaaaauuaaaacagguaaucugucuacaauacuuaggaaaguuccuaguacauacuaaaauuucaguaacuguuaguuacuguuauaugagagacauggaaauaaaguagaaacagauuauuuauuaagaacauaacaagaacauuuucaagagguggaaagaagcaacagaaaaagcuacucuuaagacuucacacucaauggggugauauacaccuucuauaauccaagacaagugaaaucccagagaauggucaaggucuguguuuuucaacuuaagacauccuuggaacacuagucaaaauacacccuuuauggguaagaauguacuguacuauaauaaagaacuuuuaacaguugaagaaaacauuagcacuauuucuugauuaucacaugagaucuccuucugggaagauuuaggaaguugucucaagaaacaagcaaagggaauggaauaaagagaguuuaagaguauguaauacuuuaauaaugagacuaagaacaagaugacacaaaaucuugaaacuuaguaggaacaguuucaagggcaguguuuagagaugagacgaucccaaaaucuguucaacagccaucaauuuuuuauguuccagaacaagaucaagggaaguauacuaagaauucacaaaguaauaccacuuaaguaacuaaugaguuccucacaggguaucaagaucaggaaaaucauacagaguccaagcagaucucacaagcagaauuauuuaaucaugggauagauuugacaagucugaagauacacagcuugauuuguaacaguuuucaacaaguccuggauguauaucaguaucaaggauacuaugggagagcucugucagacaaaacuggauuuagauuaaagggacaccugacauuaaaggaaaaauugggacacauauacuggcauauaggagaauagugagagcagauacucaacaccaacccagaucaaauccaagcguaacaacuugggaacuaucccaaacacuaaagcaggccauccuuauuaacagagauguuuuccagaaaaggaggaaaagggucuuuagauccuaaagguccuuauuaaaacaucaucacacaugcacaugguuauaaaaucagacuugaaaaaacaaaauacacuaaauauuugccaaagaucuacagcauuauuacugaaaagucugaccccuaaaccagcagaauuggcaucaccugagaacuugaaaggcauacgaaguuggaggccccaccucaagaccucuagagugggcaucuauauuuuaauaagagccccaagucauuuucauacauauuaaaguuugagaagcagugugcuaaaggacaucggaaaguuuuaaguugcucaacauccugauucaacaagcuuacaguguaauuagggaaacuaucaaacaaauagaaaagauaaaugaaacuuaagaacaaauaaucuuauaauuagaaacauuuauaauggaguuauuuuagcccuguccuugauaauacaguuguuguagaaaaauauuuaaaauuccggcuuucugguuguuauuuauguuacacaaaugaucauguacaccaccugagugcuuaugcaaagguuuuaggaagucaaacacgacauuuccagagaaggauuaaucagaaucuguuaccugguagcaauuuaccugcuagacugaucagaugauggucguggugguagugguuccacugaaaauaauucuucacugcccugcauggcaucuaugcuaguacuagccaggguaaauggugcaguuggacgagcaauccccauucugacaggaacaaucagugacucugcuacguugcacaauucuuccacagcguaagguagcaaugcuuggaauacacgcuugcauuuuccaauuggcuguggaauaaaguugcuagaacaaaaagagaaauaucagcaaucuaucuuuucauauacauaaaucacuaucacaaaaacagagugaaaaugguaucuaaaccaaaaucaaaaaggaugccuuacuuuuucuuuuuggaugaagccauuuccacacucagaauaacaaaaacucuugccacugaacguagaaaccucauugucacagcaauagcuucuucucuacguccagguguauauuuguuuuggaguucuuucacuaguguaccuaguagaguaucuaaaagcuuuaaaaaauuauauucacucuauuaauguuaagauacuucauaagauguuuagacauucauaaaguuauaaguucuaacauuuuuuaaguauuaacauuuuauaauaaaaucucaaaacaaauuuaaccaaaacauuuacaaggucaguuuaugaaauauaccugccaaugugcuugacauacagugaguccuaaauguacgauuucuuauuuuuugucccacaguccuugguauaucaacuaauauuuagaagaacaauaccaaauauaugaaaucagaagaagaaaacauaaacucagucuggggcacuuuccaaaacagcaaagcagacucaaauauuuauaugaauaaauucauaaucccaucucccucauggaaccauuauuacuuucuagucucuuuucugugugcagcuucuuguauaaauguuagcuacagagaacacccaauuuucacaguuugguuguuugguuuuuuuuuuuacguuauuuacaauacgauuuauuuuuaaauugcugcaucauauuccaguaaguggucaggcuauaauuugauucaagauuacacuaguauuaggcugauauuuuucuguuuuuaaauuuuacauuauucugugacaugccuuuauuuuucucacaucguaaauuauuuauuuaugacagguucugagggcacugauaguuuuauguuuuccagagaaaggaacgaugcaaugccaccccaucccuaucugaguguguuauuaccauaaccucauucgcacuggaucuuaagguuuaaauucuuuucuaguuucacagcaaagaagaguacuugaaaaacauacuuuucauguacuuguaauacacauucaaagaacuuaccaaaauaucugcuguacacuuaacuauaaggcaaugagugaaacaguccagccgaauugugccacuuugcugauugagguauacuugcucuucuggcaaaagauggccuauucuacugcuggcacuaagacuugaggagaaacgaaagacagaaugaacuguaaaaggucuacacuaacguaggaaauacauaaaucuaaaaagguuuuaaugaauacguacgggucuuuauucuccugcgacccaaacauaaucauagauuucaaggcauuccaguccuguagaacacgcuccaaugcaagcugggcaaaucuuggaggcucuaaaucaugaucuggcauaucugaaucuaaaaugaaaaagaaauagugaccaaaacaaaaauaaaacauauugcuucccacaagugucauaaaugucuaauuaacucaccuucaggacuggcuguuuuucgguuacgaucuucccugauucgagguggccuguauugacaaugcuccaccgucugccuugcgacugucuguacuaagaauaguaagaggugcucuccccugcaaaacagaauguugucgugaggagggaggcugaaaagcuacucagcugugcugcgcucuuuugauuuaacuuacuguauguucuaaaaaucccacuugccugcuguuuggcagaguaaccagauuaguagcagugagcaggcgauaaaguagaucaagacgagcagauuucuguccagcaauaagaguuuuacauuuacauuucucccaacaaucacaguaggcuguuggugauguccguuugagucuauagagaauuuauacacaaguacaaaaacugaaauuuuuuaaacauacaaagguuuauguugacauuaugaagguauaacucacugaaaccagagagagcccuuguuaauuucuaaaugcaaaguauaacugucaaagcuuauauaacaagaaggauuacuugguaguaaugacaucuauaaagcaacacagaauuccuaugagaagagguacucuaagguacaaucacuuuuggaaucucuucccuaauucccaguccuguucaagugguccuccuauaugaccuaaugaacccuguaacccuaugggcagauauuucuugcuucugauagggaugugaacacugucaggacuauucaccaccacccuggcaucuaguacacuuggaaaacaaucaauaacaacagauuaucacaccuuuagguacuuaaaauaaggaaaacaaaaaauaccaaccagaauucuuuuaauaucuauuaaaauuuuucauuuguccuauacaauuacuuaaugguacgguagaugguuuuuacaguccaauucucuauuauaacauuuguagccauuuauacugaagucccuauccauaauccuaaaacaccacagauguuagugcuagguauuucauugcuucucaggucucugaaaaccaacagaacuagcugugguaacuguugcugaaugaaagacuguugcauuuaguuuaagacacagucuaaacauucaccaugauucccucuaggccuauggcaauuuucuccuaguauaccccacuacaggggaccugagaccuccgcugcauaauacacucaggaacauucuguagauauacuucucaaaagacuaaucugauccuaguuacaauguauaaucaccuacuuuuauuuaaggagggcaauguuugaacuagcaaagaaaccaaacauuucacaguauacuuuaaaucaagaaucacacuauuauacauaaacugacuuaaacaagggaaacguaaguaaccucaugcuuucugaaguaaaacaugacuuaguacagauuauuuccauacagcaauauaaaucuaaacagcuuauaauauuaaacuaaagaaaacuagaauuguacucacuugcaaucaugaccuuuaugacaaacccuugcacauuccguacaacaacacagugacuccagcaagccacaaguucgacacucaaaaauauccuaaaauuaagaguguacuuuuaaaggaauaauuauaaguaugcauauaucucaucauaauaauuauuucugguauuuucuagaacaauucaaucucaacaaacaaaauuaaugugcuuuggaaaacuagaacuuauaaagggcuacagcaaauauacaguuuaugauauacaaauagaaauauuaccaguagaaaaaaauaauuuguaucauccccaaaaaggcauuguaguuauaaaaucuguaucaagauuuguggaucagauuauacuacccagugaaaauuuccaauuuucaugguaugccauauuuaacugagcaaucagcucuuuugccucauuuacuuaggaauuaaaucaacuuucuucauaucagacuuaauuccaaagcugaaaacuguaagucuagugauagucauagcgaaaaaagacacaaagauaugauuaauacaggaaaauguagaaauaacuuaccugguuaaugugcucugcuccaguccauguaaaacugcaagugucauuacaacauaaaacauauaaaggagagucaucaggguugguaccugaugggcaaaccauucccaugaauacaucuuccucuuuuucacuugaggauauuucagcuaaaaaaguaagaacauagcaguucaucuuucaggaaaggacuuaauuagccauccauuuucuucaacuggaaagccuuagcauacacacaauauaaaccagaaauuauauaucaauuuuaaaaagugauauacaaagaugacaugcaaagaaaucuaaccaacucuggaacaauauaaaguaaagcauaauuacaucauacccacauaugaugccaauacaaacacacuauacaucagccaucugaauccuuagcucuguuucaggcaguuaagacucaacuccuggcucuauuuagcaaauuauagaccaucucauaaacuauuuaucaguguuuuaaaaagauaacuacuuuaaucuuucaaaggcuggaagguaagaauugauauuccuuaaugcuuucuauuuagcaggaauucugucagaaauaacaagacaucugucuauuauucuguaaaguuauaucacuuaacaccaauuaacuaccaagagguucuaucaguaauccaucuuauuuuccaaagauuuuacacuguucauuacggaguguuuauucuuaaaucaauaaauuuauaucagcuguuuuuugauggaaaguuggaagauacaguaaacuugaaggaauaauaaacacaugaauuucauacacacacaaaucuugaucauuuccaaccaauuguaucauuuacauauauagaaauccagucugaauaauuauaauauauggacagaagagaaucuauccaaacugaauguaacucauuuaggaucugaaauaaauuaccuuuugcaauuuucugagcaguuucuaagaugguaauugcagcaggauaagcucggccacuuacagcugacauaaauggggucaucccucuugcaucccuaaaauaagaaaaauuauauguaaaaauauuaauuacuacuuauuuuccuuccugauuauaaauguucaugauaaaacaaaaaacuaaauuuuguuuuagucuuucacauauaaauauacaccucaaucaaacuaacauaaaagcuaguuuguauucauuuaguguacacuacaugauguugagacagccucuuucacucaacagagcuuagcaguagagggaauaucaugcuggauucugauaaauuguuuuaaauuuacauaacuauuguccauauaguguaagaagauaaacuuuaauaguaaaagcuaagcuaagcuaaaucuucacaugaaaaauauaucaaauccucuuacuuggcagaaagaaguucucguagauagggcuggagaaccacacugucacauaacaauuucaauauaaaaugagcauucgccuuucgauccuuggauucuacuacagauggcucuguggaaggaccuguaauuaagcagauucauuugguacaaaacaacaaugaagaagacacaguaaaagaauauucugggcuacccugccuauggggcacauaagcacauagacaauaggguacacugccuaugggguaucuagcccugcucugcaaggagcaguuacaauuuuuuuuuaaaagaauauucuggaauaauauaucaggcauaagcuaccagaacaauauucuaguaucaguaauaaauuaacuucaucacaaauaauuuaaaccuaugaacaccauuuuacaaaucucaucugauuucuaaauguauguacacagacaccacauauuugcacugacagauggaauguaauucagagaauuagauguuuuucaagcaaagaacagucuccuugagauaaaguguagaucuguagaacccuauauccaaaguguguccuuuuuucuuccagaugacuaggcagacaaagaguacagauucuuaccuggaauaguggaggugcuugguccuugaccaguaccgguugcugcugugguaagagaucccacagcgggggccaggauaaaaucaaugucaccaucuuucaguaaacagaacaguaggauguauaucauuauaggcaacauauuccuaacauguucucuuaacuggccuuaaggcuuuucucugcaagccaaaggucaaauuggauagaguuuaagugaaacuucuuuuccaaacuacaagagaaggaauccacuaggcaaaucuauugacuuaucuugauauauuacuaauaaagggauuauucuuacugguauagaaauaaauauuucaguaaaaguggaauaccugacaagaguucuggaauuuuaauuuuuaaaauauaaaucccuuaaaucuaauuuuuauagcuaaacuaguuauaauauucaucauacuacuuucaaauauuucaaauuucuaaauaucccuuuaaaauguuaaaauuauuuccuuucaugaccugcucuuuuuguuaaacacuaaaugaaauuaaauaacagcucuuaccaggauccaucgcaggagggucaggaacccaacuagggggagcuauggggggugaaacuggauccugguggucacuggaugaagcuccagcuucaugucuacccaaaccagcugcucucaacgaacgucucaucauuucccguaaucucaaacuaaaagaacaugaacaaaaucagagcucacuaccauaucuacacauaaugaaacgguguacagaacuucucaucugagaagaugaaaguauguccuacaagcaagcacuccaggcaagggaagugaaguacaaaugccaauucuggaaucacagaauaagucagugagggauagaaauaaaacugggggcuccuaguacaccguucagcacuaaaaucacuauauuaagcucccacacaaacuuaagcacagggaacgaaagcugcggugaaguaagauuagaaauaaucuuucauacaguucagauaaaagaacagcuaaacauuaaaacaaaaaguuucuaucccccguuuauaaucgguaauaauuaaguuuaauaguagacaucagcaaucauacugauuagcacaaaaccaguauuguucaacacuaaaucccuuuuauaaucucaaaagcaucugaacuaauauccacacaaugauuaguuuuaaaacaaagaccaauuuagauuuuuacacacaaaaaaauuuuuaacaguacaacuugcaucccaaagaaauuaaugaaugaaacuagaguuuauaaaauguguuguuaauguaugggcaugguuuuuuuccuccugcuauaaaaaaaaaauacuauacagguguacacaucacuaaaaagaaaaagaaauaaucacaaacacagaacucguuaggggaaaugggaacuaucuguaugaaaaucuauacuuuaccuuugaauaaaaccuuacaacggcuacaaaauuaauacauuuagaacuaacaaugauuuaagagagcacaaaaggcaaaucccuucacucagccacaauuuuagagcuuguaaauggauaaagaguaaaaauuucauuuugagggccagaaaacgcauaagggacuucauucucccauguagaauuaaucucagacaugacauucucaugugaaagaccuaacaccuuacuagauacgcauaauacaucuagaaauaauuucaaguuuuauuaauguuuaaaucucuaauugcaauuauuauuuaauugaggauaaauguguuuuuccaugucaauacauuuuuaauuuuauaaggaaccuuuuuuaaaaagucauucacaaaaauuacuuuuagaggcuauguucaagagcauaucuauuuuauaagauuuaugauguauuuuuuggaauaaaaacacucuagaagauucugcaauguaaauguuacugucucaaauaauauauuugccauuauaguauucacuauuaaaaaauaacuauaguuaauuauuuuauaguaucaaugucuucuuuuuccaauuuagaaauuugaguuuaagaguuuuuauaauguggaugggagcauggcacagugacuguuucaguccagaucacuucccuguccaaagauaucacccagaggaaaaggaagacuccuuaccaguaacagcacacaccauggugacuguucacacugugaugcuccuauacaaucuuaauuaagcucaacagacaccugguauccuaccuaaugugucuuacucaaagcacaaagaaaaaaaaaaucagcaauaauugggagacacugcaaauaaccugaaaauaaaugcauguuuuggccuuuuuaagaaugcuuacaccagagucacaaacucaauggcuaaugggucagaaagguaaaauaagggcagucagguguaagaaauggggguagugacaagcuagaggcacacaugcuuaucugaaggcauucaaauuaaaggaaaaaaaaauuuuaacauugcgcaggccaaacaaaaaacauuaugugggcuauucuccaacuucuagcuuaaagcagauuaagaauaaaugaagauaaauugagaccauagucucaucuugaacuugcaaacucccaacuuuguugcugugauguagucaauucaauauuaaaugagggggccauuccuugucauuuuuaaaauuguccuuaaccucuuuucuucauuaggucuugggaacauuuuuaaguacaaugcccagcuccucauauagauucuuaaaaaacaaaaaacaaaaaacaaaaaaagaaaauuauucuucaagauguuguacacaauucaugaagauucaccuguauccucaguggcugaggacaauacugaggagauaccaccuuggcugcuaagauucagaguuuugacauuucuucguaaaggcuugccuggagucaucguauuuucugacaauauggaagaauucaaggaugauguaauuuccucuuuguaagcacguuauauccaugcuacagaagccuuagaauccagucauguucaaacauaacacugugacaaaaaagcgaaggucaugugucuuccagauuaacaaucucuagaguauauacaccugcaaucagaugcaucaaucaagcuuuccacuaaaucugcccuuuguacucaggaacuauugaguucacauaauaaaacuucugagucaaaucaucaucugaaggcauuuaacaguauuccauucaauauugaaauugcaucaguuuugagcuuacagcucaugaaucccagccugcauacucaucaaggggcaucgccuagaaaauccauuggaggcuagaggaggguuucacuucaaugaagcagucuguggacuuccuacugcccggcguggauaauaagacuccugugcuuucaucuguucaaccggcagcccugaguuugaacugguuaagagcacugcagugaaaucuucggcaaauuccucaaaggagcuuacucugcaaauuauuucugugagcaacacaucacccacucuugaagcuccuuuuagucuuugccuucaaaauaauccugacaugaaaaaaagauggcagcacuggcauuggaccaaccauaucagaguccaacuugauuugcaccuguaauuucccugaggaaaugaaauaccugaaauaauucagacacuaauuucuucaugaagaauuuaaguugcuucccacuuuagaccaaacacuuugucugccuagcauaguccugaauaaauaaacuggugauaauuuccauuuuguuuagucuacguaaaguuuuugcacuguuuuaaauuguaauuuggucacccaugaauacuuuuugauaaaucucacuucaggauguuuuugaaccugguaaaguaucaacuuggaucaacuugguagccuuccuguugccaauuuaagaauacacauuuuuaaaggaauaguuaacuauggaacagaaaauaggcaaggagaaucuucauuuuaaguagacuuugcaaccugccacauuagcacauagugagcagugcuuccauuaaugaucuugucaagcagacaauaaauuuuuuuccuacagaaagaaaacuauauccugaauucuucauauucauuaucuagucaaauaccuagcaauuuuuaauguguuauaaaaguuuguccaucccaaaacucagccugaaaauuuaaacaucagacauccauaauacacaucacccuuucauuuuuuucccagaucaagauaucugagaaacugaccuaaauaagcaaucugaaaagauuaagguuccuucaauuauuauacuacuuguucuccaaauaacacacuaacuuccuaggaagcaagaaugaugaauuuagaacaaauugaaagaaacaaauuuaaacuacuugucuaaauuauuucaaauuuauuaagugucccagcucuaccuuaaacucuaauuuguuaucagauuauuuuucccaggguguuauugggaggaacaaaaaugaaacaaaaaaggacccaccaauucauguacacgacagguaagagauauacugcuuucuguacuugguuuuuuccuccaauuaaaguuuccugguaaaaaucacauuaccuucggcuacuugaugauccagcccgauuaccugggccauuacuugaaacaacugauauugcauuugcaauggccucaacagcagaaagccuuucugcaaauguauuucuuucagaacgcuccgcuucugaaaaaugagaaaaaauuaagaucaauuuaaguuuuagaacuaauacacugaguauguauaguccacuaaacacuaaucucuauauauuuaguauucuaauucacauacuagauaaccaauuguucaauuuuuccuccuuagagcaacuaacacuucagacagacugaacuaucugaucuuucacaugugauuuauuuccuuauuccgccuuccuucucaauccacgaagggcaaaaauaaggucauuaauaagaagacugaaauuuagcuuucacuuauuaaaauagaaaaagaccuacuuaccaguacuucagucucaguuuauguacuauguauaauccuuacugauucaaugauaaugacauaaaggucagaaaccugcaaaccacuauucaaaaauguagcuaccagaguaucaucagcaaauucaaaaaaaaaaacacauuaugaauuacauauuaacacuuuguccucaauuucucccuucauuuagccaauuaaaaacuuuauggcaaaaaaagcuuauuuaccuuccaaaaacauauaacaccucacuaagugauuuuucuccucuacauucuaaaaauuuagauaaaaguugccucaauguaacuuggcuuaaccugcuaaauaauucucauguaauaagucaucugcaauuauaaaaucaguaaaguucauuuagcauuacauauccaguuuguauauaucauauaguauuaaacacaauaaaaacacacuggugcaaaauuuuuuuucuuacauacccaucuuuaccuucugagaaaguaaaaaaaaaaaaaaaaggacacacaaauucuuuauagugauuugcuuuucuuuaacaacuguuacauuuucaaaauugccuaaaacucccuuuaaagaccuugcuauaguucuuaaucucacccucuucuucuuuaguuucuuuauugcugguuggaaagcaaacugauacacaagcaugcaaaauauuucgauuuccaucacaucuguggcugaugaaugucugcagcaucuguagauucugcucuaaaacaaccgcuugcucaagauucauuagauauugucgacaggccucauagucacagcgcagaauguguugcauuaagguuuguuucugugcucagacaaauuaggggaaaaaaaccucaaugaauuugaguagcacauuacauauauuaaaaauuucucauggccaacacaauaauauauaaucagauuugcaaaucaguagagacaauuucagguggccuaccaaaagaaacagaacuuaaggguacacuuuaagcagaacauacaaucgacaggaauagagaagggaggguaaacuuucuguuaaggacaaguaaauauuuuuagcuuucucaacuaacucagcucugcaacugaaacaggaaagcagccacauacaaugcauaaaugaauaggaguggcuggauucggccuuugggccauagucugccaauccuugguuuuuacuucauguuaucuaucuaauuagaacccuuuuaauaaugauagccaauuaagcaaaggauauaaauuuuauuccaggcuuacucccaccuucuuaggcuuuugugugugugugagacagugucucacucugucuuccaggcuguagugcggugaugugaacacagcucacuauggcaucaaccuccugggcucaaguaauccucccgccucagccucccauguagcuagcaugcaccaccacagcaggcugauuuuuuguagaggcagucuugccauguugcccaggcuggucucaaacuccugggcucaagugaugcccccaccucagccucccaaagugcugggcaugagcaacccacacccagcccucuuaugcuauuaaagguuauaugaaaaccgauaccuucaauucugcagggaucaugacagguguaauuuaauuaacaaagacacagugguacugauaaguauuuauagaacauaucauuagcuuucugacaaauagcaugaauauaccaagaaguucauucuuucacauuggaaaacuguaguuguggaauauuuaaugaaucgaauauaaagcuuuaguuuuauaaaacaaaguuguucauuuuaacuauaacuagaaaaaagcaggugggaaaagagcaugugggaguauaaaggaaaaaaaaaaacugcauuugaacaacuugccaccuucuggaaaacugucaaaauaagcucuccccuauccccaacuugagagcggguggagaacagauguccacacaagaaaacacaccuaaacaacuauuuucacuauccacuacacgugagacaggccacuuugauuguggaacuaacuauggcucugaagucaccucaucaacagcaagcuccaguucaugaggagcuuaauacuaaacuuuccaaaacauagggaaauuuauacaaaauauguguugagagaaaaugucaaagucucccugaagaacaaagaacagaguacuuucaaagggcaacuaaaaucaagauauucuguuguacggugcugucauauacacugguuucaaguaacagcaaauuauuuaguuagaagcagcuacuacucuacaggaaacucuuaucuccaaccugccagacuauaguagaugggcucucacacugagaguaucaauacuacuuaguuguguuacaagcagaaaaguuuacucugcaucauuguauguuacaucugucaguuauucuuauagcaaaaggcagagugaguucaauaaaaaauuucuugugggucuacugugugguaggcccuagucacugagguagguauaaagacuaaucaugacacacuucaucccuaccugcgggaugaugacucuaccugucagauccugacaaagugaagaggucacagaaucaaaugccuacacuugaaguaauauaaaugaaugaaggaggcuguguguaaaagagauaacagaagcuguauacuaaauggcaucacuagcacuuggagcaacaaacucuaaguagugagaacugcaaugaauuguaaagaccagucuaauguuuuugggauguagauuacgaggcccaauuucaccagaucuucuaaaauuaaaaucuggauuuuaaauguaaauccugugauuuuucaauauugguaacccaucaagaauucuaaaaugauaugaaggcuauuucuagacaucaaguucagaccacagcuaccucuguaucaucaccuccuuuaguuugaaaccacuagugcaguagguuacaagcaaagcuaagcuaagaaugagucugggugucuaaauaaaagcuuacagauagugcucauaagcaccuggauucagucuauuuuagaugcaguucuaaaaaguacuucucaccuccaaucuaauggagggugaauaugcucccauauuaaacuccauuuccauccuuuauagaaaaacugcucaaaaaaguugcugauauuuaucuucaguuccucaccucucauuuucuccuaaguucacucuaaugcuuucauccccacuaucaauaaugaccuagauggagcuaaauccaacagucaauauucaguauucacuucacugaccuaccacaucacuugacacaguuggucccaacauccugcuugacaugugcucuucauuugacuuccaggacacaacucauucuagcuuuccuccaacccuguggauguuccuucucgaucucuuaugcucguuccucuuuaucacccuaacauuuaaauguugagacuauucucaggacuuaguccuuggaccuuuucuccucaccaccuccaugaucuuguucaauauaauuccucuaaauaaacaacucccaaguaaauuucuccagcuugagccuuucucucuuagucagacuuacacaucuaacuuucuacuugccaucuccucuugguccaggaaucugucagauaaucuucuaauagacaacuuaaauuucaccugucuaaaaccaaauuccugaaccuucaccuucacuucuucuaucagaagagacaucuauuaaaaugucuucacauucacuuccucuaucagaagagacaucuuaaacuucacgucuaaaaccaaacccuugaaucuucuucacuucuauagucuucaacucgguaaaugacaacuucauucuuccaaaaccauuaacccucuugcuucgucuauuugauacccuacauuuagccauuagcaaaucuauuaguucuaccuuaaaaagauaccuaguacagucaugugcugcauaaaaacauuacggucaaugauggaccacauauaugacugugguacuauaagauuauaauggagcugaaaaguuccuauugccuagugacaucguagcuguuguuaaaucauacuguuuguggcagugcuggcauaaacaaaccuacuguacugccaaucauauagaaguacaguacauacaauuuauguacaguauaauauucgauaaugauaaaacuaggucacugauuucuaaaguauuuacuauacuuucuuugguuacuuuagaauguacuucuucuaucuauuuuuuuuaaaguuaacuaaaacagccuaaggcagguccuucaggagguauuacagaagaaggcauuguaaauugcacauuuuuuaaaaaggcaguaaaaaauuuuaaauauagaaaaagugcuuaauaccugggugaugaaacaaucuguacaaaaaacccuguacaugaguuuacccugcaguaaaaucucacauguacucccaagccuaaaaguuuuuuuuuuaaaaaaaaaaaaaagaaagaaagaaagaaaugaaaacucugccccucccccccaaaaaacccuuaaggauauaggaaagaaaguuauuuuuuagauagcuacacaauguguguguguguguguguguguguguguguguaagacagagucucacucugucgcccaggcuggagugcaguggcaugaucucagcucacugcaaccuccaccuucaccuacuagguucaagcgauucucgugccugagccucuuaaguagcugggauuacaggcacaaccacacccgguuaauuuuuguauuuuuuguagagacaggguuucgcuauguugcccaggcuggccucaaacuccuggccucaagggauccauccacuuuggccucccaaaaugcugggauuacagguacaauccaccaugcccgacuguguacaauguguuuuaagcauauuauuauuacaaacaaaucaaaagguuaaaaaaaauuuaguguagccuaaguguacaguguuuauaaagucuacagcaguguacaguaauaacauaagcccucacauucaccuaccacucacucacugacuuacccagagcaacuuucaaucuucuaagcuucauuugugcuaaaugcccuaucaggugcaccuuuuuuuuauccuuuagaccguauuuuuacugugccuuuccuauguuuauguaaacaacuacuuaucacuguguuacaaaugccuacgguauccaguacagaaauacacuauauagguuuauacccuaggagcaauaggcuauaccaucuagguucauguaagugcacuaugugauguuuguacaacaaugaaaucaccuaacaauguauuucucagaauguaucccugucauuaagcaacacaugacuacguaacuagaaucuagucacauuucacuccuaacuccacccccuggguaagucacuaucaucucccaccuggauuauuauuauauccuccuaacuggcacuccuauuuacucacuuucacccuaguacucucagcacgucauaaggaauccuuuuaaaauguucacugauaucaggucaaucucggcugaaauugcuccaauagcuucuaaugcacugucuccacaucuaacaaauacucuaucacaacaaaccacaacauguuuaaaacuaaauucauccuuuucccuuaucccauuuguucccccuccuauauuucuucucuaccaucaaccaugcccaaaucagaagcuuuauuaauucuuucauucacugcuaaaauccaguuaccaagcuuuacagguucuaguuucuuaagaucucuuaaauccauccccuccuuccucauuuccaaaaguugacauuuacuuuguuucuaaccuggauuauugccugacuuuuucccuuuuuuuaaaauguuuuuuguuuguuuguuuguuuguuuugagacggagucacgcucuguugcccgggcuggaguucaguggcgcgaucucggcucacugcaaccuccgccuccgggguucaagugauucuugugccucagccuccugaguagcugggauuacaggcgugcgccaccaugccgggcuaauuuuuguauuuucaguagagauaggguuucaccauguuggccaggcuggcuucaaacuccugacuucaagugauccaccccacacucugccucccaaaguaccgggauuacaagcgugagccaccacgcccagccuacauuaaccuuuuuaucugaucucuaaacuucugauaucuaucagcugcucucuaaacacccaccagccacugcugaucuuuuuuaaaaaaucaaaagcacgucauucacuggcuuauaauccuccuccuccuccucgcuuucaggcugaaguuuagguagcguuaggugaacacacaaacacccuagugccccucuccagccuuuucaguugcuacucacugacccacaggaucccuaccagaauucuggucauaucaaaaaaaaguacuuucucccaacuuauuaauaagauucacaaagguugcucuuggugccugggauaauaccucccaacuccaucccugugucuaaggggccuaucugaucuguccggguaucgcuucuuaaagaagucuuugguacagucacaguaugauuuauaucucuccccuuugugcuccuacaacauuaugcaugccuugcucaaacacuuaaauuacacgauaaucacugauguacuugucuauguaguuuuaauagaccauuagcucuuuuagggaagaaaggggcaaugaaugaucuauuuaagauuguugcaagaucuauucaagacuauuuagugguguuuugugaauuaaaaugcccaguaguuucaauacucaaauuaccucuacagccaugaugauaacagcagcuuucuuuuugauuguugaauuggcaggaagauuuauuaaagaaugcacacccauuccaagacuacuaauagguggaagauccagccaaucgggaucccuuauuccucccaugcaaucuuuggccauuggguagaugguaccauuuccaucucgaagaauaaugggagauuccuauaauaaugggaaaaugguaaaguuugacuccuaaucaaaaaauguaucugauuuuuacaggcauauuuauuuccaaauuagauuuuaguaauaguaauaagaaaccuaguauucaaaugugcuaaauauucuagguuuuugaauaauugauaagcuaaccagagccagacccccuaaccucacaaaaaugccauuguuguccuaucacuuuucaaaagcaaaaaugagccucuaccuguccagcagugaaaauggcuacauuccucucauucugaccaaggaaagcaaugcugcuuguaggaaaauuauuuuccuguucugcuuuuccuguagcaagaucaaagauacaguaucguacccaauuuccagucuucagaacagcaugaacaccuucagaagcacauaaaugagaagaaaaauuguuauacaucuuaucucuaauaaacaucuacaauauuuuaacuucucuggccacacuuguaagucaauucaaacagauacaugccauuccauaauguuacagauagggaacaaaaaaaugccaaugcccugaauuauuuuaucauauucccauuuccugaacaaguauuaauggaauauaggauaugccagcugaagaaguuucaaaauuuaccuuuggaaucuacauucacugcuaauauuucuguuuuuucagguauacaaagcuuuuuaggaguccuuuggaaacagucgggaaccuucgguguuccaccaguuuugacaaccugcaugacacaaaaggaauuuugcuuucaaacuccauaauaaacucacggagucaguuccaauauucacuugcugaauaacuucuuuacacuuaccugcaauucaucaauucuaaguaaccuacaauccugcaggagagaagaagggucagcaucuggaccagagcuguucugacaguuaguauuacuggagguuccuggaaauuuuacagcaacauaggcaccaucuacuuuuagcaccuggaaguauaggcaaauucaaugaacauuagcaauagcuuauauaaaaucaacauacaaauucuauucacugaacuaauuuaauguuaaaggaauccaauucuuuguauguuucuucaaugaucaccaaguuauaaaaucaacccagacagacucugagcuuugcuacugacaucuauauucaaggcucauuugcuagagaaaacugacccacacagccagugauuacagucagugaauguuuucaguaaucaacugaaaaacuuaaguauauagcccgugaaauccucccaucuccuaauuaaauuaaagcagccuucggucugacagaacuuucuugaaaauggcaacguucuauauuggcgguguccaauacggcagccauuagccauaaguggcuacugagcacuugaaaugaagcuaaugugacgaaggugcugacuuuuuuaaguuauuugauuuuaacaaauuuaaacagccacauauacagcuaguggcuacaauacacucaacacagggauagggucagcaaugcacagaaagacaagcacagaauuugaaaccaggacaaauuugggucccacuucugcuacuugaugcuuuuuauuuuaagcccguaucuaauucucagaagaaaacaccuacccaugaacuacaggucuauuuugagaaucaaaugaaacgguauaugagaaagaccuuuguaagcugcagaaacugguauaucugcucuuuccuuuaaguauaaaugaaagacuaucacguuucagaaacuacugaguaaucaugaaaaccuuuacuuuacagacauucuacaacugcaagugcauuuuaaauaugugucaguagaagagugaaauuaauggcacucaaauugaugguuucuuagaaggcaaaacagaagagaggagaaaaaguggaaggugacuuguaauaagguuuuucaguacucuggaagaauuuuaaaugucauggaagaugaucucaacuagaacuaagagauccaacaaaugggcuguaccaaaaaguaacguaucucuaugcaacuuuucuacaaaacuaaaacuauucccaaauaauaguuuuuuuaaaaagcaacauaucaucacaaaugcucaaagagaggcauaaucucuucaucugucagcgacugagaagacagaucugcaucagaugcaggggugcaacuaaagauaccacugaagaugauaaauaaaacagcccugaagaaaggacucagauaucaaccacaaaucccuggauaaccaauaucauuauaauucuguuaguaauuaaguuuuagauaucuugaacaaaccuugccaacaggaacauucuugacaucuuccacaaaaaccacuucccgaagagaccacugcucuucauucaccuuuuccucuucuuuuggugcagggguugaccgucgucguucuuagacaacaacaaaaugguaaguaccaaaaagaaaauguaaaagagacuuuauagauuucaucuaaauuuauaagaaagacuaucuuuaaagggauacauaagugaaguuucucaacaauuuccuaagcuacugcuuuaugaauuggaguuuucugaucaaucuguacuucaaauaaauucacagugaagaacaacuguaaccauuaauguuuaauuguauuaacaccaguauaaacaaguacaaagaaauagcguaaaauguauuuuguacucccaaaauuauaguaucuaaccagaguuuaaaaaggaagaucugccagauaguuuuaagaaaacuaucacauaacuauuaaagucuaacuuuuaauuuccuaaauugcaaagcaauuaacaccauaaaauuuauuuuaaggaauuuuugaaaaaauucuauccaugguguggcaguaagucuagguuuauaaauuuacaaauuuugagcaaaaguugugaccaagacauaaucaauuuacaauaauaagagucucaacaaaagugaguagauagacuagcuaguggcaauuauuuccuucuauuacuaucaugaauuucacauaucuuuuuaaaacucuaauucugaaaaacaacagaaauagucaacacuguaaauaccaucuuucuauucaaagaagguuaugcaaaaaaaaaaaaccaaaguaauagagauacaaauuauauaaaaagauguaaaaaaugauaugaguugccuuaaaucagaaacaaacuaaacacagcugucugcaugagaccuauuuucacaaaugcauacaacaaauaaaacuuacuguauggcauugaugcacugcuggcaauugaggaugcaucacuacacguggaugcuggagaugguggaggacccauuucuguuuucacuggcuccugcuuacuuucaggccugagauaagaaauaagauucuccuuauaauuagauaaaugaaauaauggaaacuaguauuuuuuaaagacaaguauuuucuuauaaaagaaugaauauuaaaaacauuuuuauuaaacuauguauuuauauuaauuuuuucauuguauauuuuuaagacucaagaauaaaagguacacaaugcaugcuuucaaauagugguuuaauaugggaaggaaaaauauaaaagcuaucaacaacuugagacaaugauucagauaagcuuuaucuagaaauaacgaaauuuacacuuaauuuaucaacacagcuuugucaaagccucuugagcaaacaaguuucacacugcaacacugcuaagauuuggauauggcaauuuaacugaaaaaaaaaaaggguaaaggcaaguaaguaaaaagcccauuagaccauuaauuucauagaguuccaagaagaaacucuacucacaaugguuuauaaaaauuuauucuuaaaccaucuggugacaggauuaaaaaacuagcccucuuuaaugaguuauuuaauacucuguuuaagaaaauaacuacagcaacuaaacagcauucuacagauggugcaaacauaaauauuuuuauauauuaaaggguagaaaucaguuuuuaaucagaaaagucacugauuauucacaaauuuguuauuuauauaccuauuauaaacuggaccaucaucuuaacccucgucuccuauuacucucaucagaaauuucaccugaguuuagaaauaaucuaaaagaaaacugguauuauuuucaccaggaucuuaacaugagugaucucaauaaguacacagcaaauacuccuggcugcuccacaaaugcugugaugguggggggaagccaauacugauuaaucacuagcauaccuuuaaagugaaugcauuucaaugacuggcaaacgaggguacuacugacaugaaaaagacuauguucuuaacauuuaaauuucacuuagcucuuuugcuaauauuugaaauggcugauuucaaggaagaucuugaaaaacuucaucaauuacaggcuuuaaauuccauauucuauucuaaucuuguauuuguacacaucaaaauuauuucaaauguucuuuacaaaguucauaagacaaugaaaauguuuuauuacuucuauuuuuaguacaaaauccaacguaauuagaaagucuauaaaucuuuuuuaaaaaaccaagacagagaaagaacacgaaaacuaaaagcaaaaccuuaaugagguauaaagugcaauagcuuugguuuguuaaaaauuacauuuaacuuaacaguaaucacuguuuucacauuuaacuuugcacuuuuaacacugaggaauuacagcaguaaacuuaguaaauuuauaaucauaacaucugaguauaaauggaaagcaaacuaaacaauuuuggaaccuuaaaaaucuguauguacaguaaaaucccuaucguuuuucaaugccugaauacauuuagaaaaaaagaaaauacauugauguguuaaauguucuuucuagaaugugauauuacuacucucccacauaucuauacuggucaccuauuuuuauaagauuaagaaaaaauguuauuuaacaauuuuacuaaaguuuuaaaguucauguaccaaacaaccaaauuacaguacaaacgauuauuuuuaaagaugaguagauguuucuaaaagcacagguguuaagaucucuguacuacgcuccaaacagaagucagccccagaacauggggcuauacaaaauucagcgguguuucuauucacaaaucccuucaacccaaaaaacguuuaccaauucuuuacagauauuucccucuugaguacauuaaucuguaaaacccuuucaauaaucaagauguagggcaggaaguuagguagaaauuuaagaugauuaaacaaggagagagaaugucggcuuaauagcaaggcuuaaacauauuauuacugccacaaaacaccugcaaaggauacaaucuaauaacaaaacgagggcaucaaaagagaacacuacacugucaucuggccaucaaaaucaacuguuaauauauaaauaugaggggggaggagccaagauggccaaauaggaacagcuccagucuacagcucccagcgucagcuacucagaagacaggugauuucugcauuuccauuugagguaccggguucaucucacuagggagugccagacaguaggcgcaggacagugggugcaacgcaccgugcaccagccgaagcagggcgaggcauugccucacuugggaagcgcaaggggucaggucagggaguuaguucccuuuccuggucaaggaaaggggugacagacagcaccuggaaaaucgggccacucccaccugaauacugcgcuuuucugacgggcuuaggaaauggcacaccaggagauuauaucccucaccuggcucagaggguccuacgcucagagucucgcugauugcuagcacagcacucugagaucaaaccgcaaggcggcagccaggcugggggaggggcgcccaccauugcccaggcuugcuuagguaaacaaagcagccaggaagcuugaacuggguggagcccaccacagcucaaggaggccagccugccucuguaggcuccaccucugggggcagggcacagacaaacaaaaagacagcaguaaccucugcagacuuaaaugucccugucugacagcuuugaagagagcaguaguucucccagcgugcagcuggagaucugagaacgggcagacugccuccucaaguggguccugaccccugacccccaagcagccuaacugggaggcaccccccaguaggggcagacugacaccucacacggccggguacuccucugagacaaaacuuccagaggaacgaucagacagcagcauucgcgguucacgaaaaucugcuauucugcagccagcacugcugguacccaggcaaacagggucuggaguggaccucuagcaaacuccaacagaccugcagcugaggguccugucuguuagaaggaaaacuaacaaacagaaaggacauccacaccaaaaacccaucuguacaucaccaucaucaaagaccaaaaguagauaaaaccacaaagauggggaaaaacagagcagaaaaacuggaaacucuaaaaagcagagcgccucuccuccuccaaaggaacgcaguuccucaccagcaacggaacaaagcuggauggagaaugacuuugacgaguugagagaagaaggcuucagacaaucaaacuacuccgagcuacaggaggaaauucaaaccaaaggcaaagaaguugaaaacuuugaaaaaaauuuagacgaauguauaacuagaauaaccaauacagagaagugcuuaaaggagcugauggagcugaaagccaaggcucgagaacuacgugaagaaugcagaagccucaggagccgaugcgaucaacuggaauaaaggguaucagugauggaagaugaaaugaaugaaaugaagcgagaagagaaguuuagagaaaaaagaauaaaaagaaacgaacaaagccuccaagaaauaugggacuaugugaaaagaccaaaucuacgucugauugguguaccugaaagugauggggagaauggaaccaaguuggaaaacacucuucaggauaauauccaggagaacuuccccagucuagcaaggcaggccaacguucagauucaggaaauacagagaacgccacaaagauacuccucgagaagagcaacuccaagacacauaauugucaaauucaccaaaguugaaaugaaggaaaaaauguuaagggcagccagagagaaaggucagguuacccacaaagggaagcccaucagacuaacagcugaucucucggcagaaacucuacaagccagaagacagugggggccaauauucaacauucuuaaagaaaagaacugucaacucagaauuucauauccagccaaacuaagcuucauaagugaaggagaaauaaaauacuuuacagacaagcaaaugcugagagauuuugucaccaccaggccugaccuaaaagagcuccugaaggaagcacuaaacauggaaaggcacaaccgguaccagccgcugcaaaaucaugccaaaauguaaagaccaucgagauuaggaaaaaacugcaucaacuaacgagcaaaauaaccagcuaacaucaugacaggaucaaauucacacauaacaauauuaacuuuaaauguaaauggacuaaaugcuccaauuaaaagacacagacuggcaaauuggauaaacagucaagacccaucagugugcuguauucaggaaacccaucucacaugcagagacacacacaggcucaaaauaaaaggauggaguaagaucuacuaagcaaauggaaaacaaaaaaaggcagggauugcaauccuagucucugauaaaacagacuuuaagccaacaaagaucaaaagagacaaagaaggccauuacauaaugguaaagggaucaauucaacaagaagagcuaacuauccuaaauauauaugcacccaauacaggagcacccagauucauaaagcaaguccucagugaccuacaaagagacuuagccucccacacacaauaauaaugggagacuuuaacacuccacugucaacauuagacagaucaaugacacagaaaguuaacaaggauacccaggaauuaaacucagcucugcaccaaguggaccuaauagacaucuacagaacucuccaccccaaaucaacagaauauacauuuuuuucagcaccacaccacaccuauuccaaaacugaccacauaguuggaaguaaagcucuccucagcaaauguaaaagaucagaaauuauaacaaacugucucucagaccacagugcaaucaaacuagaacucaggauuaagaaaaucacucaaaacugcucaacuacaugaaaacugaacaaccugcuccugaaugacuacuggguacauaacgaaaugaaggcagaaauaaagauguuauuugaaaccaacgagaacaaagacacaacauaccagaaucucugggacacauucaaagcaguguguagagggaaauuuagaacacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaauugaaggaaauagagacacaaaaaacccuucaaaaaauuaaugaauccaggagcugguuuuuuggaaggaucaacaaaauugauagaccacuagcaagacuaauaaagaagaaaagagagaagaaucaaauagacgcaauaaaaaaugauaaaggggauaucaccacugaucccacagaaauacaaacuaccaucagagaauacuacaaacaccuccaugcaaauaaucuagaaaaucuagaagaaauggauaaauuccucgacacauacacucucccaagacuaaaccaggaagaaguugaaucucugaauagaccaauaacaggaucugaaauuguggcaauaaucaauagcuuaccaaccaaaaagaguccaggaccagauggauucacagccaaauucuaccagagguacaaggaggaacugguaccauuccuucugaaacuauuccaaugaauagaaaaagagggaauccucccuaacucauuuuaugaggccagcaucauccugauaccaaagccgggcagagacacuaccaaaaaacagaauuuuagaccaauauccuugaugaacauugaugcaaaaauccucaauaaaauacuggcaaacugaauccaucagcacaucaaaaagcuuauccaccaugaucaagugggcuucaucccugggaugcaaggcugguucaauauacgcaaaucaaauguaauccagcauauaaacagaaccaaagacaaaaaccacaugauuaucucaauagaugcagaaaaggccuuugacaaaauucaacaacacuucaugcuaaaaacucucaauaaauuagguauugaugggacguaucucaaaauaauaagagcuaucuaugacaaacccacagccaauaucauacugaaugggcaaaaacuggaagcauucccuuugaaaacuggcacaagacagggauguccucucucaccacucccauucaacauaguguuggaaguucuggccagggcaauuaggcaggagaaguaaauaaaggguauucaauuaggaaaagaggaagucaaauugucccuguuugcagaugacaugauuguauaucuagaaaaccccaucaucucagcccaaaaucaccuuaagcugauaagcaacuucagcauagucucaggauacaaaaucaauguacaaaaaucacaagcauuccuauacaccaauaacacacaaacagagagccaaaucaugagugaacucccauucacaauugcuucaaagagaauaaaauacuuaggaauccaacuuacaagggacgugaaggaccucuucaaggagaacuacaaaccacugcucaaggaaauaaaagaggauacaaacaaauggaagaacauuccaugcucauggguaggaagaaucaauaucguuaaaauggccauacugcccaagguaauuuauagauucaaugguauccccaucaagcuaccaauuacuuucuucacagaauuggaaaaaacuacuuuaaaguucauauggaaccaaaaaagagcccgcgucgccaagucaauccuaagccaaaagaacaaagcuggaggcaucaugcuaccugacuucaaacuauacuacaaggcuacaguaaccaaaacagcaugguacugguaccaaaacagagauauagaucaauggaacagaacagagcccucagaaauaaugccacauaucuacaacuaucugaucuuugacaaaccugagaaaaacaagcaguggggaaaggauucccuauuuaauaaauggugcugggaaaacuggcuagccauauguagaaagcugaaaauggaucccuuccuuacaccuuauacaaaaauuaauucaagauggauuaaagacuuaaacguuagaccuaaaaccauaaaaacccuagaagaaaaccuaggcaauaccauucaggacauaggcaugggcaaggacuucaugucuaaaacuccaaaagcaauggcaacaaaagccaaaauugacaaaugggaucuaauuaaacuaaagagcuucugcacagcaaaagaaacuaccaucggagugaacaggcaaccuacaaaaugggagaaaauuuuugcaaccuacucaucugacaaagggcuaauauucagaaucuacaaugaacuuaaacaaauuuacaagaaaaaaacaaacaaccccaucaaaaagugggcaaaggauaugaacagacaauucucaaaagaagacauuuaugcagccaaaagacacaugaaaaaaugcucaacaucacuggccaucagagaaaugcaaaucaaaaccacaaugagauaccaucucacaccaguuagaacagcgaucauuaaaaagucaggaaacaacaggugcuggagaggauguggagaaauaggaacacuuuuacacuguugcugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuacugcggcacuauugacaauagcaaagacuuggaaccaacccaaauguccaacaaugauagacuggauuaagaaaauguggcacauauacaccauggaauccuaugcagccauaaaaaaugaugaguucauguccuuuguagggacauggaugaaauuggaaaucaucauucucaguaaauuaucgcaaggacaaaaaaccaaacaacgcauauucucacucauagaugggaacugaacaaugagaacacauggacacaggaaggggaacaucacacucuggggacuguugugggguggggggagggggagggauagcauuaggagauauaccuaaugcuaaaugacgaguuaaugggugcagcacaccagcauggcacauguauacauauguaacuaaccugcacauugugcacauguacccuacaacuuaaaguauaauaauaauaaauuaauuaauuaauuaauagauauauauuagcaaaguuacaaacaguaaaauuuagcacuuccuuucaaauuuccugggaaccuuaacaagacccuaucauguuaggaguuuacaacuucacaccucuaagucuuccuugauuauucccauucauaugcagagcaaacaaggaacuggugucaaagcacgauuaguuaagcuauaguacuuacuuagcuucaguaguuuugcuagcuuuuuccauguuuuucaagcuuucaggagaucuaaguugaaaucuacagcugucauucauauuccaaacugacuccauuaagacaccaacuuuaggaaucccagcacuaauugaaaaugcaacugcuccagcaugauaaagaggauuauuucucaagcauaccuagcaaacaaaagaaaaccaccaucaagaugacauaacuuuaaaaauauauauaauauuuauuucaaauggaugaaauacaauauaugaaaguacugggcuuccuagguuucccaguauaaucuuacccaaucaauaaggcugaaaaagcaccaccuuaaaggucuucauuaagaaaauuuguuucuaggccaggcgugguggcucacgccuguuaucccagcacuuugggaggccaaggcagguggaucaugagucaggaguucaagaccagccuggccaagauggugaaaccuccgucucuauuaaaaauacaaaaauuagcugggcaugguggcaugcgccuguuaucccagcugcuugggaggcugaggcagagaauugcuuaaaccugggaggcggagguugcagugagccaagaucaugccacugcacuccagccugggcaacagagugagacuccaucucaaaaaaaagaaaaagaaaagaaaauuuguuucuaauauuaaggaaaaggaauaauuucaacauguuugcuaaaaauuuagcauuaacuuuaaauuuucaugcagcaaauaucccauccauucugcuacaaacaaacaaacaaacaaacaaacaaaaaacagagcagaaacagcagagaagaaacuaaaaggcauuauaauuuaaaaaguaaaaugugaaaaaaaaaauuacacuucuugucuguuuccuacaaucugaaauaacuuuuucccuuaauucaugauaggcuccauaacuuuauagauguuucuuuaucccagaagacuacuguuuccugcuagccagaagguuccaugaauaauuuuucuuuuaaauuaaaaaagaauauguagacauuagugucugaaguuuaacuggguuuaggaguaaauaacuuacagagaaaaaaaaaaaaaaaacucugucaggggacuaaccucaggucaugcuccgaaaaccaauggccuucaagacagcacuguuaaacauaccaacaguaucuccaucuuagauaggaacauuuuuucuggagauaucuuuuauuuauccaauaucccaaucuuacuaugugguagaugaccagagguacacacgaagaucaugauuuuuuguggcuuauaauuaaauguaagaaacaaaagaagauggugguacauuugaaaagugcaggaacuggaaacauuggcuuagagguacaguucuaccaaagaauaguuguguaucauuaacuauaacuccguggcauaaaaugaauaguucuuaagaugaucuauaaauacagaugcagcugaauaagugaccaacaguucuuuucaauguuaagacaugaauauuuuacuuguucugcagcuguaacugcccucagccuccaguauucuacagguuuaaaacacaaccuugguuauauaccaagguauuuucauauguuaucuuucggcaauuuagugucaagcuuuuuuauuuaaagcuuuucuccaauauuuuuucuguucucccugucuacaguaaugccauauuaccugcugauauggcagcugcugcaacauccugcuaguacaugagugcaauugaaaaauaauguccagaacaucagaaaucaguauuuaaacuaaauaggcaaagaagggauccuacaaaggagggaaggaggggcaaagagaggagcagggggaaaaagagagagcauacccuguccaaagaaacuaauauaaauaaugaaggccgaucaauaauguucaaaauaguggguaaacgcugaaaguuuucugguucgaagaccaauaggcagaagaacaugaggaagaccaagaaaaaagguaucaugaagaaaaagaauagguacauuuuacuuccuuguaaugaaaaaaaaaaaauaccugcauuuaaagugcuagaugaagaaauuaacaccacauucuauaauaaaaaacuaccauuuugucuaaguuuuaaggauuaaguuuuuaaacauucauaacagcauuugcuguaaugaauacaagcauuaaguuuuacccagaagauaaaccucaaccagaauguaauaaauuagaaguucucagacucauuugaucucaagaccuuuuuccuuuuuucacuauuaacuauuacugcauaucccaaaaaccuuauguuuauaugggucauaucuaguuuuaauaauuaguaaauuaaaacugaguaaaucgaguguauuaguaauugaaauugagaaaguuuuaaauauuuaauagugauaaaaccccacauucauauaaacaauuuuuauggaaaauagauuuucaaaaaaauaguggcgagaaaaguaacaucauuuacauuuuagcaaaucucuuaaugucagacuuaauaaaagacagcuguauucucacgucugcuucugcauucaaucuguugauaccuucuucugacaaagcuaauucagcuaauaggaagcuaauucagccugacacaaauauguaauagaaaaaugaaggaaauuuucagagucccugaaaggguugaggagaaggcaggggucucuggaccacacuuagagaaccacugagauauuaacaauaucagcuuccagaaaauaguacccguagaagccuaaaaccaucucagagucaaaaaccagaaagugguagaaauggggauuugccaaagcccccugccucaugcugacaacauccucauagagcaguaucuuucaaacggguuagucauaugaaucacccgggauguuuguuaaacacaacgaugccuggcccuaccaccaaacaaacuuaaacauuucagguaagggguuccagacucugcauuuuaaaaguagcaagugauucuuaaagccagggaaccuugccccauagggaaaccuacuaauacugaaccacaaucuauacaguauuacucuacugaaugaaggaagaaugacgugacacauacacguuacuggaaaccgacucuucaaaugaugcucaucuguaaaacugcuuacaagggaagaaagugauucugaagagaaacgaggucccuuaagacaggcuaaauccaucacuuaccuggguaccaacagugauguucggcauugaagaaauaccagcacuggauuuaggcuuuuuauuuuuugcucuagcuuucucuaacauuuucuuccuuugacuaaaaggaacuacaccccugaaaacaaaaaacauaaauuggucaaauaagcaguaaaacagcccacuaaauaaaucugaaauuacacauauuaucaguuaagcauuucuggcauuucuccaguauuuucgccucagaaaacuauuaauguguacaauuucaucuuaauuauaauuugugcauuagauuaauaacuggaucuacuuuuauuaaaccuuuauaauuaaauuuuaugggaaauucaucaauugcuuuuuuuuuuuuuuuuuuuuugagacggggccuuucucugcugcccaggcuacagugcagguggcugaucucagcucacugcacucuaccuccuggacucaagagauccuccugccucagccucccaaguagcugagacuacaaggcacccaccaccacacccaguuacuucuuguauuuuuuguagagacuaggucucacuguauugcccaggcuguucuccaacucccaggcucaagcaauccucuggccuuggccuccgaaagugcugggccuccgaaagccacugugccugggccuaacagacauauuuucuuccaaauaauuauacuucauuaggaaacuccccuauauauuguuuccaaaaugcaauuuugcuguuaacuccuuaaaacacaacaaagaaaaaauguaaggucaccuucuaacaguaaagcuauaauuaaauaagguagagaauauucauacaaugaaaugaaaaaaauacucuauaaccuauacuuucaauuauguaaaagcaaaguacauguuuaugcagaggaaaaaaagauuuaaaauaccccaaauguuaacuguaguuaucucuggguugcaggauucuaaaugacuuuuguuucuacuuuauacuuucauaaaacuuauuaauuauauucacuaaguauguauuuuuauaaauuuaacuguuaaaguuuuuuaaaauguuacuuuguuccaaagugaaauuucccuuccauaaggcauaaucuuuuaauugaacuucucauguugguauuccacuacucaaagcaucuuucuauacauacacaagcauucaccgauaaauuccuccucccuauagacucaccaccaauauaaacuguuuuccagcugagcgcagguguaaagggcacagcaauguaaagaaacuauccgcucuccuugaaguucagaguaagucugagcagugugcucuaauuuagaagccacagaacuuaaaguuucauccacccauguagcaaccuaaagaauaaaauauuagaacuuuaaauaaaaucaagccaucuuuucaaaaggauugugguaaaaacuagggcaaggcauauauacuuuaaagacuggaguucuaaaauguuuugaguuaaaugcuauaaaaauaaguaauucagagagguucuuaguaagacuagaaacuauaauacuuuuucacacaaaucaaaauagcaguuauucaaaugaaugucuaaggccaucuuuaaggucagaaguaaacauuugcucuaccaauuuuuaaaagaauuuagugacuuuaggccaggugucaugccuguaaucccagcacuuugggaggccaaggagggagaaucacuuggcgccaggaguuugagacuagccugagcaacacaguaagacucugccucuagaaaaaaguuuuaaaaaucagcugggcacaguggugugugccuacaguaccagcuacuuggaaggcuugaguucaaggcugcagugagccacgaccacugcacuugagcuugggcaacaaagcaagacccugucucaaaaaaacaaaacaaaacaauuuagugacuuuaaagccaaaucgauaauuugagacauaauauccauacuuugucaaucuguauuuucuagcuucucaacaucuuuucuuagcaauuuucuugaauauuuuugccuuuccuuaaaccagaaagcuuuuuuuuuuuuuuuuuugagacggagucucgcacugucaccugcgcugcagugcagugguacgaucucagcucacugcaaccuccaccucccagguucaagcaauucuccugccucagccuccugaggagcugguauuacaggcgccugccaccacacccagcuaauuuuuuuguauuuuuaguagagaugggguuuuguauuuuuaguagagauggguuggcuaggcuggucucgacaccugaccucaugauccacccaccucagccucccaaagugcucggauuacgggcgugagccaccaggcccagccacagaaagcuauuuuuaaaguuacaguauaaacuagccaacaaaaauauacauuagauuacuaaggcuugagacacuuuguauuuauguuaacauagaucaaaaaugaaaagauggaaaaggagcaaaaaagaaaaaaagaaaacaagaauuaaagcaugaaauguuaaucaaugcaaaguguuucauaccuuguuauuuucuguagcuacaguugcucuuaugcuauuugcagacaggaggacuaucuuuucauugguuaaccccaaaaauguugcucguggaugauguaaugaaggauucuuugaaagcauaaaaaaaaauuacuauuuuauauguugauauguagagcuauucaaugcaagauuucauaaaauaaaauaccugggcauuucuguaaggcucagauucacuccauuuccacugauaaaguucuccuuuacugcugacagccagaaguucagaauacagagccccaauacagaugaauuuuguuccauccuauaaaguaaaauacaauacuauaaauauaaaaauugccaaaucuacugauuugaacacugucacuuuaaucacuucaucagaucuagauuaauuauguaaacacauaaaccacaacuauacgaagucuuuagcacagccuacaagguauccaauuaagguggcccuggcucccuccauuaacucacucaccuccauucacacuggccuucuuccugucacaguggucuucuuccuacccucggaccacuguccuugcuguucccucugucuguguuacucuuucucaggugacacucccucaagagacugucucugaugacacuauguacagaaccaccacucucacauuaguuccuuacacugcuuucuuuuuaauccacagcacuucacaacuugacauauuuauuuguuuauacacuaucucacucaaguauaagcuuugucuuauucaccacuguaacuuaagaacuuagcguacaaguaggugcucaaucaaugugcugaaugagugaagggaaaaaaagaaaaacagaauacggagcugaaacagagaaaaacgaugucaaaucaaaagauucuuucccuguaagcucuuucaagcuauggaaacaagugcccauauuuaagguaaucauucguucacuuuuauguugacauacaugcaaugauuuggaaugcaauuaaauuauaaaaagcuuggcuaauaaauguaaauaaauaauuuucuuuaacauaaaacaaaugaucagagccacaaagcuaccuagaaaucucacagcaaaaauugccaguaacggauuuuagguugcaaaaaugcuguuggucuauacacaguacuucuccauuuucuuugggauucuggcuccaggguaugauaaacaaauggugucuuucugguuuuucugucaaaauucaauuuuauuuggucagaugguaacguuauagugcuaaaacuuguaaagucuacaagauuuauuaauauaacacaauaacaacagguuaugccuuaguguuguacagaaauaauacuaauuuuaaucgucuauuuuaccuguaccagucaaaccuauuuuccuauuuucaagucacuuuuauugggggauggaaaagagaccaaauuuggaauucuccaaguuagcaauucuucccuuaccuuuaccauggaugucuacaaaccauuacugacuuucuccauagaaacugcaucaaauuuuaccuuucuacuucauauucucuucucaauccuacgguuaagaauuaacuauaauggaaucagacuaagugaguccccaaccuagauccaacacuuauuaaguaugugacuucagguaaacuauacaauuucucugaaaccauuucuucauuucuaaaauggguauuaagguaaugcaaaucaugguaagggagaggggagugcaggguaaaaaccaaacggaguaacauauauagcugacccuugaacaauauggguuugaacuguuagggucugcuuauaguucucuucagccucugccauccuugagacagcaaaagcaacuccuccucuucuaauucuuccuuccccuccucagccuauucaacaugaagauaaugagaauaaagaccuuaaugguaauccgcuuccacuuaaugaauacuaaauguauguucuuuuccuuaugauuuucuuaauaacauuuucucuaauuuacuuuauuguauaaauacaguauauacuacauauaacauacaaaauauguuguuaaucaacuuuauguuguugcuaaggcucccagugaacaggaggcuauaauaaguuuugggggagucaaaguuauguggauuuucaacugcaugaggagugggugccccuaaccccuucauaguucaagggucagcuggauaaaguacacagcacagagcccagugcaaauaagcacucaaucaaauucgacuaugacuaaucuccuccccugacuucaucucugacucacccagaaaaugauagcucucaggcaggggcuuccucaauauuccuagcucuagauuugcuuaaugaaagcaccauucucaccuccucccuucuccccaucucagagaaagaaguguuuuccuccccuccuauuuaaagauaacccacagacacacuggaugcaacuccuucccauaucccccaacaaccauccaaacaaaucucuccuucaguccuaacaugguaaagugaauuacugccuggcauauguuucaccuuaccaguuuucagugauggacaugacauuuuuuccaacugccaaaucaaugcucaauguacguaaucaguccaucuucucuuuaaacucuucaaaugauuugccucuguucauuaucuguucuggaacccauccuucucucccuaauucauaggucaccauucucuacuggucuuccaccuaccuuccaucucccuggcacuaccaugcauggucuucccuccaucucccugguacuaccaugcacucccugccacugauucuguguuucucccuguauucaaauugugcuucaccuucagccucagugacuucaucuaccagagcaucaugcuuuuaaauguguaaaucucauaucuccagacuuaccuacagcugucuuaaaaagcacaaugacaucccuaaaaugaauccgccaucuccugcaaagcugugccuucccuguaguuccuaucucuaugaaugacaucaccacccaccugguaaugggagacacgacaaucgaauugacugaugagagaaaaggaagagaugaggcgugcucccagguucccaugucuaaacugaucucaaauuccucucagauucuucucuuucucucuccccauaccccugcuuugguugagauccucacaauuuccuugaacaacuguagcauucucauaaccgacuuuugauuuuuccuguugcuuucucccaucaugccaguaauguucaccuccuuaaaacaaaucaaauacaacaaagcaaaaccccaccaaucacaucaagucacuucucuacggacucuguugacuucuuaauugcugcaaaacaauauccuaacuucuugcuuggcaaacugucuagucaucuccaucccaucucuucuccuacuccccaccacaaagcagcaauucugaauuuuucaugguuccucaaacacaucaugaccuuuugugacucugggcccaugcccagauacguuuggaauaccuuugugccuuggucaaugcccaccucaccuuaaaaaugcugcuuaaaugcuaucuccucugcgaugccuuugccagaucucucaggugguauuggucauuuaccacucagaaccccuauagcacuuuacucauacuuucagccuagcacugaucacauuaugaucacauuacauucuauguaaauguuuguguuccccacugaauuccuuguagaaaggccaauaucauacucaugacuauauuaccauaugccagcuugguauauggcacaaagcaggaacacacugaccaacuguugaaugaacaaaugaaucuuaacuccagcuucuuuggguaaaugccuuacuagagcaguacaauccugaacaaaccagcccaauagcaagagcauggugcaugaggcccucucagaacugacuugccuuuaucuuucagagauagggcaaugucccccacggugauaaggccuggaugagccaauuacaccccuacaggcccugaaaacccacuauggacaaaugaagaugaauagcacaacuaugaacccacaggaagaggacaaaaaaaucaccuacuacuucuugccugcuucagauuuaucuguauuaaagaaauuuacuguauguaaauacaaaacaaucaaauacauacacaaggacaguauuuuagcucauucauuucauaagucauagaaaacaauguuuuuauuguuuuuaugaaguacgaauugcugcuucuuagcaagcugacaucugcucaauccaacuagagaaaguggcuaugcauguuuccuuaaagagcaguaguuuguagcucuauuuuucaacaaaaagaaguugaaucaguaaaucugcaacuguccaacauaaaugggucauaaauuuaacuagaaauccuuccucaaagggggaaggaaaacuguuaaaaauaugagacaugaaauagcggccaaagcuuuaaaaaacacuuggcccagcaacaccaacucuauuaacuggccacaccuauguuuacuaauucauauugugaaaaaguuggcaucucuauuccugaauuuugccccacaaaacuugguuuucacauuuuuucuacuaugagcaaacacugguuuuaucauuagguagcagcuccaacuccuaucacuaaauacaauauacugcacaucaugauuggaaugauggcaacuacaagauacacugcaauuuggccaacuguguccauucacacuucaucucucucugccuauccgcuuuuccauaugcuuuuucugccgaguuucuuuuccuuuuuaugaucauuuuucauuuuguucuuacuucauauuaaauuacauuugugacacaucuaguuaauccuggaaguuuccagaugucaauaaaaacaaaacaaagaccuuccccagccaacuuccacuuuuagaauccucugccuucauuuuccucaguguuggaagcacaaugaaggugaagcaauauaacccacaagucugaucagcugguuccaacagggagguugcuccaaagagcuuaaacaaggggucaaaugaaauggauccauuuccucucaacaccauucaaagaaacagaguaacauacaacucuacaauauaaagggcuggugggaauaauucuacuuauuguuuccucuagacuagauagaaauagauccagaacaguaaggaauauuaauguuuuuuagcggggaaacagaaccucacucugucggccaggcuggagugcagcagcacgaucuuggcucacugcaaccuccgccuccugcguuccagcgauucucccaccucagccucccacguagcugggacuacaggugcacgcuaccgcaccuggcuaauuuuuguauuuuuaguagagacgagguuucaccauguuggccagacuggucucgaacuccugaccucaagugauccgucugccuuggccucccaaagugcugggauugcaggcaugagccaccaagcccugccaguuaauguuaauuaacaguaccgagucaggcgccguggcucacgccuguaauuccagcacuuugggaggccgaggcaggcagaucaugaggucaggagaucgagaccauccuggcuaacacggugaaaccccgucucuaccaaaaauacaaaagacuuaaccgggcaugguggcaggugccugcagucccagccacucgggaggcugaagcaggagaauggcaugaacccaggaggcagagcuugcaaggagccgagaucgugccacugcacuccagccugggcaacagagcaaaacucccucucaccaaaaauaaauaaauaaauaaauaaaauaaaaaaauaaaaaguaucugcacucucauauucacugugguaguauuuauaauagguaauauauggaaaaagcuuaaguguccuucauggacaaauggaugaagaaaacacacacacacagacacaacagaaaaaaaggauaauuauucagcuuaaaaaaggagaucuugccauuugccacaacauggauagaccuagaggacauuaugcuaagagaaauaagauagacacagggaaaaaacauauugugugaucucacuuauaugugaagucuuuuuuuuuuuuuaaaggucaaauauacaaagguagagaauaaagcagugguuaccaugggcugacaagcagugugggggugugagggagggaaaaugggguuauaggauacacagcagacauguaggaugcaaaucuagagcugcaauuguuaugucaugaggauuacaguuaauaaaaugguaucauauuauggauuuuuguuaaguagauuuuagcugcucuugucacaaaauaguaacugugagaugauagauguguuaaucuauuauaguaacaauauaaauacauguauccuauaaccuguuguaaacuucaaauauacacaauaaaauuuauuuauuuauuuaguuaguuaguuuuuugagacaagagucuugcucugucgcccaggcuguagugcaguggugugaucuuggcacacugcaaccaccgucccccaaguucaagugauucuugugccucagccucccaaguagcugggauuacaggcaugugccaccaugcccagcuaguuuuuguauuuuuaguagagacgggguuucaccacuuuggccagauuggucucgaacuccugaccucaggugauccacccgccuuggccucccaaagugcuaggauuacaggcgugagccaccgcgccuggcccaagugcagauaugcaugauuucaucuccucuggguacguacauaauagggauugcuggguccuaugguggcucuauuuuuaacuucuuuaggaacuuccauacugcuuuccauaauagcuauaccaaucuaguucccaacagcauacaaggguucucuuuucucugcaucacugucaacaugugcuaucucuugucuuuuugauaacaaccauccuaaugggugugagaugguaucucacagugguuuuaauuugcauuucccugacaauuacugauguuaagcaccuuuucaaauaucuguuagccauuuuuaugucuucuuugaagaaacgucuuauaagguccuuacccgguuuuuaaucagguuauuuuucugcuacugacuucaagugugcuuuauaaauuuugaauauuaacuccuuaugacaugcaugguuugcaaauauuuuuucacagucuauagagugccuuuuuauuuuguugacuguuuucuuuacuauacacaaagguuuuuuguuucauguagcuccauuuacuuauucuuccuuuugaaguuugaguuuuuggugugaaauccaaaaaaaaucacugccaugagcaaugucaaggagcuuuccuuauauuuucucauaguuuuuaagguuucauauuucacauuuaggucuuuugucuauuuugagucgaucuuuauguauugucuaagauaggaauccaauuuuacaugugaaaauccaguuuucccaguaccacuuauugaagaaacuaucuuuuccccacuggugcccuugucaaaaauuaguuaauaauauauguuugaauuuacuucugggcucucuacucuguuccauuggucuauguuucuguuuuuacgccagcaccauaugguuuugauugcuuauagcuuuguaauacuauuuuaaaccaagaaguauggugcuuccaauuuucccauuauugcuuucacuauuugggguauuuuaugguucuuuacaaauuuuaggauugcuuuuuuauuucugugaagaaugccacuggaauucugauagagauuauguauaaaucuguacauuacuuugagcaguauaaguuuaaaaauacuaauucuucccauccaugaagcucccuagacucaagagauccucucgccucagccucccaaagugcugagauuauaagcaugagccacagcaccuagccaagauuauuuucuuaauuucuuuuccggcuaggcuguuauuuguguauaggaauacuacugauuuuuguauguugaccucguagccugcaacuuuaaugaauuuauuaguucuaacagguuuucuugugaaauuuuggaggggguucuacauauaagaucaugucaucugcaaauacagauaauuguacuucuuccuuuccaaucuggaugucuuuuauuucuuuuucuuguuugauguucauuagugcuuccaguacuaugcugaauggaauuggcaagaguaggcaucccugccuugcauuaaauauuauuggaaaagcucugaguugcucccuguugauuguuagcuauggguuuuuucauauauggcuucuauuauaugcaggagcuuuccuuccacagcuaaacuguuaaagaguuuuuaucaagaaagaaugcucaacuucuucaaaugcuuuuucugcgucaaucaagguguucaugugauuuucagguuucauacugcuaacaugaucuaucacauugauuaauguguauauauaaagucagccucauaugccaggaauaaauuccaccuggucgugauguauaucuuuuugauauguguugaauucaguuuccugaauuuuuuuuggaggauuucugcaucaauguucaaagauauuauuagccuaugguuuucuuuuccucuggcgucuuugucuggcuuaggccuuguaaaauguguuugguuuagauucuuguuggaaguagguugguauaaacacauauauaauuacaauuuacaugcagacauucagcaacauauuaugaaauuucuaaucuagaaaaaauaaauugcaaaaaugacugagaagagaaaauggagccauguuauacaaccaccuaauuaaaagauuaccucuucucaccaaaguaaaugaauuaucaaagcuauuccagaaaugcaaaauguaauaagcagucauacaagccagaaaaacaguaaaaaacaguaggugcacagaugguuagauggaaagguggauggacggaaggauggaaagaauggcuagagaagggugaguaaagggagcgggaaaaaggagucggcggggaguaugggggaagagagggaggggaagcaagaaaggauagauuuuagggaguagggauagcauaauaagaaaguugauguuuugggguaaaaaccuucagaaaccaguaucaacuuggcugguuucacugugaacaucauaaccuugaacuuagagcacagacuuaggcacucccuccccuucucacuuugguacauauaggcugcccuuaauuuccuauuacacuaaauuauuacuauaauaaaauguuuucauaacuugaauucauucuaguccagucagauaaagggggcaugcaugaucuguaucuuuuuggucuguguccaauucacuacuaacagagaaccuggcacauaacacacaagugccacauaaacguacuucgaaauacccaacugggcucucucacccucccaugaccugcaggaacugcccguucucccuuccugggacaggaccaugcuucuccuugcucuuugcacuuuacauaaacuaacuuauuuaauucucauaacaaacccauaauguaaaaaguauuacuauaucuaucuauaugagaaaaccaaggcagagagaaguuaaagaacuugaucaagaucacacaacuagacagugguaggauuaggauaggaaauccagcaguuugacuucagaguccacacucuuuguaaucauucugugcagccuccugugauuucccaaugccuccugugcuacuguguagcuauuacguauguauguauggaaaccuauuaugguacuuauucaaacaaauuaacauuauuuuucuucuuccuauaaaaucucucacccuaacaucuaacaaaaggccuaacacauggcacauauuuaaucaagguuucuaaaguaauaaugacugaaugacccuuacuucugucuuuauggaacuuucaagaugccuauaauuuucaauuaugcuuuuauauuaguuuugacauuuaauucaagaauaauuuugggaaauauguguauuuuacagucaccucaaauauuuucaguucaauacuauaccacaaaaccuuaaagaaaagagaacauccuaucauuaaaauaauuuuauuggcuuacaaaaggguaaaacugccaggcacgguggucacgccuguaaucucagcacuuugggaggccgaggaggguggaucaccugaggucaggaguucaagaccagccuggccaacauggugaaacccaucucuacuaaaaauauaaaaaauuagcuggaugugguggcaggugccuguaaucccagcuacucaggaggcugaggcagcagaauugcuugaacacaggaggcagagguugcaaugagccgagaucacaccacuauacuccaaccugggcaacaagagcgaaacuccaucacaaaaaaaaaaaaaagguaaaauuuugaagaacugguuguuccucuaaauggaugcugggaaaguagguacuaauccaguuccuuuaccaacagaauuaagcuuguacccuaacaaaagacaaaaugaaaauuacuauggacacuaacaaccauacuuaauauuuaagaguauuguauuaggucauuucugaaauuaaacuaggaugcauauuuugauugcccccacuccuaaaaaagcuacuccuucccguauaaaaaaaaaacuucauugcugcaucugccauuuacaagacauuugaaauaagcaaagacaugaaguuuccuucuccauaaaaaugaauggaucagaggcaagccaauuccaaguuuacuauuguguacaaaauugagacuauccuuuagcagccugguaugucaagaacguagaaauaacacuuucagucaaaauaaugcaaguuaccaagauuuuuuuuaaaaagcaaaccccaaucaagauuauaaggaaagucacauuuuaagaauauuacuuuggaugacuaaucaccaccugucuccugcacuaaaccucacaaguuucauaagacaggcucaauauccgaucuugugauuaauauagcccccauaaguagcaagguacuaggcaauuagcagcaaugucuguggcauggaggagauaaaaugauagaugcaugcucugcaacugcucugguuuuccaguguuagccuuagcaugacauucaaacugucuugagcuaggaauuccuaauggaccccucauuagacaagccccuacucuuggcagaccacucucaucuggugcugguaccucuucucaccaaugguaaauaccaagugcauccugacacccuaucucccugcauucuccaccuaccucucuauucccuaucaagccuucccccaaaaccuuuugcuccucaggaaucacuaccccuaacuaauuuugagaaaccaauauaagucucacauauuaccaguuucuucacaugguauuuauccugcgccccuguauaauacuuuguuuuccuaaaguuacauaaaaacaaggucuucuuucccuuuaauagcucucuacauucucuuguagcauucagcccugcaaacaagcaccuaaugguauuuacugaucacuaugauaaugcuuaacaguuuaauuaaaggcuuaagcuguuuucuuucccagaauucaaguaugaauuucuagauuuccaucaugugcuaguaaaaagaguuuuuuccauguugcuauuuuaaauuugguauuuaauggaaaaaagaauauagguaggauauacuuuguuucacauaccgcucuucuuccauucacucgguggcuaaacaaaccaaggaauaaugcacuaaaagucuauacagugccaagauuucaugaugcacuuacaacugucucuaaaaacaagguauacuuaaaaacauaucuaucauauuuuuagccaggccaacaacggcuagcuaaaucuaacagaggguacaauggcuaggcuugcuaaacuuacacuauucagaaauacuuucauuaaucaaaaauaauacaugacaaaccuagauuaauaauacgugguggcccuauuaaaacauaauucaggagucucuuuuacuuccugcaaauaugaaauagacacaacucuaacaugauccagacaagagaaauaggaaacgguaauugauguacaaaaagaaaaaaaaaguaaaagcccaaugguuuaaaucagucccuaccauaugaaguaaaaguagaacuugggacauuucuaguuuuagggaaauaaguaaaagaaugcaauucagggaaaguuuggcaguugccaaagaaaacagaauaaccuuuugcuuccaaagagacugauuaaaauucauguuccuucuugcauucaaacuugccacaugagcugaaugcagaggaaaauaaaugaacuacaacaagacucacaguaaccauggaaacguaaauuuggaaaguuaaauaauauucgccuucaauaucccggauucaaguucuaaaucaaagaaagaaaagaaauccauaucaggcucucuuuaucugcuaguggggccccaaaguucccaucuucuuuuaguuuauuucugcuuuagaaaauuuccuacccaaaugguucuggaaauaagaagaaacagacgcaguaaaaaacaagcgaaaaacauggguuccaauaggagccucugaagaugaacuaucaauuacauacauaccaucaacaggauacaucaacucuguuucacuuauggcagugauggauuuuuaaagauucaaaucaauuaccaaauccuagaugcuuucuagaauccagucauugcacuauuccucaggauacagagcauaacuccccuagcccauuccuguucagucagcuuugucucccacagcauucaccgcaaagaaucugucagaacucacugccauuaaauggcauaguuaacuaaucaaagaacacagaucccuaaucuugucaugauauacaugcuguaucaaugacuaaaaacaugcccugcagaaacugguguccaccugacuuuagaaauuugacaaaacaaauuucuaccaaggaauguaacaccacuuacuggaguaauuauuaccagaaaagaaguacuggaauagcaugcugauguguuaucuagaacuaacauccuaauuucucugauuuacuuuaucaaguaguaagauacguugcaccacugaauacaucucacugagaugacucauggagugccaaauaaagauauauucuaucuauauuuuaaaacaaaacaaaaauauuguuuuauauauuuguguuuuuccuugagugauaguacaaaaaccagaauaaauaaaauggaaaccuuagagggagggguugucagggauccauuuaaauggaagcagugugaauuuuuuccaaauaccuuaucaggccaccacugcaaaucuucuccuagagauacuggacuuugaacagguguauucuucuuauccaaguuuggcucuccuuccuugcugguagaaccccuuucauuaucaaaugaggcuccaucaagccaccuucguucacguaaacguaaaacggauucacguucacgcaacagcucagagucucucucuaagggaagaaggagaacugguaugcaauugggucacaccagugggauaaaaguaagccacucucuaguaaagacccuucaggaugcaacuaacagcaguuuaucuacucauaaaaauuuauguaaauguauaucuaauaaggcugacaugcaacauucaaaacaucaacccuuucaagugaauguauaaaaauuauaacuaguauuuuaaaaaauuagaggcagacuuuuguauauuucaacuacaugguuuuagaguggaacugcuuuauuuugaaguauauuugguucuuuuuuaaagaauuuuaaauuguuggcuuucauuagaaaugcguacuauaaauucaauuuacauaucagaaaauauacacuccucguuugucuacugguggguuuaaaaagcacauaaauuuagaacuucaacauguuacguauauaagcaaacucgaaaaaugcacacauagaaaaaacccuaaaaaggguaaacuaugaauccauuaauauaagcuaauuauaaaguuuuuaaaaauccaagcccuuguuuagaguaauuuuuauaggaugaauuuuuaugaauaagucuuaaauuuuacugaggaaccagacaggcuuuuuuuuaaaaauaaucuuuauaaaaugauuuccuuaccaaaaugcuucccauggcuauuggccuacaaacuaucuaaagccaguuuuucugaaguugcucauacauuacuuuuuaaagaacguaauccaaauaaacucucuaagacuaggauaaauaaggauuagaaacaauaaauugaacuauacaaaauuaccauauauaggucaaaaguggucaaguauuagcuauuccauaugguucaaacuaaaaguaaugccuacauaggaugaacauaggaaaagagacauuuggccagguaugguggcucacaccuguaagcccagcacuuugggaggccgaggugggugggucacuugaggucaggaguucaagaccagccugaccaagauggugaaacccugucucuacuaaaaauacaaaauuagccuggugugguggcgaaugccuguaaucucagcuacuugggagacugaggcaggagaaucacuugaaccgggaaggcagagauugcagugacccaagaucacaccauugcacuccagccugagcaacaagagcgaaacuccgucucaaaaaaaaaaggggggggugggcaggggggagaacaugggaagagaccuuuaaaggaguuauuuauguuagauauggaauauuugaaaauauauuacuugacacauuuaaggcaguaaaguaugcauuuauuuuuaaauucauaacacuauuacauagugcauucaauauauuaaaagaucaccacagaucuguuauuuuaaaacuuuauuccuaaguacuaaaaguauaugcagcaagcucuuaauauaacaugacacacuguccaguuuaaagaucaguaaauacagccaauuucuguuaucugaaucaaguaguuuuacauucuggaaaguaaaaauauugacaauuauaauguaaacaagccauacacaaacauauacagagaaaggcaggauuaauuauuucaaaaucuuucuaaccucuaccauguacuguuaacuuuuaaggauuucaaacuuuuuuuuuuuuuuuuuuuuuugagacggagucucacucugucucccaggcuggagugcagugguaccaccucagcucacugcaagcucuuccucccggguucaugccauucuccugccucagccucccgagcagcugggacuacaggcgccugccaccaugcuuggcuaauuguuuuuguauuuuuuuuuuuuuagcagagaugggguuucacuguguuagccagaauggucucaaucuccugaccucgugauccacccaccuuggccucccaaagugcugggauuacaggcgugagccacugcaccggccucaaacuuuugaaaauagcauuuuaggcugggcgcagugacucaugcuuguaaucacaaaacuuugggaggcugagacaggcggaucaccugaggucaggaguucaagaccagccuggcuaacauggugaaaccccgucucuacuaaaaauacaaaaauuaacuggacaugguggcaggcaccuguaauuucagcuacucaggaggcugaggcaggagaaucucuugaacccaggagguggaggcugcagugagccgagaucguacuacugcauuccagccugggcaacagagugagacuucauccccaaaaaaaaaaggcauucuaauaaacuaaacauuucuauucauuuaauauugguccuaaauccauucuaguaaguuuuuucacauuucauuauuuuaucuaaccaggauuuaaaauaaacagaucacuuauuuuaaccaaauaaacuaagacuuguuuucugaaugcugcaugucacuguaaaguagaauucugcuuuuaguucagaauccauauuccuaauuaaaaauacauuuaggugaagucauaguccuugacaucaauuccacaacguaaauaggaucaacucuaaaauacuauuguggcucuucaaaauaaaaaauaauuaauuuuaaugcuaaugcauucauaaaaaacuaauaauaacuguaauauuagaaguucaaauacagucaguagauucuaccacuaucuuuccauacagcuagccugugaccaaaauaaauauauaaauaaaugcaaaauuaccucgagaugagccuagccuggaaagugaugaacgacgaaaagaaggguaaccaaaauagcuaaugucuucagaaaacauggcaucugcaucaauaaugacacuugggugggcagaaugaaugucggcaucaaggagagacauaagauccucuauaaacagaaacaaacaucacugcagcauacacacaaagagcaacuguagacugcugaaagagcucuaaaaauucacauacauuuaaaaacuagggaaugacaucgccugaggaaaaacacaacaaccuacauuauuaacaaagauuuuaaagaacaucaaaugcauaaaugucgccugagcuacuuacuacauaaucacaagaaagaucacucguuaagauauaacacuuguggccgggcacgguggcucacaucuguaaucccagcacuuugggaggcugaggcaggcggaucacaaggucaggauaucaagaccauccuggcuaacauggugaaaccccgucucuacuaaaauacaaaaaauuagccaggcgugguggcgggcgccuguagucccagcuacucgggaagcugaggcaggagaauggcaugaacacaggaggcagagcuuacagugagccgagaucaugccacugcacuccggccuggguaacaaagcaaggcuccgucucaaaaaagaaaagaaaaaaauaaaagaaacuuuacaauaaaaucaagcaacucuacagugaaaaauaucuaccaccuugaaaagaauauucagaaaagucuauugugcuuuaaauuccacuccccagucgaaagagcacuccagaaaugagaaaaacaugacggugauccaccaaccuccaggcaaauaagauucgcuggcuguaucauccccaucaucuccaucuucaucaucccggcuaaguaaauuauuuacagcaagguucacaucaagauuuguucucugaaguucucgaauaaugacacuucuggauuugccuuguaaaacaacuugggccugaaauaaaaaauaaaaagaagugcuaugguaauuuucuuuugauuaaauucuuuaucaaaaucagcuuucuaggacaggaugugguggcucaagccuguaaucccagcacuucgggaggccaaggugggcggaucaccugaggucaguaguucaagaccagccuggcuaacauggugaaaccccgucucuacuaaaaaauacaaaaauuagcugggugugguggugcacacccauuaauuccagcuacucgggaggcugaggcaugagaauugcuugaacucaggggacggagguugcagugagcugagaucaugccacuguacuccagccugggcagcagagugagacucccucucaaaggaaaaaaaaaaaguuuucuaggaucaaaauaggaaaacaguuguuucagaacucaugauaugagucaugacuacaacccaccauauucaguaaaaccucaccuuguccuguugucugacauuaaguguucuacgagauccauaccugugaaaucagcuccucuggaaugacagaugcuggaauaacuggcuggggcugacugcccaaaagcccagacccucgaucccguccuguccgaauaacucgagucugccggcgggaaucucgagcuccagcugaugaccuaccagaggauccuccaccacuuccacccacuccagaacuccagcggcuucuaaauauuggagaauuuauaaaauuagcauuuuaaacaaucauucugauugcuugguuuucauuauuauuauuuucagcuaagauaaaguuaucugucuaauugacauaacauguuacauaguguugugacaaaagaauaagguaauagaacugagcuuuaaaauaauaauacuguuuuuuaaagaaauggggucuugcuaugucacccaggcuggagagcacugguuauucacaaguacaaaguacacuacagcccagaacuccugggcugaagugauccuccugccucagccucccuaguagcuggggauuauaggcacgcacuaccauaccugacaagugucccaauuuuuuuguguuuuugagaugaggucuugcuauguugcccaggcuagucucaaaacucccgggcucaaucuuccugucucagccuccugagcagcuaggauuacagguguguacuaccaugcccaauuccaauuuuuuaaugcuuaaauauaacuucacuuuuuauaaagauaaacaucacacuuuuggauccuuaaaaaaacuuuuuuuuuugagacagggucucccucugucgcccaagcugggguugcaguagcacgaucucggcucacugcaaccuccgccucugccuccugcguagcugggauuacaggugagggccaccauagccuggcuaauuuucauauuuuuaguagagauggguuuucaccauauuggucaggcuagucucgaacucccaaccucaggugauccacccaccguggccucccaaagcgcugcgaaaauaauuuuuuaaagccaccuauguauuucuaaucacaacuauaaaaugaacacauuggucaggcaugguggcucaugccuuguaaucccagcacuuugagaggccaaggcagguggaucacgaggucaggaguucaagacuagccuggccaacauagagaaacccugucucuauuaaaaauacaaaaauuagcugggcauggugcacgugccuguaaucccagcuacucgggagguugaggaagaacugcuugaaccaggacccaggaggcagagguagcagcgagccgagaucgcgccacugcacuccagccugggcaacagagcgagacucugucucaaaaauaaauaaauuaauuaauuaaaugaaauaaaaugaacacaucuugccuuugcaugaaagaccuaucagacuuaacuaccaacacuguuacacaaaaaguaaaauucagaguuuagaauucaaagugcuucacaugaaauaaacauucauuugcugagauaguacugcauuaauauucagcacuaucaaccaccuuguccaagagaaagcugcuauuuaaauaaguuaauuuuuucuuaugagaaaacaacuuagaaagggcaugacaucuacaucuucucuuacuguccaaacaugaacaucaagaagauuaaaucaagucaucuagauaaccaugauugccuucuguacuuaaucacaucuuaaagaaaauggucacacaagucacuucagcuuuuuaaauuagggcagugucuuuucucuucaaaaugaaucuaauaauuggagaucauaugaccuagagagagguauuuuacucucaguuccuaccguacucgccuaaggcugaaaccuucaaacucccaaugcaaacagauuucauuucaauuugauuuuccaaaccauuuccccccuuaaaaaguuuggaauacauuaaccaauaaugauucucaaaucaauauacaucaaauuuccaugguuucuccucucacuugacuggaaagcccaaucucuggcuaaauaaaaaacuguuuaaauaguuuccucaguaaaaugaaaaaauaaaccuagaaaagcuguugucauccuuuugacgagcuucuguacuugcugaugcacacuaccaauucauguuuaugcaguaucuguaucuauagccuaagaacugcccaagauaacuuuggagaaaagcaauauaaugcauccucaaggcugcaguaugaaacagcauuuauuucagcuaguaaaugucauguuuaaauaacuauucauaggccagaugaaaaacaaaggggcuucauuaaaagcacauuacaucaacaaaaaaaggaaauuaaaaaaacaauccaggcugggcgugguagcccacaccuguaaucccaacacuuuggaaggcccaagagggaggaucaccugagcccagaaguuugaaaucagccuaggcaacauggcaagaccccaucucuacaaaaaauaaaaaaauuagccagccaugguggcacucacguguagucccagcagggaggcugaagugggaggauggcuugagcccaggaggcggaggcugcagugagccaugauugugccacugcacuccagccuuggcuacagaucaagacucugucucacagaaagagacaagaggagagaaagggaggggagaggggagagagaagagcaaagggggaaagaggacaggaagggagagagagccaaguggagaggagaagaaagaaaaaagaaaacaagccccacuuaacaguagcgucaaaaaaaaacaaacuacuuaggaauaaaaccuaagacuuauacacugaaaaguaaaaaacacugcugaaagaaauuuaaagaugacacagauaagaaaaguaucuuggguucaugaauugaaagaccgaauauugcuaagaggucuacccuacccaaagcauucaacacaaucccuaucaaaaucccaauggcuuuucuucuuuaacaaauaaaaaaauuggcugggcauaguggcucaugucuguaaucccagcacuuuggcaagcaaaggcgggaggaucgcuggaggccaaggcgggaggaucacuugagcccaggaguucuggaacagcccuggcaacacauugagaccugucucuacaaaaaaaaucaaaacauuagccaggcaugguggaacgugucaauggucucagcuaugcaggagacugaggcaggcagaaagcuugagcccaauaggucaaggcuucagugagccauccauguuugugccacugcacuccagccuggguaacagagcaaaacccugucuuaaaaacaaaacaaaacaaaaaaagaauugaaaaguuugucccuaaauauucacauggaaucugaggcaagcccagacagccaaaacaguuuggaaaaagaacaaaguugaaggauucacacuucacaauuucaaagcauauaacaaagcugaaguauuuaaaacaguauggguaugggcauaacgacaaaaaagaccaaugaaacaaaauggaacccagaaauaaacccuccuauauaucgccaaauuaucuuacacaggugauaagaccacuuaggggaaaaaaaaauagucucuucaacaaguggugcugggaaaaguggauauccacaugcaaaagaaugaaguugaacccuuaucuuacauuauauacaaaaauuaacaaaaaaugaauuaaagaccuaaaacgauaaaacuccuagaaggaaacauaagggaaaagcuucauggacuuggugauuauugcuuagauaugaugccaaaaaaacacaggcaacaaaagcaaaaauaaacaaacagcacaucaaacuuuaaaacucuguguaucaaaggacacaaucaacagacaaccuacagaaugagagaaaauauuugcaaaucauauaucugauaagaggauaauauccagaauauauaaauaacuccuacaacucaaccaaaaaaaaauuaaauagccuaauuaaaaaaugggcaaaggacgugaaaugauauuucuccaaacgugauauauaaauggccaacaagcaaaugaaaagauguuuaacaccauuaaucaucagagaaauccaaaccaaacuacaacaagagauuaacuaaugcugauuaggauggcuacuaucaagaaaaaaaaaauuacaaguguugcgaguauguguagaaacuggaacccaugugcacuguuggugggauuguaaaacggaacaaccacuuucggaaaacaauauggagauuccucaaaacauuaaaagaacuaccauaugauccagcaauugcaugucugguauauauucgaaagaauugaaaccagggucuuaaagagauacuugcaaacccauguucaaagcagcaucauucacaauugccaagugguagaagcuacccaaauguccaacaaaaggugauacauacauacaauagaauauuauucagcuuuuaaaaggaaauccuaucacaugcuacaacauggaugaacuuucaaaacauuaugauaacugaaauaagccugucacacacacacacacaaaaaaaaccucagugguuccacuuauaugaggcaucuuaaauagacauucacagaaacaaaguagaauugguggcugccagggacuagagggagagaaaaaaagagcucuuguuauuuaacggguauaaaguuccaacuucacaagaugaaaaaguucuagaaagcuguuucacaacaacaguguggacauacuuaacacuacuaaacuguauauacuuaaaaaugcuuauaaugguaaauuuuaugguuuuacaauuaaauuuuaaauucacuuaaaacugaaguuguauuaaaguacuacucuagaaaguagacauguuuucuuuucaaguuauauauuaaaacaauuaugcaucagaaaacaacaaagaacgaaugaaacacaaauagggaauaaaaucaacuacuaaucaacuacuugugcgccuacagucccagcuacuuagaaggcugaggcaggaggacugcuugagcccaggaaauugaggcuguggugagcuaucaacacacuacugcacuacaggcuggguggcagagugagacucugucucuaaaauaaguuuuuaaauuguuuuuaaaauuaaaaaucaacuauuggcugggugugguggcucacaccuguaaucccagcacuuugggaggcugagaugggcggaucacuugaggucaggaguucgggaccagccuagccuaccuggugaaaccccagcucuacgaaaaauauaaaaauuagccagguuugguggugggugccuguagucucagcuacuuggggggacugaggcaggagaaucacuugaacccaggaggcagagguugcagugagccaagaucgcaccacugcacuccagccugggugacagagugagacucugucuccaacaacaacaacaaaaaucaacuauuaaaucagcacuuuuacuucauaguuuccuaugaguuuuaaaaacuaagucuuucaggaaaaacuaucuucagucauuuuuaaaaacauucaagagcuaaauauguaaauuauuucaaugugaaaacaggaaaaaccacauuaaagagccuuaaaaugauauaauuauaacuauauauaccaguuugccuaugauagugccaguuuaagccuauuggcuaagccuaacuauuaauuucacucaaaaacgucccuguucagacaauaaauuauauggccaucacagauuaaagggaagacuccauauuuucacuaagaaaugcaucaccauuuuuuuccacaagcaaguacuauuacaagccugaucagaaauaguauccaaguacacaucugcuccugggcagaccuuacaaguaucucaaacucauaucuccaugagagguagauaagcuacguaaacaagggaagccaagauaacagggaagacaggagacuaucugccuaucuaaaaacacucaaauucuuuucuauaagcacugcugauuuaauccauuacaccaccagcagcugccaguuuacaaucucugcuacacaagcccuccauugaguuuaaagacaaccgucaaaauaucucuccaguuucuccauucaccugacuguuaccauagagaauacagguauucccacucuggccugcugugugcaguguuuucuccuaucagaauccaaaccaccuaccaguccccguacgucaaucgccauuaacauuccucuaaccagcucacuaucuauauaaagauuaauguguuaaacuaagcauauucuaauagaggucuauugguagucacaaaagacaguacuggaaucaguugauuccuuuuaucuauaauuacagugagcaacauaauuuuuaauauuaaacuaacaaguacugggaaaaccuguuucuacuuucugugguuugcuuaucaaauuaauccuacaauuuugaucccguuauacaguucucaagguacacagaaugacucaaaaugaacuaaggauaucauaccuaguauggaauuaguccacagcuugcaaacuuaaagcccaugggccaagucuuguccauauagguggcugguuuaaaauguguauuuaucaucaaaaacaaggaaaagucugagaaacggucacagucaagaggaaucuaaugagaaagggugacuaaauauaaaguggaauccuggaugggaucuuagaacagaaaaagggcauuaugaaaaacuaaggaaaugugaauaaccuauggaugacuuuaguaucaccacucauuaauuguaacacauguaccauacuaacauuagauuuuaauaauauuggaaacuagacaugggguacaugggaacucucaguaugauguuugaaauuuugucaaucuaaaaccauaggcuggguucacgccuguaauuccagaacuuugagagaccaagaugggcagaucuugagcucaggagaucaagacuagccugggcaaccugucaaaacccagucuccacaaaaaaauaauuagcugggcaugguggugcaugccuguagucccagcuacuugagaggcugagguaggagaauggcuugagcccaggaggcggaggcugcaauaagccaaaaucaugccacugcauuccaacccgggugacagagccagauccugucucaaaaaaaaaaaaaaaaaacccuauccuaaaauaguuuauuuuuaaaauguacauaacauguaugcacacacaagucugaaugaugugacuguguguauguguauauuuauuuccaugaaaauaucaauuagucccaacauuuaagauaagagauuaucacacaauccagauuugcagguuuucuugggacaaaauaaggcagggagggacacaaggauuugaauuugccaaccauggcccuguauucuccuauagacaaaaccaguuuaccagcagccuccuugaaaaauggggaauccaguuugucagaauccugcuacaaacugucuuacccaccugaagggggccuucaacuauuugcaaguaaaauuauacauuucaauucacguacuauuagcucagauuaaacccuaaaggaauaugguagcucaaaucaacgaaaagcagcuuauaccuaucaucuauuguucaacggucacaaguaacagaauaggaacuuucgauacagguccauuuucaccuuacuauuuauuaaacaaaaauaaacucccuucucuaccccaaauaaaucuggugcucuuacccuuaagcugguuuaaaaugaguuuaaaaaaaauaccuaggagauuuuugaaauaccuugcaggauaaacuugaaguaauuacuaaagaaagaaaacaguagcagcuagaaaucuuuagcacacaaaucugacaauuagcaaaaucuucuaaggaaaaaacauuaaauggaucaguauguauuccuaaaaauaaucagucaaaauaaaugaucaauucucaauuauccaugcuggccgggcauaguggcucaugccuguuaccucagcacuuugggaaguuggggcaggcagacuguucaaggucaggaguuaaagaccagccugggcaacauggcaaaacccugcucuaccaaaaauacaaaaauuagcagggugugguggggcaugccuguaguccuagcuauuugggaggcugaggugggaggaacacuugaggcugcgaagucaaggcugcagugggucaagaucacaugacugcaauccagccugggcaacagagggagauccugucucucaaaaaaaaaaaaaaaaaaaaaaaauccaugcuaaaaaacuguaccaauaaucccaaacucuuuaaaaauguggcucucaaagagacuauucacuuccugauccaggacaacucccagcagcaaaagugagcaggccuagacucugcaggacaggagugaggaccaaggucucuggggacagucucuuucauauugcauuguauuugguaaaucugugguuuaaagacuccccuuugaggacacaagauuugccuguccuagauuccccaauacauguuauaaauugcaagcuucucuaaaguuaauuguaauuaacacagaaauugaaaaaaaaaaaaaaagagcaauguacaaaucaaggaaacacauuuacuauaaaggaaaauaugugugacuguaaaaaaaaaauuugauuuacaaaauaacuuaaucacaauuucaccuucaacaaacugcaaagauuuuucauacagcccaagagaaacaaucagaauuuaacugcuuauacuuuguaaacaucugcaaacucaaauauaaguaaacaaaucacuggcaucaaguuggucaggaggcacuaugacauuuuacaguauugcaaucauggaccuaaugcuuaaagaacgcuuacacagucuguucuggcagagagaacagaggcacaaagagggguuuacggggaguguaagaaauggguaaggggacucagaaaacuaaggauucugucugcauuuuaaagucuuaaaauuagcccuaaucuucuucagaguaggucuacagagguuuuauucaaacauuauuauauuuguuguauauuuuuauuaacaaagucacaaaauucuaccauccuacuuuagucauucugucauacauucuauuauaauugguuauuuccaaguuuuaagaggauuuaagccuaagacaauuugagcaacauaauaagagaaauggguuauaaacuggagaauaaaacaaauauccaugagacuauaaugauguaaauaacauaagagaaaaagaaauaaauagaauaaaaaauaaggccaggcgcgguggcugacaccuguaauccuagcacuuugggaggcuaaggcaaggagaucacuugaggucaggaguucaaggccagccuggccaacauggugaaacccugucucuacuaaaaauacaaaacuuagucaagcgugguggugggcgccuguaauuacagcuacucagaagucugaggcacgagaaucacuugaacccagaagcagagguugcagugagcugagaucaugccacugcacuccagccugggugacagagggagacucugucucaaauuagauagauaaauaaauaaauaaugggccgggugcaguggcucaggccuguaaucccagcacuuugggaggccgaggcaguuggaucacgaggucaggagaucgagaccguccuggccaacauggcaaaacccugucucuacuaaaaauacaaaaaaauuaccugggcauguuggugagcaccuguagucccagcuacucgagaggcugaggcaggagaauggcacgaacccaggaggcggagcuugcagugagccgagaucgcgccacugcacuccagccugggugacagagcgagacuccgucucaaaaaaaauaaacaaauaauaaaaaaaguaaacaaauaaagaaaugggguagaggagggaaaguucuuccuuacaguugaauuccaauuaauaaauguaaaagaaaugauaauuuuuuuaaaaaaucaccauuuggccaacaccacaguaacaacugauucagacaaaaaaagaaucaucaauaaaugcuaaacucagugagcaaaaguaugaugaggaagaggauauuugcagagucacaaaguaucuccccacaaaaugcauauuaaagaaaaaugggaaaauaguaacuuuauaguggagaaacagguaaacaccaucuuaacuaaucacaggacaccuccuuuccaguaauaaaacaacaguaacaucacaugccaccugauaugaugcacugaaaagggcacaucaucacuucugugguauucuugcaaaaaauguaucacuugaguuuaaucacgagaaaugauaaacaaauccaaacauucuacaaaauaaccacugguuuuucaaacucaucauggccagaaagauaaagacugaggaucuggcccagauuagaggaaacuaaagaagcauggcugcuuagggaacauagugagagacccugucuccacaaaaaauuuaaaaauuaccuacaaaacuuuaaaaaguuagccagguguggugguggcccauaccuacauccuagcuacuugggaggcugaggcaggaggauugcauuaaguccaggaguucaagguuauagugaguuaucauugugccacugcccucuggccugggcaacagaacaagauccuaucucuauuuaaaaaaaaagcagcagcagcagcagcaugacaacucaaugcaacugggauccuggacugaauccuggacaaaaggguauuaguggacaacuggagaaacuuaaauaaacucuguauauuaaucagugaucaauguuaauuucuugguuuugauaauaugauuauguaaauguaaaacauuaacacggaagcugggugcaacguacacauaaauuauuugugcuauuuuugcaaacuuuuuauaaggucaaauuauuucaaaaugaaaaauaaaauuuaaaaauaaauaagaguaggcugggugcgguggcucaggccuguaaucccagcacuuugggaugcugagauggguggaucaccugagguccggaguucaagaccaaccuggccaaaauggugaaacccugucucuacuaaaaauacaaaaauuaggagggcgugguggcacgcgccuauagucccagcuacuugggaggcugaggcuggagaauugcuugaacccgggaggcggagguugcaguuagucgagauugugccacugcacuccagccugggugacagagcaagacucugucucaaaaaaaauuaaaaauuaaaaaauaaaaacuaaauagaguauaggauuaggaacaaaugccaguauauaaacugauaagcaaaaccugggaugagcagacuuuuacuguaaagggccaaaucauaaauaguuuaugcuuuggaggcuagucugucccaacuacucaucucugcuguuauaguacaaagacagccacagauaauaaguauggcugucuuucaauaaaaacugggguggcuggauuuggcaugcaggcuauacuuuacugauccuuaaacuaaacaaaaaaauguucaucuuuaagaaagguacuauuuggcaacaguauaaccgguaauacuuauucuuaaauauaaucaaaaauuuuucaguuuuaucacaugaaauaaaauuucauguuauuacaugcuauuuucagaauucuuuaucauauacugugugccuaggaccauuaaaagagcacauauaacauuuuaauaaagacaagagcuauauuuaguauagcuaaaggauguacucaacuaaaaacuuuccucacauucuaaaauaaauuuaguucagcaugaaaacacaaacgcaaagaaaguaaucauuuugguaucccccccacaacccuuuucuuuucuuuuuuuuuuuuuuuuuugagacgggggucucucauuuccauugcccaggauggcauacaguggcauuaucauggcucacugcagccucaacuuccugggcuuagaugauccucccaccucagccuccuggguagcuaggacuacaggcaugcgccaccacauucagcuacauuuuuguauuuuuaguaaaaauggcauuuugccauguugcccaggcuggucuuaaacucugggacucaacagauccacucaccuuggccucccaacgugcugagagguguaagccaccacacccaggcccaauuuucaaaucuaacuuuuacuuuaccuaccaauuuguggucuggagggaaaaaagccaaacacuuccuccuccauuuaauuauauuuugaaacuaguuacauugcuucuaguuuucugugaucagccuucaaacacguggugacugaaguagcauaaucuaaucauuaacuggguauuuucagaaaaucuggccauucaagaaucaagguauaaaaugaguaaaagcaccugacuugaaauuuguauaugguuucuuuaguuuaacaguauauaaacuuuagauaaaagugucugagugcaaugccucagacguguaaucccaaaacucugggaggccaaagcaggagaaucacuugaggccaggaguucaagaccagccugggcaacacagcaagacccuaucucuagaaaaaaauaaaaguaauaaauaacguuuaauuacaucauuuacaaacuucauuaaacugauucagaaagaacuaccagaguuggaugccagaaauaaauaaauaggaucaggaacaaacgccaguauauaaauugacaagcaaaaccugggaugagcagacuuuuacuguaaagggccaaaucauaaauaaguuuaugcuuuggaggcuagucugucccaauuacucaucucugcuguuauaguacaaagaauaaguuguaccaagaauaaguuguaagagaggaccaaagauaaaaucauuuaaaauuuuaaaugaaauaaauggcgugacauuauaaacauauguaaacauuauauacauuuuuuaaaggucaagagccuagauuaauuguaauuagccugugugaguuauuuuuaucaugguggcucacccugagcaauaugaacuuccugcccagaguucaggagaauuuucucacuccaucacuagauagaauauugaagaugaucauucagacugagagcacucacaggaagaugauacagaccaucuguaagauggugccuucaacuggccacaacuuacccuaagguguugccugccagccugccuagagucucagaaccugagagaaaccauggagagucgcuuguccuaccaggccuugacguccucccugcccccgaguugcuguucaacuuugaccugggggaaagcaagagguaaauuuuugaagaccaacauuuuuuacaacccuguuauuucaaauugcauugcuuaauuuggaaaugaucuauaaaaucauuucaguuaaagagcagauuugacuugguaccuacuaaacacguaauaucauucuucugguaaccuguuucuguuaagugauaacugacuccucugcuacuuuuaauguuaguacuuugggcugugaaucaucgcuugcauaaagauuaaaauuaaacuagaaagcaauaguuucacuguuuuaaaagaucuaauuuucugugaugcuuuaaguugaggguuaccgaaaucaaaacacagguuuaauauaauaccuaagagcuaaauacauauuaaauagaaaggacauaauaucuuacccaucauuauuaucagguuuacccaauuccaaucugucuggcuguacugaaaaaccaauccugcaaacucuaccauccuaaaagcaaagaaaacagaaaaaauuauccaaguaaaaauguguauuaaaauuugaauuuauucaacaaagagauucugugcccaucacugucaauucagaagacgauaaauaaacuuccuuccaaaaggugcuuacaccugagauggggaaauaugacauacauaacauuaucaagaaaccagucgaaaauaauuuacaacaucucaaucugacaaaauucaaaguaagaaaaugacuggauuuaggagacuccccuauucuguuacuaauuaguuucacacucuggcaaaucauguaagcuuucucugggccagaggaggaaagagaacugggagcucuucaagauaacuuucaaguaacugcuguuuuccuguuauaauggaagagauacaaugaugcacaauucuauuuuaacaguuuauuuuucauuucuguaucuuagagugaauaauuuaccucaagaagaaaggcagcaugauuuggucccaccacacacuguuuaauaguagccuguuccaauacauucaaagggggguggcugagagauaaaaaaagaaaaaguuaaauuauuuuuuaaugguaaauacaucauaggguuuacucuuaaauacaauuagaaaaaaaaaguuggcaaaaccuauuuuuuaaacuaauauuuacuuuaaagcaauaauugaaaaauaauaucuccauaaucauuuauaucucccuguaugccagauuuaaaaaaaaaaaagcaugaaugcaaucuauaauucaaauaagcccaacccauaaaaaguugacagauuaaaagauucuuaaagucuaauaaucacauuaaucuuaaucauaucaggcugccgccuaaaugaguuuuuucuuaauaaagaaaaauuguugucagaagauuuaaauauuuuaaaacucuuaccuguuuaaauuauauuuguucagcuucucagaaacuucucguaaccuuuaaaacaaaacauuaacaaaccacguguacagaucuuuuguaaacaaauacuucugacagguacuuguaccauuauuuugguaauuuccaauaguaguacacaaaacaacugcuaugguaagaauguuuuucauauuuucauuuuugucccgaaaagaucacaagcagacucugcaauuccguucccucaccaccccauuugcaaccucaguaacaaugauaaucguauuaaucccauuuucccauuaaucccaggugagaaaacugaagcuucuagaguuuauagaaaagguagcauaaaguugguagcugaaccaaugcccaaccaaaggcucaauuguuuaaaaaaacaaaacaaaacaaaaaacuguguuauccaugucaagagauucuugagugcacauggauaucaugaaaugaaaacagaaagccuaauugacuuaagguaucaucucaaguucuugaacggucuuauagcacaaaauugaacaaaccagaucaucaauguccuuaucuauauaaaguaaggauaacaccucccauuucuaacagcauuuaaaacaguacugaacagauuuagaaaaaccccaaagggcuacauaacaaagagauauuaacuuguauuuucuguuaugauuuuguuguuucucuuaagaaaacagucuugaauguaaaacacuauaauagcuaaauuaaacuagguauuuugucaaccuaagaaagucauuuuacaauguaaagauauaaucaaaugcagagauuuuaagcaauucuauuaaguuaucaaaaaaaacacugccugaucugaucuuuuaaaaccguuuuccagaaauaauucuuguaaaaguaaacugagaauuuuagaaagcaaugggaaaaaucagaacauuaaaucaauagaaaaguccaugaauucugcucucuaaagagucacaaaaaugaauaaaaucaaauuucaaucauuuguacuaacagacaaaaauguuauacauacuccaaaaauaaaugacguuaaagccaguuuagggcuuaaaaacugccacaaagcauauauaaucuaacuuaauuauuucaguaagagaaaauaaccuaauuauuucaguaagagauucaauuaggagucagcuguucuauaacuuuauccuauaaguucuaucauccuagugaacagcaucuuucaaaggcguacaguaacugucuaauauugaauugcauucaguaacugaaauaacuuuuuuuuuuuuuugagucucgaucuguugccccagcuggagugcaauggugcgaucucggcucacuacaaccuccaucuccuggguucaagugauucucgugccucagccucccgaguagcuggaauuacagguacccgccaccacacccggcuaauuuuuguaauucaguauagaugggguuucgccauuugggccaggcuggucucaaacuccugaccucaauagauccacuugccuuggccucccaaagcgcugggauuacaggcgugagccaugacgcccagccugaaguaacuuucaaaugcggccauauuuuauuucucucugaagaaguagauacuuacuggugaccuuauucucacuccuaaagaacagcaucugaucauuugugauuuggcccccagaaaaauacauuuucauuuuuguagcccaguuuugcauuuacuuccauuaacaaaacauguuuucauuaguucaagaaaguuaagcuuuuucaaagaauuccaguuugcccauuuacaaagcacacuucuguguuccaagauaaaacaccuuaaggguaauguauuguggaacccaugagcucuaagagaaggcugacuagaaaauagggagaagauaaacaagggugggucugcucugcagaguaacagcagccuuuagaagaccccaagaagcagcaggagcucucacuuccccggguccacauuuacuaugaguaaccacaguagugacacuuucagaagauaacuuguucacuggcaugcaacuaaacucauucauuuccauuccuuuguuaguagcucaaaacuugucuccagagcucucgcaaaauauauagcauugggagagaaaaauaauugucaaggccuuuuucaaaaccggacaaugccugagauuaagaauuaaauguuguuuccacgucuccaaauauuccagacaauuauuuguaaaacuaaaguaagcuucgaggauaugagaaugcuaaaaaauauuuaaacucaagaacucaacagcgaauuucaggcuaucuggggagauagcacaaaugguuacugcuaucaauuaaauuuucuaaucuuaaaaguccuggugagaccccuaaccacaucugaaauacaugucugaaaugcacaucaauuuguacuggaaacaaugccaccgaauagcaagaaauccgggguuuacucccagcucaucuacuacuaccuggacucacuaaaaguccacuaggucucaaguucucaucuaugugaggaagaacucuuuuagucaucuccgguucugaaaauucuuauuccugaaauucuuauuuuuuguuuuuuugccucuuuugagacugggucucacucugucgcccaggcuggagugcagugguccaaucguggcucacuaccaccucaaucccccaggcucaaucuaucuucccgccuuagccuccugaguaaacagaacuacaggugcgcaccaucucacccagcuaauuuuuguauuuuuuguagagacagcguuuuagcacguugcccaggcuugucuuaaacuccugggcucaacggaucuacuugucuuggccucccaaagugcugggauuacaggcaugggacauagugcccagccucaguccugaaaugcuuaugaauauaugaaaagcaaguguaucaauggaagauauauacguaauguuuacaaugaaauagcacuaucauauucaauuuuuaucguacccauuugaaacuuucaaauggauuuuauacagacauuuagauugcuuccccaaauaucaaauuuuaaaaaacucuuaaauucaguccacagauuuacacaaaauguaucauccuuucaaaucucaagagaguuaugacuaaacugggcccuacaaauuaguuuauaugaauccagauaacaguaacaaauaaaucuucaccccaaaaaaauaaacuauauuuaagaaguauuugauuaucuuuuacauuagagaguccucaguagacaggcaaaucaaagaaucacugcaggccugugauaacauucguuuaaauuugcuaaauuauccaugcuguuccccuccuuuagccaaaaaaaaaacugaaguuuuuuuaguuugcuaauuauucuauacaacagagauucaccuacuuuaaaggaucuucauacaauguuuacgauaggcaguauuaacaaaaguuuacccucucuuuaaaauaaaaagaaacucacacugaagcucaccaaauuccauuucagaauaaauuuuuacacgugguuaugaugaaaaacaauuuuaagaauacagcaugacauuagaauauaaccucacuggccaggcacaguggcucaugccuguaaucccagcacuuugggaggcugaggugggcggaucaccugaggucaggaguucaagacaugccugaccaacauggcuaagccucguuucuauuaaaaauucaaaaauuagccgggugugguggugcacgucuguagucccagcuacccgggaggcugaggcaggagaaucgcuugaacccgggaggcagagagccaggaucagugagccgagaucgcgccaccgugcuccagccuaggugacagagcaagacuccgucuaaaaaaaaaaaaacacaaagaaaauaaccucauaauagcauuuaaucucauucaaggauagauagguagacaggugaacuuuggugaggugguuguaacacacaaugaauagguuagcaaaaagcuucugacaauccuuggguacucuacacuccuauuugcuacauuuauucuauauucugauuaaauaaacuauuucauuccuuuaaauguauagaucacuuuacagaucuagaggcugaaauuuuuguuuaaagcaacaaaguaagguaacagcaaacugauguuaauuaacagagacaggaaaacaguguaacgguacuugcuagaagccaacauauuucauugcuauacuuuaaauccccucuaauuucagucucauucuccccaaauuuaacauuacaauuucaaagguaauuuaucuucucacugauccucaacuggcaacagcacuaaguacagguucuucgguuucauaauucucugccuaacucuaacauauaacauaucugcauguucaaauaccccuaaacuggauuaaaccugacagauccuuucuugcagaauuucuaaagcaaaaaaaaaaacguauaauuaaaccuucaaagguuucaauucucaaagacagaaagguauuucugacaucacauacucuacaaggugaugguuuccauauacuuggaacuguuaaacaagguacauccacucauguuucaugacucucagcaaucacguuaauggcaaaaguggcaucaucugccaccagugcaguuccuucagucucauuccacuuauuucccacccaguucaaaugccaccuccuccaugaaccuuuccugguaguuguaauuuccuuccuacagaagucuacaaauucucucauaucuagucauuuguguuucuauccgaacugucuucacagacucuaagcaaagacagaauacaacuugccaagucuuuccuuaccccucugcuuuucuggauacaguuccaacaacgaaaaaaaguacauuacugguacguaacuuauuucagaggcagaaaauguuccugaucuuaaucucaaaaaaacuaacucuccaggucuuccgucucaaauuaaauacgugagcagugugaauauacagauuuaagauaguuucccauauaacucuuaaaagaucacuuaccauggaaggaaaaaaacacuaaguaacucaauaaucauauuaggaaacugccuauaaagugaccccaccucaccccaacucuggauauccacucauggaauaaaacuuuuacauacccauacaauuuuauuuugaaguaaagggcuuaauaauucaugcaaagaaccaacagauacagucaaugaagguuaccuacaauacuaaaucacagacuccuguagaaaaagucuucaaauucaccucuugucauccauguuggagaaagcagguauugccaaaacaaaaaugcaguacauguaaaaaaucugugaccagauaaauucugcuagaaaaagaaauacuguaagaauauuucuggcauuucuccaaaggcaaaccaucuaaaucuuaaagccuaagucuuggagugguggucuugccuauaccauuuuuuuuuuuuuggagcaacuauuguguacuauauagaugguagagacaagcaccuuucuaaaaagacaaccuaucucuaaccacagaacaugguccgcaguuaaauuaucaugcacuuucuuaaguaaacaggcagucaguccucaauuuuuacacaguucuuuuaaacaacucuugcaccauaccacaaacacugacacuucuuaaacgcugcuucucaugccaacuguuucacguuaucacugauaucaauaaauucaaacuaucacgugggguggucccaccugccagccacuauagcuagggaaaaaggcuauauaaacuuugagcccuuucugaugaucauuuacuggugccaacaucuagaaggcacauccccacuccagccccgcccccagcaaacugagauccugggcuaguuuauucaaugcaaaggguaucccaaccccaaaucccuuuucacacaguccuggaggaagccaauggcgaaccaccuaaggcaaguucauaggggagcccuuuuaaggagaucuuuguuauaagaccuccuauauaaacugagucuucggcuugugcugcaucauggauuuguuucugggugaagggaacaaugccuuucccccaugcacucuguauuacgacaaacauuaggagcuaccuuggccuaugaggcugggaaugacaaagagccaggaaggauuauuccuauagccuuagaaguauccuuucccccagaugaaccacaaucucacacaaauauauacacuccacugggguuggggcuaacauaaagagucacaccagccuucuguuugccucagcccaagcaagaagcaccaacccguuagaaaugagucucuucaucuguguaugaaaaacuugcucauuauaugccugaaaguugaauuagacacucaauuuucagacacauuuuuaaaaauccauuuuuuaaugcuuguaucugaauuuaacccugaucuucgguacuccaacuuugggauuucauggugaagguaggaaaaugagagauguaauauaauuauuuugacaacacacacagaaaaaaaaaucacuacauuuucacaucaaaaaaugccaguaaggccauaaucuugcaauaaauaaacacaaaauuagcuauauuuaaaacuccccauuuuguccuuaauuuuuuucaucucacaguugaccacaggaaacuuaagaguuuaacaaugaggaaccaaugaguaagacuguugugauggccaaacaggaacuaaaaauguuaccaggaacaaaagaauuuaggcuucaagaaagcaaagaccauauauguucauuucuuucuagcucuuuauaggaggguuuucuguuuucuuuuuuuuuuucccaaggggcacaguccugcucugucacccagacagagugguggugcagugguguaagcauagcucacugcagccucaaacuccuggguucaagagauccuccugccucaccuccugaguaggugggauuacaagcacaugucaccacaccaggcuaauuuuuauuuuuuguagagacgaguggggugggugaggguaggggggaggugucuugcuguguugcacaggcuggucucaaacuccuggcuucaaaugaucccgucugccuugggcugccaaagaccugguauuacuggugucagccaucaugcccagccuaggaggguuuucucugaaaguaaaucagaaccuuugguugugguagaaaaugcauauaauauuauuuaacacaguugccucagcagcuuccuuucuucaccucuuacaagguuugauucucaaacuuguuaaaucucaagaccaccuuauacucuuaaaaacuacugaagaccccaaaaaucuuuuguuuauguggguuacaucuguugauaacacuaaaguuaaccaauaaaauuugugaauauuuuaaaaauaaacuaacuaaauauugacauaaauuaccuaccuauaaaaaauuuucccaaaaauauuugacaaggggggcuguuuuacauuuuugcaaaccucuuuauuaucaagcuucauauaaacuagauuucucugaucugcuucugccuuuaucuaucacaauauauuguuuugguauaugaaguauaugaagaaaagcuggcccuagauagaaaaguuacggaaaagugagguacauuuuaauauccuuuccagauaaccacagguauuauucuuugauauuauaccaaaacucagcaagugauuucuuaaagguugagagcaauguggaaaucugaaaccuauuaaugaacuuugaauaacucaaguaugauuuugucaucuggaccaggauacacuggucauuuggaaaacacugauuuauugacugacacagauacucaaaaaucacauuugcuaauguuacuaucaaucuacagugucaaacucacaguaauggguacaaguuucccaaaauucuaaaauuugcuugaaaguucaaauuuaucaccagaaacaaauaccuucauuguuuucuguaaauuaacaggcuuacuuguucauuuucaagaaaaugucuguuaaauauccaagucugaauaaccauuauuugucagucagucucaaauaaaaaugguuuccaugaagaaaggggcuuguuuuaaaacgaucuuaugcucaaagguauagauuuaauacaguuaauaacuccuacuguuucaucaaggacacuuugaagugaaacuggcuuuuuccccuacaaguacaagaaaagcaaagaauacaaugacaauuaguuguacaguuuggugccacugcuuugauuucugccaaaaagccaguauuuuacccaccacugcuuuuaaaccacagcacagaugucaaaauggugaaaaagccuccguuuuauuauaaagacaguuuugaccucagagccccuguaagacucuuggagguccacagaccacacuccgagaacugccauacucuaaaugcacagugccauuaaagugaccaauacuaaaucgacauuggggggaaaaugaguaauaauucauucuucuuacuaaaacagccacaaaugccaaccaaaauaaccuccuacuuauauaccuuuuaaaugcuucucaaauuauggauauucuuuuuaguaucccucuguggcccaagcuggagugcaauggugugaucucaacucacugcagccuccgccucccggguucuagcgauucuccugccucagccuccuaaguagcugagauuacaagcacacgccaccacgccuggcuaauuuuuguauuuuuaguagagacgggcuuucgccauguuggccaggcuggucucgaacucccgaacucaggugauccacccaccucagccucccagggauauucuuuuuaacugauagauauauuuauggggugcaugcauacaacauguacauguacacaauguguauacauguauacaauguguuaauaaucaaaucaggguaauugggauuucaccucaaacauuuaucauuugugauaagaacauuccagaucuucucuucaagcuauuuggaaacauacaacaaauuauugauaacuauagucaccauacugugcuacugaacacuagaacuuauuccuucuuaacuguauuuuuguacccguuaaccaaccugucuucauccuaccuuccccgcuaccuuucccagccuuuaguaaccaccauucuuucuacucuauaccucuaugagaucaacuuuugauauaugggaucauauaugggaugauauaugggaucauagcucccacauaugaaugagaacaugcaguuuuugucuuccugugccuggcuuauuuaacuuaauguaauguccuccuggcucauccauguuguugcaaaugacaagauuucauuauuuuuuauggcugaauaguauuccacuguauauauacaccacauuuuuaaccagucaucugcugaggggacacuuaaguuuugauucccuaucuuggcuauugugacuagugcugcgauaaacaucucuuaaauauacugauuucaauucuuuuggacauauacccagcagugggacuguuggauuauauggugguucuauuuuuuaguuuucugagcauccuccauacuguuuuccauaauggcuguacuaauuuacauucccaccaacaguauaugagaguucuccuuucuccacauuaaauuaugcauauccuuuuuuuuuaaaaaaaaaaaaaaaaaaaaaaaagacaaggucuuacuauguugcccaggccucaaacuccuggacucaaaugauccucccaccucagccuccccaguagcugagacuauggacgcauuccaccauggccagcauuggauauucucugauacuacaucaaaacucaacaagucauaguuccucaaaaauuaguuacaauguuaaaucugacgccccaucaaugaauuuuucauacuguuauaaaaaucuauuggucuaauccuguacuuugaguacacuguuuguccaugccugauucuggguuguuuguuuuuuuuuuuuuugagacggagucacggagucucgcucugucgcccaggcuggagugcaauggcacgaucucggcucacugcaaccucugcgucccugguucaagcgauucuccugccucagccuccugaguagcuggaauuacaggcaccuacgaccaugccugacuaauucuuguauuuuuaguagagacaggguuucgccuuguuggcuaggcuggucuccaacuccugaccucaugaucugucugccucggccucccaaagugcugggauuacaggugugagccacugcacccagccccugaaucuguucagauuauaaaaugguguagcagcugguuaugauggcucaugccuguaaucucaucaacucaggaggcugaggcagaaggaucucuugaguccaggaguuugagguaaaagugagcuaugaucgccccacugcacuccagccuggacacagagcuuagcaacuauaggccuccggguuugacauauaagaauuaaagaauugcuacaaguuuauuucuuuggugaaaagcaaucugaucacagucuuauacuucagauuucagcuugcacauugaucccuguuaaccaaugcucagucacaagccuuaaccacauuuuauuuaaauuugcaucaacaauuucuaaaucaguggucucacuuuucucacuuacugccuacccaaauaaaucugugccaaguagcaaacaucugacugacuuuacucuuggguuaaaugaccccaaauuacacaaaagacaaaacaaaacacagaaagacaaaacaaaagaugguuuuugugagguaaguuucaucuguuggcuucuugaaucauaguuuguaaggaggacuuacacuuuuauuaaugcuuaugaagaugauaaaugccaguuuauauauaaugcauucauguuacccuaaauaagaacauucaccuucaagaugcauucaaagaagaaaaugaaguuucuaaauaaauauuguaacuucauaaagggauauaaacuuuuuuaaugugaacuucuaacuauuccccuuaguuaucaguuuuaguugaaacugucaaaaagauuucuauuaaacucagaaaauucauguuucucuaguuugcagagaaaaaugcucugcaaacuagagaaaaauuacauuauucauggucauuucauuagcuaaacuguuaaaauguauaccuacaaccaauuucuuccucuaaccugaaaaauacucugauuagaaauucuuauauuguaccacaaauaacacuuuuccuaauuaagugaaaaggagaccaaaaucccaaacuacuggggccauuugaaagauaaacacaucucugaaaaacgaaaugcugaacacacacacacacacacacacacacacacacacaaucagucauguuccuuuuuuguuuuuguuuuuccuuuuuguggagaacggggucucgcuauauugcccaggcagcucucgaacuccugggcucaagcuguccucccaccucuugccucccugagagcugggauuacaggugugagccaccgcacccagcccagucauguaccuuuaaagcaaaaucaaucacguuauuuucagcuccguucgaaacaggaaaaggaaaagaaugcacaugccaaacaagaagaaauuugguaagaaaagauucaagauauggccuuuauacacuaauuauucuuaauaauuucauaaguccuucugucuuaccuaauuucauuuguuuaacaguaagacuauauauacauucauacaagaaucaaacuaugcuagcagauaagaccgaaagacuucuucagggcuccugaccaaaaaaguguagcauccgaccaaaauuucaagagaauauacuaggcuuucuucaccauagaccauccacauucugaauaccugugacuucauuccguaaagcaucucccaaaugcagauaauguauucaaauuacuacaaauccaauuuuaacucuacauacaaauaaaauaucucaagagauagcugauguacuucauaguauaaacacugcuauuugguaaguuauucaguccuugagaaagaacuguaaacugaaauaaaauaccugaaaugaaaucugauuucucuauagaaacaagacaaucgggguuauauuccugaucgaggaucuugaugccauuagauucuggagaguuucuuuguacgagauuuacugagauggcuucuuguugccguuuuauuaacgucaaagaugaaaucgcaguuuugcugccuuugaaauggucacuuuacguccuaagcugccauuucaucagccccaggcaucacaccuacucucuugugaggggcagcuuggugaggugugaagaguacgcuguagugucacagaaaccuggguuugauuccaucucuacugugaacuggcucuggaacuuugguagagcuuauuuuaacaucccagaggcauggaagguuucuucaucuauuaaaugcagauagaacuaccacuugucuagcagugaugcuguaaggauucaagauaauuuuguaauauaccuuggaaagagcaggcacuuaaguguucaauaaauggcagccauuuaucaauauuacugaaauguauuuuucauccuuggauagcucacuauauugcuacuucaacucugccaagcucuggcuugaagugguucucaaacuaaauagggccuuauuugauuccuaagaucugcuaggaacuugaggauccagggaaugaaagcuaagucugggaauucuuggaaaaagaaaucugugaacacacuguaacuccuuguuucuuauacacgaguuuuuauuucagcguuuuuuuuucuucuggucacuaccgucacucuaaucgcaucucucucuuccagaaggagccuguacuccaaacacaauucccuaacuaaaucauacucacaaacuacucuuuuauuuuuguuuacauaacuauucccucagccuuagaauaaccauaucccuucugaauggcacugucagaaaaaagaaagcagguacguagguagguaggugacauacagauauuagacagacugacagaauaacuauaucccuacugccuucugcacacauagcuacuagucucaggccuacacugaaacaaacugugggaaaccuuaauuuacccuucacuccagacuaaacuaggcauuucucugaauuccaauauaccuaguacauauuucccaacagcaguucuuauacucaaacuacuuguacaaucaaauaucugucucccucacugccaaacaaacucuuaaggcaagaacuauguuuuauuaauuucaaaauucccaauaccugacacauaguaaaugcuuauuuauauggaugggggagcuuaacaaacggacauucaugucuuagcucuaagcccuacacugucucaaaaugguggauuugcgacuuuuuaaaaagucuuucuuuuaaaauguuuaaacguuuaaaaaguaauuuuuggccgggcacgguggcucacaccugcaaucccagcacuuugggagaccaaggcagacagaucacuugaggccaggaauucgagaacagccuggguaacauggcaaaaccccaucuccacuaaaaauacaaaaauuagucaggggugguggugcacaccagugaucccagcuacuugggaggcugagguacaagaaucacuugaaccugggaggcagagguugcagugagccaagauugugucccuggcacccuagcuugggcaacagagugagacucugucucaaaaaauaaaaauaaaaugaauaaaaaauaaaagugauuuuaaaacauucugcugugaccaauauuagcagacuagguuuuauaaaacacaacaaaggaauguuguccugcaaaauaaucccccauaggcuacauuauaauucaaauggugcuauaagaguaugaggaauuucugaaacucugagaauuagccccagaaagaguuuaccagacaaacaggaaaguuacucaauacuucauaguugugggauacucucccaguccucuugccuaagaagacaaucuucuuucuccucucccucucccuccccugcgguuuguaucugggcugguguuagggaaaugugcuacagggaccaaaaggaagcuggaagcaauagcaagggggaaggagagcuuaucaggaagcaaaauuacagauaaaagccuauuauagugcagagccuggcugucuaagcgccuuacauugguaacaggaaucuaacuggugaagugccuuaacaugaaaauuauaggaaguccgaucacuggaggucuuccaauggcaaguaauacaauaaaauauucuaacaccuaaugcuuaccagaauaggaauaauuggauauaaacauacacauuaaauuguuucuuugguuugggcaaucaucaacauuguagcuuucaugaaaaggcaaaauuagugccagacugguccuaccgagucaaucaaaagcccuggguuuugacucccagcucugacaccguguaaccuuggauaccucauuuaacaucucuugcucucauguucccacuucugucaaaaauuuaucuguuucacaaaguuguuuuaagaaauagguaacaucacaugcaaaaguaauguguacucucuaaaauaagagugccuaaauauggcucaucaucgaaaucccuggggaacaauuaaaaagacauauucuuaggccccauuuaaaccuacuaaaucagaaaucucuaaauacaaggcucaauaacuuauauucuggcuaaauaaauauugguauaugcaugaaauaucucuggaaggaauaauaccaaucaccuaugaggaagggaaguagaaggccaggaaacagaagagggagggaggcuuuucacuguaugccaauuuacaauuauuuauuuauuuauuuuuauuuuuugagacggagucucgcaauguugcccaggcuggagugcaguggugcaaucucagcucacugcaauuccaccucccagguucaagcaauucuccugccucagccucccaaguagcuaggauuacaggcgcccgcuaccacaccuggcuaauuuuuuuguauuuuuaguagagacaggguuucacuauguuggccaggcuggucucgaacuccugaccucgugaucugcccgccuaggcuucccaaagugcugggauuacgggcacaacuuuuuauuuuuagaccacaugaacauauuaccaacuuaaaauuuuuuuaaaaaaaugucuaugcauccacaguaauucugauggcucaacuagguuuggaacucacuacucacucuaaaacaccauaaauacacacaaggauuaaaauauucacaaaaguaggggucuguuuagggaggcaguaaguaagcauacuauuucaaguuuggagacuguugcuuaggacagcccccucuuagaaauucacaauucauacaccuccauuaagccuccaauaagcccuacaaugaaaaggccuguuuaugcuuaaucuuaugcuucccaaguugaagcugaacauggaacacucgcuaguaagaucuuggggaaccagaggacacugguuugagagcuaagguuccugaaguagagcaagucuuagucaucucuacccuagaacccaagagaguguaucuagaacauagaaaccuccuccaaaaggcacagcucaacagugacaaacugcuuuuccugucuuuucucuucgucuaaaaaugguuucccaauuuccuuauuguuuaaucaacugaaaggauuuuuuaaagagcauaauaauccacugugccuaaaaucauaucguuaaaaaauguacaauacuggccaggcgugguggcucacgccuguaaucccagcacuuugggaggcugaggcagguggaucaugaggucaggagauugaggccaugcuggccaacauggugaaauccugucucuauuaaaaauacaaaaauuagccgggcauuguuggacgcgccuauagucccagcuacucaggaggcuaaggcagaagaaucgcuggaacccaggaggcagaggucgcagcgagcagagaucgcgccacugcacuucagccugggcaacaaagcgagacucuuaucucacaaaaaaaaaaagguaaaauaccuacagcccaaauaaauguuuucaacccaaauauggcaguaggcauuuuuauuccuuuaagugugaaaauaaaagaucuuuaugauucaaaagcgccuuguuuuaggagacagcaauagauuucaguauuguuuuuccuucuccaauauaagcagacccugcugggcaucuuuauucccauuaagccagacuaaucaagugagcuguacaaucaaaccacuugacaaccucauuuuuuacugaaaaccuacagaucugcauaaucagaaugggucuaaaggcuauaucaaauggcucuuugaagucugcaccuacuucaaugcacucuaaugggucucuaaucuagaaacccuuccuucaacuaucuaaaccaaagcagucaaacaaaugucaucaaaauuaaaaaaaacugccauagccaaauuuaaggacucuaucauuguguuuugucacuauggagcacaaauuaacauaaaugauuccucucugugugguaucacaacuaccacaauaaaggcuugguuuuagucuucaaggauccaccagaaaaugcuuccaguucuuugucuuauaauaaauauuagguugguacaaaaguaauugcaguuuugccauuaaaauugcaagaaccaggucgggugcgguggcucacaccuguaaucccaccacuuugggaggccgagguggguggaucacuugaggucagaaguuccagaccagccgggccaacauggugaaaucccgucucuacuaaaaauacaaaaauuagccgggugugguggcgcacgccuguaaucccagcuaccagggaggcugaggcaggaaaaucacuugaacucaggaggcggagguugcagugagccaagaucgcgccacugcacuccagccugggugacaagagugaaacuuggucuugaaaaaaggaggaaaaaaaaaaaaaaaaaaauugcaagaaccgcaauuacuuuugcaccaaccuaauaacucaauguacgcugacucaacagacucaacaagcgguuccagacuaauauuuuaguuuacugacuuaguuuacagccuaauauuuuaguuuacagacuaauauuacugaccaaguaacaucucaccccaucucaacgcccacucucaucuucucccaguagauacagggggguuagggguagcggugggggacaacuuggccuuuuagauagugcauggauaugacaguaagagagcuaaucuugggaaagacuaugaagaagagcugccuaccuuccagucccuaauuaucuuccccaauacugcugccuuuuuugccgugcuuuuuuuuuuuuuuaaaaaugccuggaaaucacuugcuaguuacagagauacaucucaaagcauaacaaguuuauugguaucaucagcuaccuccucucucgguuucugaaaggggaagaugguggaggagugaguagggguauaugcgaacacuaaacucaucuccagccagaugcucuuuguaacugccaccaucucaaaccuguccuaguaauuaaucacuauguuaggagaacacaaauguuuguaaaacgcggucgccaucaucauagcuacaauacagcaguguagcccuccuguuuucuacaaaaauaacuggcaucuauuuaauacuucgguguguauaaaaacagaaaacaaaccuaacaaaauggaggcagucuuauuagaauauuaucaauaaauaauauugccauaauauugucauaauaagugucaauucacacuuggaccauacaguuccuuugucccagacuaaauucucuauaccuccuucuuacccugaccacuccaccaacccugauugucgacagucaguguaaaaaccauucuacagaugugguugguccuguuaucuccacuuucucuccuuuccaucaaaagcugaaaaaagugaguaaaacuaaaacaaaaaggaaaaaaauauaagaaacacuucuuaacaaguauuuacugaauauuaugugcagauaugcaaaccaguagagugaaagaauggcugaaguagagaugaugcauugaguucacccugaggaagacuucuccuacucuaaauauguagcuaugaaaggcaacuguaaaaaagagaaaaccaaaagacaaagcugagaugagauacaagaugaguaucuccacacaagaaaaacagaguaaaagagacugggugccagagcuggguucauccuagaagccaguuaggcccacauuuuuaguagaaaacuucguaacugaaaauuuuaacaguaaccauuaaaauaauggaaauauagucuaugacuuucgaaucaagagggagggaaaaaaaggagugcagaaaacuaaccaucuaacagaagaggaaaaaaacagcaaagaggccgggcgcgguggcucaggccuguaaucccagcacuuugggaggccaaggcaggcacaucacuugaggucaggaguucgagaccagccugaccaacaugguaaaaccccauccauacuaaaaauacaaauauuagccacacauggugguacacgccuguagucccagcuacucgggagauugacacaggacaaucacuugaaccugggaggcugagacugcagggaaccaagaucgugcaacuccagccugggcaacaaagcuagacucaaaaaaaaaaaaaaaacaaaaacaaaaacaaaacacacacacagcaaaguaaauggaucagaaaauauaaaauucagagagcagaaauaagucuacuuauucaaauagauuaaucucacauauuacaagucaaagauuaaggggaaaaaagucagguaucaguagcgaaaaagcauuaauagggauagagacuauauuacaauaaaaggaacaaacuacaaagaacauugaauaauguucaugaaucugaaaguuucuaacacacagccucaacaauguauauaacaaaaacugaccauuugagaagcugucaacucugaugaaaaauuuaacaugcuuuuuuuuuuuuuuuuuuuuuuuggacauaggaucucccuauguugcccaggcuggucuuaaaugauccuuccaccucagccucccaaguagcugggacuacaggcaagcaccaacaugcucagcagagaaaguuaacauauacuucuguauuagucuguuuucacacugcuauaaagacauacccgaugcuggguaauuuauaaagaaaagagguuuaauucauucauaguuccacauggcuggggaagccucaggaaacuuacaauuauggcagaaggggaagagacaagucuuccauugcagcuggagagagaaagcaaacgagaacagggaaaacugccuuauaaaccaaucagcucucgaccaggcaugguggcucaugccuguaaucugagcacuuugggaggccaaggcagguguuaucacuugaggccaggaguucaagaccagccuggucaacauggugaaaccccguuucuaugaaaaauacaaaaaucagccagacaugguggugugcgccuauaaucccagcuacuaggaaggcugaggcaugagaaucacuugagcccaggaggcagaguuugcaaucagcugagaccccaccacugcaccacucugccugggugacagagcaggaccuugucucaaacgaacaaacaaaaccaucagaucucaugagaacucacuaucacaagaacagcagcaugggggaaaccacccccaugauccaaucaccucccaucgugucccucccuugacauguggggauuauggggaucacaauucaagaugagaagccauauccacuucuaucagauacugacaguucaagcagacaaaauuaucaguaaaaggcagaaacacugacaaagaacauuaauaaccuuucucuaacgaauauacagaaaccuaccuccaaagugaggagucacagauuuuuuuuuuaagguauaaagcauguaucucugacuucugaauuuaacagauaagugaaacuuccuucaaauuauaagaacaaauauaauuuuaccaacuuuucauuuuuucaaaugagauucagaaaagaacaacuacuauuacuaacauuuaagaaaagaugguuuuuaaauuuaaaaaagucaaaaaagaaaaaaggcaaucuaaaauaaaagcuuuuucucacuaaucauggacugugaagauuuucuuagaaaauggcaccacagcaaagaauuguacaguucaauauuucuuaacuuuuuugaucucaggaaaaagaaacauacagauauuuccauuuaauagugagucuuugguauaacaguuuccuuguuuuacauuugagaaaacaagugacuacagaggugaagugauuuacuuguaguuacucaguuaagaggaaagugggaaagaaggcaugagacaaaaccuucccucuauccuugccaucaugccacaccugccacggguccaauucaauuaacaaauacuuccugaauucccacaguauaagguuuuacaagaaauaaaaugaacuguaaaauacagcaugggaggaggucagggagaggagaccaacagaaucaccuguggagggggcgucucuacauacucgggaauaccacccuuaauagugggccacaguuacagaauacaguguaaccuacccaucaggaagccuaaacuucaggaaaaaaggaaagcugagaaccacugauucaaauccauacaucucaaguaguuuauaaucuacuugugaaagcaaaguaaguagaaaaacauuucaaaaaaggaaauauaacacaaggguagagagagacacacacaaaaagaaaacacaaacccugauuacagugacuuuagaauaauuuuuuuaaagccugaagaucaacagaagccucgcaaaauuaaaucuugaguaaggcuugagugcacuuugauaaguuaguuaaaugugcauauccugggauacucauuuucaggaggaaaauguagaguuauugcaaagacaaaagcaggcuuuaagucucuccuugagagcaaacaggaccacagccaagaaccacagauacaugagcagagauuaugagaaaagugugugugcuaaagagaaaaucacauuaaaacacacacacacacacacacacacacacacacacacagagacacacacacuggguauggagaaguuguguauucagagaaaacaggaauaauuuuccugcauguaacuucuaguuaaguguauguguaucucaaauaccuccugcaauuccacuaagaugaaaaauuuugaaaaacaaauuaauuuuaaaguuacagggacaaagagaaagacgaggcuagugcauucaacaaauuuuggaagcuggaaagccgacagacaaguggccagugaguucacgacaagagaaaacuuuucaaccuaaacccuacgugguaggaggaagccgaaaaugaacaggucaauuuuuaggaauuggaggcaucacauuccucugaagccugaggguaacgcaaaacaggaacuguuggaaauuagcauaaggaaauuagcauaaggaaauuagcauuaguuaaaccccuagcuccccacccucuagacaggagacugcuccccuuccagaggcuaaacauuuccuacuuagcaaaauucagccagaguacuaauagccugggaauacacccagaaucggcgugggagggagaaggggugucagagaccagaagaaaaagugaaagcugucugcugaaaucaguaaucagcccccaucccagaaugcuuacagccacgcucuuaccugccaggauuccucuuuggggaaaccagcccaacaagaaaaauauauauauuuaacagaauauuuuuuaagaaguuggucucauggaaaacagggcagaaaagaaaaucacaguagcuaugaaguugucauacauccaaccaccaggaauuccaaaaagagaaaaaugauaaaauggauggggagggaaaaguauuaaagaaauaacaagaaaaacuuccugaaugacacgagcuuccagaauaaaaggacccaugaaauauuuggacccaaaauacaaugaaugaguaaaggaccuacaucaagguacaucagugugaaauuucucaacacaagggacuaaaggaagacccuaaaauaucucagggcaugaguucauaaggcauaggguuagggagaugucaagcagaaagaaucaaaacagcacugaacuccucaaaagggauacuggaagcuaugaaacaaugauguaaugccuucaaaauuuugaggaaaaauuauucccaaccagaaaucauauaucuagccaauacaauguacagccaaaaaauaaauuugcuuucaucuuaauaaaccaaaaaaauggcauaucaacaagaguagggacaagccuuuuugaaaacgacacagaacuuucuaaacaaucaaaauagauccaaaauuccuuaaaaugucacugaaacaguuaaccgaaaaaaacaaacacaaaaaaaucaauccugccuuuuuggaugaagagcucacuaguccaacuaacuuuacagcaaugauucucaucuuuucuucaaaggugauagaauauuaaagguauuauuuguguuuaaaauguauaugggcaauuuuaaucaucuuucaauauuuuaaagguuaguauacauuaacagaaaucuucaggagugcccuaaagaucugaacuguggcugggcaugauggcuuacgccuguaaucccagcacucagggaggccaaggcaggaggaacacagaguccaugaguuugagacuaaugugggcaacauaaugagaccccgucucuacaaaaaauuuaaaaauuagcugggcauggugguacaugccuauagucacagcuacuuggugggcagguggaagagaggagcuugaggcgaagaagagcaaggaacagagcaaagaccaaaauaaaacacacacacacaaauuuagggacaagucucuuuaaaaaccaaaagagcucugcugagcugcaaaggaguuccaaguuccaccugaaaccagcaagucuaaaagggccuugaccuuacuucucuaaacucucuuacuaguuucucaaguuauuggcuugaccagacaagcaagaaaaacucuaaccauaacaaucaagaccuaaaggccugaccuuuaaacuaaaucaagagcuuuaaucugaaauaccaacaaaggguuacugagucccucaacacauaccaaaaaauaauuugaaacagaaauucauuugaaugauggcaagguuuacuuaagacauuggcaucaacaggguauuacagcacauaauaugcuuaguacagagccuaguacaaaauguuagcugcuccugcuguuucuuccaucaccauuucugacugaaagaaaaacuguuaaaugagacgcguaaaaaggaauuuggggaugcagaaaugcuguuauuacaacugcuacuacuuauaaucaguaccacuuuggaugaagagaucaaaggugaauccaaguaucuaucauuacaccccaauaaaaaauaagcacugaaagacauucaaaauagaucucauaacuaacucaauaccuggacauaacugaaguucauguauaaauuguucuguauuucauacuuacuguaaaaauaaugugaagcauggaaucuaucaaauuccugguuaucucaacuucuccaaauuacauuuagaauuaccucuaucccacccaagugaccuaucaaaaauaccuacaaaaaguauaauuaagguaccacaguccaguaagcacuuccucuuuugaccucuuccagaauuucuugacucuguuuuuuuuuuuuuuuugagacaggucucacuguguugcccagucuggaguguaguggcuauucacagacacgaucaugaugcacuacagccucaaacucucaaacuccuggguuccagugauccuuccaccucagccuucccuaguagcugggacuacaggaacaagcuacugcacccagcuaaucccauucaauuuuccaauuaaucacuuacugcuuugaagugucaucucugauacugcuauucuaccuuuuacauuucuauuuucccaacuauauaguaagcuuacccuuaaggauaaguaaggccuguaauuuuuugcacauccaggcauuuuguacaaaguagguacuguguggauugacuaaagauacuagaaucuuacacaaaaccacagacuaguuaacuguucacaaacuuucucacccaaacacauaaaagauagaaacaauucagugucacuaugguaaugauaugauucuaauaugaugugcauaguccaccaucucacacccuagcauguaaggauggagaagcaagagcuucauaaauagguaauggcauacuggcuucaaaaaugaacaguggucccuguuucaauauucaaauggagaccaggugcagugacucacgccuguaaucccuacacucugggaggccaaggcggguggaucaccugaggucaggagcuugagaccagccuggccaauaugaugaaaccccgucucuacuaaaaacacaaaaauuagcuggguguggugaugcacgccuguaauccuaacuaccugggaggcugaggcaggagaaucguuugaccccaggaggcaaagguugcaguuagucgaucacagcacugcacuccagccagggcgacagagcaagacuccaucucaaaaaaagaaaaaaagaaaaaugagcacggagacugucacuuuauacauagucuccucuccuccaucaaaccccaugcaaaagggaagaaaagauacaugauagugaaccuguccucugccaacagguuaaaauuuuaauacaguuuuuuaaaaaauuaacguagacaaaagguaacaguuaauguacuguuuuuaaaggcuggagcacaguccuuuacuaugacauucuguuuuuaucuacaaauauuuaaaacuuuaguucauauaggccgggcgcgguggcucaugccuguaaucccagcacuuugggaggccgaggcaggcggaucacaaggucaggaguuugagaccagccuggccaauauggugaaacccugucucuacuaaaaauacaaaaauuagccuggugugguggcgggcaccuguagucccagcuacucaggaggcugaggcaggagaacugcuugaacccaggaggcgaaguuugcagugagccgauaucacgccacugcacuccagcugggugacagagcaagacuccgucucaaaaaaaaaaaaaaaaaagaccuguacucagggacccaccacuacacagcuguacagcaagggaaccacaguaccuccuucaacucaaauugcuuccccaacaacauugucaggauguuaaauaaaacaauguuuggaaaacacagugcuucaugcguaguaacaaugcuaaauauaacacuuaaaaugugcaaaccucaugauuuaccuaaucagccucuaaauauuauauaauucuagcccagaaacuuacauuccucggucuccaaagggagaccuccacaaaacaauaauuuacuauaaugucaguuucuaucagcauuucacauaaucacauaaauaaaacuucuguaucgauuauaaaacucacaguccauuagguuuuuaaaauaucucuaauguaaaagauucuccaacauuuauaucaaaccaugauuaacaaaaaguuccuggucaggggugguggcucaugccuguaaucccagcacuuugggaggccgaagcagauggaucacuugagcccacgaguucgagaucagucugggcaacacaguaaaacccgaaaccucaccucuacuaaaaacacaaaaauuagccaggcgugguagcaugcaccuguaaucccagcuacucaagaggcugaggcaugagaaucccuugagccugggaagcagaggucacaccacggcacuccagcccaggcaacagagugagacucugucaaaaaaaaaaaaaaaaaaaaaaaauggaaggaaggaaggaaggaaggaaaagcuccucugugauacacugagcuuuguaauuuuuuagccauuguuuuugucuuggcuucaagaaaaucuaaaaacuaauucuacuuaauuugacacuucgcuaacauuucuaccaacuuucccauccagaacuuauuccuuccccucuguuagaccuaggcagacccuuaaaaacugucuagucucacauccuugucuuaugaguaacaagaaggcuuucagauauaaggccucuuuugauuagaaacaaaauaugugauguauaaaacauguguaaaacacacgcucuuuuucacauucacacaaaagauccugcaaguucaucacauauucaauaaaaacugcaaaauacccaagaaaaauggcacauaugacuaauaaccccuugaaaacugaccacaaauaauaucaaaauacucucuuaggcacagcuaugaaauaauaagcccuauuuccaauaaacuuuacaugcaaacagaugugucuucuucguauuaaucauacuggcaagcuacacauuuauuucaacaauaaugccccacacccaaaagauuuuuggaguuuuccuuuuggaaguggcauuaagauuucuuuagaaugccacuacauacccaguccccaguacaaugccugacacacaguaggcacgcaaacuauuaaaugaauacacacaauaguaguauuucagugcagacaugucucugaaaauagaaaacauucaguccuaaagcuuacuaauuaaacggaugaugaagccgagugguucuucuuuuuuucguaucagaagaguaacgugcugaugacgucauaacaagauuugaggguggcacaucucacauaugcauaugaacacccaaucaucacgcuuauaauagacuacaaaacgauccugaguagguuuuacaaaauacuauuucauagaaaauacacccugagucugagcagagucauaguaaagaacuaaucgcuagcucacauuucaaucuuuaagucucagaauacaucaaauauuucacauuuccuaaacaaugcaccuaaucaaucaacugacuguaaguaauacuagugacgucaaagaaacacauuuauauugacuugccuugugauucugaccuagaugcuuuuaagggggccucugugguguuaaaccaacugucgaguucaauaauuaucucaggaaauuguucguuaguaguuacacuuccauaauauguauuauucuguccaaugccauaaauguuaaguccuuauaauuuguuuucaaauacaugguaucagucuuuucuaaaacauucauaguacccaaaucucuuucuaaauaauuaugcuuuacuauuaucacuauucuuaacgaucacagugguuuaaaagaaaucuauaaauuauuuuauacuucuuccaucaagagguagagucuaauuacucuuccucauauauaagcuagccugaugacuugcuucuugcaaagguaaugaggcagaagugacgcugcaaaacuucuaaggcuaggucacaaaaaggaauuccagccugguuuuauuucuugggaugcaugccuuugaaacucugagcuaccauauuaaggacucuggcuaaucgaagucuccaugauaaagagacuacacagauagagaugccuaaggaaucccagcuguugcagaccccaguuguuuugagucuuuaaaugaagacacccucuacaugacuccagcauuugacugcaacuacaugagaaacauagaguaagaaccaccuaccaaguacugucaauucccagaagagauaauaauaauauaugauuguuguuucacccauuaaguuuggguugguuuacugcccagcaauaaaaaaucaggaugaugaacaaagaaagaaccucaacauuuucuugggcccuggcuccauugguauaugacuaaagacucauuuaugcuucaucuuuacuaucuuccuuaccaucuuccuuuuacugcacuacauuuaaaaaacaaauuuucuuccuauuaauauuaaggauuuuuuuuuuuuuuugagacagagucuccucugucgcucaggcuggagugcaguggcacaaucucagcucacugcaagcucugccuccuggguucacgccauucuccugccucagccucccaaguagcugggacuacaggugcccgccaccacaccuggcuaauuuuuuguauuuuuaguagagacaggguuucaccguguuagccaggauggucucgaucuccugaccucaugaucugcccgccucggccucccaaaguguugggauuacaggcgugagccaccacgcccagccaagaaggauuauuuuuuaaaaaacaaaaaaacuuucuauuaauuuacaucuaugaacuuccuucaacauuuauuucaaauacuuauuuacaaaucuauuuaaccauaggcucaucugaauaguacauguuugcucaaaauaaaagccaauccuuacguagcaucaagaagcaacacuuugggccaggcaugguggcucacgccuguaaucccaguacuuugggaaacuaaggugggcagaucacuugaggucaggaguucaagaccaacuggccaaaauggugaaaccccaucucuacuaaaaauacaaaaauuagccuagcgugguggcaggcaccuguaaucccagcuacucggaaggccgagcugagaucgugccacugcacuccagccucggcaacagcgagacucugucucaaaaaaaaaaaaaaaaaaagccacacuuuuauauauacaacugacaggccaacucucaacaaucacacccgguaauguauacugauagaauguuauuuccucaucccugcagucaggagagugcauaaggaaacaaaaguugacaaagccaaaacccucaccaaccauuaaucucuuggaaaaauggucuccgaacaucccuguaaauuuaacaagugcacaaacuggccuauugcuuccacaucuuuugaagcuaagccacugcuagucauaggauguuaaucugacaauaccauguaguccaacgcaaaauaucugcaaaaugaaguugcgaaucuugcaaaagguacaagacuucaugaggucuagggaaagcaauguugagaaauucaacaaaacguacauacacgucagugagaaacaaagaaacauauacacagaccaauuaaaagacaaugaauaucgaggcugggugugguggcucaccccuguaaucccaacaauuugggaggccgaggcgggagaaucccuagagcccaagaguuuaagaucagccuaggcaccauagugagaccccaccucuacuucagaggccaaagugggagaaucucuucagccugggagguugaugcugcagcguacagugauggugccacugcacuccauccugggcagcagagcaagaaccugucucaaagaaaagaaaacugaaagugacaauugugcuuuaacauagaaugucaacaucaaaugauuacauguagcccuuggaaaaaccacaaauauguuuguaaaaauuacuccacgauaaaauucaaaugaaaccaaaugcagcaugugaacuuugacugaacucugguuuaaaaauucccacuauuauacacagacauuuugaggacagguggagaaaaaugaauauacacugaguauuggaugauauuagggaauuuuuguuaauuuccuauaaagugugauaaugguaaaguggcuauauagaaaaagguucauacuuagacgauacaagcacaugcauuuaaaaaugaaguauuacaaugacugcaacuuucaaauaguucaaaguuauuuauauacacacauauuuugcaaauauagcaaaaucuuaguaaguuaggcaggaauaucaucacccuuacucagccaagaaguuacagaagauacauccuccuccaucuacaauccuuaggauuaaauguuuucuuauaaaagggaggggggaaauaugucagaagcauucaaaccacagcaaauccauccugaauuguagacgcugguuaaaguaaggcugagaccuacuaggucguguucccagacaguuaggcauucuaagucacaggaugagauagaaggucagcacaagauacaggucauaaagaccuugcugauaaaacagguagcaguaaagaagccagcuaaaacccaccaaaaucgagagagcaauguaagugaccucugguaauccucacugcuauacucccaacagugccaugacaguuuacaaauaccauggcaacgucaggaaguuacccuauauggucuaaaaaggggaggaacccucaguuccuaguaauugccuacccccuucccagaaaaacucaugaauaaucccuauuauuaagaucaaaaaauaacauucuaucaguauauguuaccagugugauuguugagaguuggccugucagguguauuauuuacuaggguauaugcuauuguuuagcauauaaucaagaaauaaccauaaaaauuaguaaucagcagccuuuggggacugcucugccuauggaguagccauucuccauuccuuuaccuuuuuaauaaacuugcuuucacuuaaaaaaaauuuacugaaucuagaagguacuaucuaccuucuaaaagguuauccagauaauucauuguucauucuuucaauucuucugcauauuugaaaauguuuacaauagaauacuggaaaaaacaaaaauaaaaaucucacuaaagcuacacaaacacacacacacaccucccagucaagaaucuccacuuaaggaaagccuccuaaagaaaauacaggaaaaaaaaaaagguaaaguuauaaugugcucucuuucaauguuaucaggacuauuagauaccaaaaaaaaaaaaaaacaaaaaacaaaaaacaaaaacuuccaaugcuugauucauucuuuauccuaaagaucagaauauagugacaagaacuaguuuuuauaaaaagacaggauucugcuuaguuuugaaguucaaauuaauuuaauauagauauaugcuaauguaccucaggcacuagggaugcaaaggcaacaaugagccuguuaucaggucuccccacagcucucccagaugacacucacaagcacaaacugaaggaaggcaaguuuaaagaguagcacugcaccaaagauaagaauguguaauaaaucacuuaaagauacuacaaagaauaguaguucaaugggcuuucccaucauuuucaacugauuacaauuuuuaauaagacauuucaaauagauaaaauguaugaagauuaaacgcuacauauuucaaaaguguuucaugcaacaucuugucacuagaaugugaacuccacaggggcagacauuuuugccuguuuuccugacugauguaguccaagugucuggcccaaaacaagcccucaguaaauuauuuguugacuaacaaugaaugaaugaaacuuuaagucaauuuuuuuuaaaugacuuaugggaaucuucauuuauauuuaaguuaugaugaaaauucuggucaauuuacuaggggaaaaaaagggcuuaaauuuuacuccaauuuuuuuacaaguugucuucucccaaaguuaauucugaauguaaaaacggaaacaacaggcggugguucacacuaguaaucccagcacuuugggaggccaagaugggcggaucacgaggucaagaguucgagaccagcguggccaacauggugaaaccccgucucuacuaaaaauacaaaaaauuagccacgcaugguagcacacgccaguagucccagcuacucaggaggcugaggcaggagaaucgcuugaaccugggagguggagguugcaaugagcugagaucacgccacugcaccccagucagggggacagagcaaaguuucuuuuaagaaguuucuagagccaggcaugguggcucaugccuguaaucccagcacuuugagaggcugaggaaggcggaucacuugaggccaggaguucgagaccagccuggccagcauggugaaacuccaucucuacuaaaaacacaaaaauuagccgagcaugguggcacacgccuggagucccagcugcucuggaggcugaggcacaagaauugcuugaaccagggagacggugguugcagugagccaagauccugccacugcacuccagccugggcaacagagcaagacucugucuuaaaaaauaacaauaaaaaguuucuagaggaaaaaauauuuuaggugaaacuaaauuacuauucuuuauucaaugauuuucacguucuuauuuuaggugaauaguuaaauaagcuaaaacacuuuccuagaaauuuauucuuuuucuuuuucuugagacggacucucgcccucgcccaggcuggagugcaguggcacagucggcucacugcaaccucugccucccggguucaagccauucuccugccucagcuuccugaguagcugggauuacauucgcacaccaccacgcccagcuaauuuuuguauuuuuaguagagacaggguuucaccauuuuggucaggcuggucucuuaacuccugaccucaucaucuguccgccuuggccucccaaagugcugggguuacaggcgcgagccaccgcauccggccagaauuuauucuuuuucuauuauuaaaauaauauauacucauauacagaaguauauaaaauacaaaaucauaucaagaaauaucaaaaguaaucaaccauaacccagaggcaaguauaccgucauuuuguuuuagcacuuaugaaacuuuagucuuuaccacaguuaauaucauagacuuuuucaccucuuagauagaaaaacacauugucuuuuauucagcuccgugauucuacugguuucuccaaaagaucugcaguuuuuucccaauaacagugaggcauuugaacugaaucauccauucaagcuugaucauccucauuaacaauggcaaacaccaacaacuuggcuggagagaggugaaguacauucuuuguagccacaaaaucaagcaacuugccuacauggaaaauggaauucacacuccuuagugcauugguuccauuacucuaagccuaaccaacuacauuaaccaguuauggccaauuuauggccuagcacaucuuauuuacuugaucaugauaugaccaaagucauuauugaagauaauuaacaagguauccuuuucuacaagaacauuauucaacugauuugaaacucuauguauucaucagucuaagcauucugggcuucuuuuaguuccucaaauacacagcagucucucacggucuccacaugugcuguuccuucugccuagggagcucuuccaguucuuaacaccuuguccuacguccuacauccuacagcucucccaccagccucucucagccuaccuccuuuucauucacaaucccuauucucauuuucaacacuucuucagguaagcuuuuccccugcccaagacugaacuggugcuucuagugaagaauccugaacuuucccuuuucacuguacuugucacacuguccuguaacugucucuuuuucaugaaccaaacaccaccaccagacacccaagacuagaacugacaggcagcagacgcccccaaaucuugcugaauaaacacucuuuuaaugauuucacauauaucuauuuauauauauacacacacacacacguaccuguuuacauauacacaaacacaguguauucauauuuauaauuacauauauacacaaacauacauacacacaaacaguguguguucacauuaauauauaauuacauacacacacacauagaaaaacaaguaacuuccucuacccuuuucaaaggaaaagcaauaaggcuaaguuaauguaggguggagucuuugccacuuaacuaaucuaagcacuccggcccucaguuuccucagcuauaaaauaaaauccuaaaaucguccuugguguaaaguuuugaugaaacaucucaaaacauucuauucagcagugucaagucacaagguaauaucuauuacagucuaauacacagaacaauggguuuccuggaaaacagaaguuaaaaaguuucucauugagcauguggcaguacuaggaccuaauaaacagcauuuccaaaaaacaagagcaacacucuuaauccauuagaaaucaaagguaaacaaacauuuucaaacucagaaggugauaugccaucaucaaugugcuuuugcuuuaucauauacuugauaaagcugcacuccugccugagugacagagugagacuccaugucaaaaauaaaaucaaauaaagggggaaggggugggggagcaauacagaagaccugggcauguuuuuuaagagcuccucuucaguuaaacuaaccagacggcaagagcuuagaaagcucuauuuucugcccacuacuccuaaauaccuauuagaguaaguacaaaaaaagcagaagagcaggucugaggcaggaaauaagaaucaaaccuuaaaauggcagaacuggccaacauauaucaaauguaacucauaaaacaguaucuauagcucuacagucacacagauucaaggcugaaaugaacuuucagacauuaaauacaccuccucaucuuacaaaugaguaaaaugaaacucacugcaugaaaaugacuaugugacuguuuaguggaaugaccaagccuccuaacuccaacucuacagucuuuccaguucucagagcugucuuccauagggccugucugugguagguacacaguaucuuucggauacacaguaucacucuucaaauucugcaggaauugcuugauaauuagugucaauaucauaaaacaaacuuuccaaagauagauaaaauuuuauuacaaaacuuaacagauauaucuaaauucaaauauauauauauacacacauauauauauacacacacacacacacauauauauauauauacacacacacacacacacauauauauauauauuuuuuuuuuucuugagacagagucucgcucugucaccagacuggacugcaguggcgcgaucucggcucacugcaaccuccgacuccccgguucaagcgauucuccugccucagccucccaaguagcugggauuacaggcacacgccaccaugcccagcaaauuuuuuuguauuuuuaguagagacggaguuucacuuuguuggccaggauggucucgaucuccugaccucgugaucugcccaucucggccucccuaagugcugggauuacaggcgugagccaccacgcccggccuggucucauuuuuaaguaucucugugagaacagcauuugaagaggccacauagucaaucccagccugugcacaaugagcaaaaagacucucugcaaggcucagauauccuaucuucccuccaucaaugccuauaaaccaaaauucacccagcucaagaaaacugaagaggauaaaccaguccccacauccugcaaccuagucuucaaagucuuuccuacacaaccauuagauccuucuucccuaucacuuauauaucaauuagcacuuaauuccuucuuuacaugucugucuccucaucaaacugaaagcuccaugagggcagaggccagccaucuuuguauuccaguguauacacagguuagcuggcaaaguauuuguuguacugaguuaaagaauaaaaaucuagccuggugcgguggcucacgcccguaaucccaguacuuugggaggccaaggcagauggaucaccugaggucaggagucaggaguucgagaccagccuggccaauaugccgaaaucccgucucuacuaaaaauacaaaaaauuagccaggcaugguggcgggcgccuguaaucccagcuacucgggaggcugaggcaggagaauugcuugaacccaggagguggagguugcagugagccgagauugccauugcacuccacccugggcuacaagagcgaaacucuaccacaaacaaacaaaaaaaaaucuuuuucccacuucccuuguucacuuauuuuccauucaucaacauaauuaaguaaaagaaaucauggacaaucauagauucacaguucuuucuccaaguaauucuauaauauaaaaacccuuuuccaaauauuccauguucauggauuggaagaaucaguauuguuaaaugucuauacuacccaaagcaaucuauacauucaaugcaaucucuaucaaaacaccaaugacauucuucacagaaauagaaaauacaauccuaaaauuuauauggaaccacagaagacccaaaauagccaaaguuauccugagcaaaauaacaaaauuggaggaaucacauuaccugacuucaaacuauacuacagagcuauaguaaccaaaaaagcaugguacuggcauaaaaacagacacacagaccaauggaacagaaacgagaacccaaaaacaaauccauacauuuacagugaacucauuuucaacaaaggugccaagaacauauacuggggaaaaaacagucucuucaauaaauggugcucagagaaucggauguccauaugcagaagaauaaaacuagaccucugucucucaccauacucagaaaucaaacugaaaugcauuaaacuuaaaucuaagagcucaaaguuugaaauuuccccccaaaaaacugggaaaacucuccaggacacuggacugggcaaagacuucuugaguaauacccuacaagcacaagcaacuaaaguaaaaauggacaaaugggaucacgucaaguuaaaaagcuucugcaggcugggcgugguggcucaugccuguaaucccagcacuuugggaggccaaggaggcuggaucacaaggucaggaguucaagacaagucuggccaacauggucaaacccugucucuacuaaaaauacaaaaauuagccgggcaugguggugggcgccuguaaucccagguacucgggaggcuaaggcaggagaaucacuugaacccaggagguagagguugcagugaggcgagaucgcgccacugcacucuagccugggcaacagagcaagacuccaucucaaaaaauaaaaauauaaagcucugcaaagcaaagaaaacaauccaccaagugaagagacaauacacaaaaugggagaaaauauuuacaaacuauccaccugauaagggauuaauaaugagaauaucuaaggagcucaaacaacucuacaagaaaaaaucuaauaaucuaauuaaaaaugagcaaaaggucugaauagacauuucccaaaagacauauaaauggcaaacagguauaugaugaaaaaaagcuauucccuaccacaaucacaagggcauggaaacaggaguuaaaaaaagaccaaaugaucuagcccaacucucucauuuuacaaaugaguuguaucauuuacucaaggucauaucaucauauggccaguuagugucggauacaaagaacaaauucacgauccugcuuacuccaacuuacauucuaucuaccaccacaucagacugucuaaaaauuuaaaucacuacauaauauauauuaucucaucaaauuuuuuuuuuuuuuugagacggagucucacucugucgcccaggcuagagugcaauggcgcgaucucggcuuacugcaaccuccaccucccagguucaagugauucuccugccucagccuccuaaguagcugggauuacaggugcucaccaucaugcccggcuuauuuuuguacuuuuaguaaaaagacaggguuucgccacauuggccgugcuggucucgaacuccugaccucaggugaucagccagcuucggccucccaaagugcugagauuacaggcgugagccauuaugcccagccuauaucucaucaauuuacaaucacaucuaaaaaggcaaaguuuucuuuaaacuaugucuucaaaucuauguuaucuuaaacaauuuuuggcugggugcaguggcucacaccuguaauccgaacacuuugggaggccaaagcggguggaucacgaggucaggaguucgagaccagccuggccaacauggugaaacccagucucuacuaaaauuacaaaaaauuagcugggcgugguggcaggcgccuguagucccagcuacucaggaggcugaggcaggagaauugcuugaacccaggagguggggguugcagugagccgagauggcaccgcugcacuccacccugggugacagagcaagacucugucucaaaaaaaaaaaaaaaaaaaaaucaaaaaugcacauggggaaaaugucucuaucucuaguauuuugacauggaugccaaaaauaucuggcauaauauguuaccauugaaggaaguugggugauggauccaugguaccccucuguaccaauuuugcaucuucuuuugagucuguaauuauuucaaaauaaaagguuagaaaaacaagcuaggugcaguggcacucaccuguaauccuagcuacuugucuguaaucccagcuacucaggaagcugaggcaagaggguugcuugagcccaggaguucaagaucagccuaggcaacacagcaagacccugucucaaaaaaaaagaaagguagaaaaacaauacauggcauacccaccugaugccacucccugagcucgcuaaucuauaaccucacucuucuccaagcuuucucccugagccagaaaaaguuccaaacacgucucaacccgaaguuucaggacgguuugguguggcaauugaaacacaccagcuaucccuggccuagcacacuuuuugcacaugagaagcacacaagcauuuacucaacaagaaaaacuaaucuaacacuguucucaaacucugugcaagcaauagcauggcaaauauuuacacagcccaaacucuaccucuuguagcagucuuucauagugcuacuaucuauggaugagccucauuucucccaacuagacugugaccuuacaagcaccgaaaugcauuuuaaaaagcuauccuuucaguaucucacaguuguguagaggaccuagaauuuauguaacuuaaucuaaauuuuuccaauuucgugguuaaaaaaaaagaagcgaacaaaaauaaacuacucuagcuuagagagagacacacaaaaucaaggaacaggaaaauacccuauucucaaacagacagguauaaaaccuguaagucuaaggggaaaaggaagguuggaggcagugaagaacuggcaaguuuggcccuauuugccaucaucaaucaauguuaagacaaagaaaagaggguaaaagagccuuuuuacucaguggucuucaaguuuugcugcuccugaugacgguccaucccaugagaagcacuguuuuaaaucaagagaccuccuaacugggaaaagccaccacaauccaugauuuuacuacaauuugacuagguuauguuacucauacaauaauuucaauucaacuguccgaaaaaccuucuacuuuaaaaaagcuuaaccauaucauguccccgauccccaaaaaaugcuauuaccucucaauaaugucuuaaaauugaccaaaggaagacaaagacugaaucuacaugucaauugaagaagcuuuuacauucccagagcccucugaagagcagagagacccuagagaaaagcaaaauaccaacuguccucgagucccugccacucuagaguuucaugaaaccagaaacauucagggaugguaugggguggcugcuaauuccuguacuguacuacaguacugacuccugucucugcaggcaagugucguauguacucuucaguagcucucagcucucaaaaguagcagaaagaugaacagaugccaacaaaaucaguccacaugucaucucugaccugcaaaccauggccugccaaccuacacuacagaagucacucauuucuguuucugcauccccuaggcagugacaaaauccuaccaggaaucgucucagguagcaggaauuuggguuaaucuucuauuggcgacuauaggaggcaaaaaaaaaaaaguacuucccccaaaaaacaacuacagaaacaaaaggucccacugcccauacucccccuacucaauuauucucuaaucuacauguaauaaucagaauaccugauaagcagaaaaaacacaaucacuuaaggaaaacaccuaaggauuuccuggagaugaagacaaguuuaaacaucacuagaaauauaagccuauuaagagaaugaauguuuagccaggcaugguggcucaugcuuauaauccaagcacuuugggggcugaggcaggagaaucacuugagugucagaguuugagaccagccugggcaacaugcugaaaccccaucucuaugaaaaacacaaaaauuagccaggugugguggcacgcaccuguagucccagcuacuagggaagcugaggugggagaacuaccugggccugggagauugagauugcagugagccaauauugcaucacugcacuccagccugagugacagagugagaccuugucucaaaaaaaagagaaagagaaugaauguuuauaaacuacacucacccacaauuucauaaaaaucguuugauugcugaugcuuccuuaaaagacuuaaagcaggguuuguagaggcagaugauguuacagagcaauaauuggacaaguucgaauuacuucuggacaagaaacaaagccacuacuacaacauaagagaacagauaaucagcugaacaaucuaauaccccucuccccaaagccuuccauauaaaacucuguuuucaucauuuagaaauuaaaauaacccuaccauauugucugggcuuucuuagcuuucuccaucaaauuaacuuccuaaucucaaauuuagcuuuucuuaaggcuuaaaaaaccaucuuccuccacuucucacuucauaacaaggaggcugucacggaaaacacccaaaugaauuuccaccaugucccuaaguaagagucuuggagacacaguuaaggccaucucuggaguuccagguugucugugagguagaccugguaucugaauucaaguaaagaccuggaauaccucaucgccugaauucugaacagcagauucaugcuggagcagagccaauuucuugaaacggcagguucucgacacuucuauaucacagaaauggagccugaacucauggggaagaaaauaaaaacuuaucuacugauccauucaucacagugcuuugucgacuagccacuaucaucaucuuuauaacuagcaaucuagaauacaaccauuacauuuaauggaauucuaaaauauaaucuuuuuacauauacuaguauguuuuuuaauuaacacaaaaauuugcugucaagaaaaaucuagguuuuuauuaucaguggacuuuuccuaugaaaaacauugugauaaauugaagccaagaaaaacuucaggccagccauggugucuccugccuguaaucccagcauuuugggaggccaaggugggaagacagcuugaggccaggagucugagaccagccuaggcaacacagcaagaccaugucucuaauuuuaaagaaauaaauaaggcgaggcacagugguucaugccuguaaucccagcaccuuggagaggcugagacgggauaauugcuugagcccaggaguucgagaccagccugggcaacacagagagacuccaucucuacaaaaaauuaaaaauuagccagaugugguaaugcaagccuguagucccagauacucaggaggcugaggcaggaggaucgcuugagcccagaaggucaaggcugcagugagccauguucacaucacuacacuccagccugggcaauagcgcaagagccugucucaaaaaaaauuaaaauaauaaauaaacaagaaaaaaauaaagacuagagaauagcuagaaagaguaaacuacccaaauuuauaucagcuagaaagcagauuuaaaaacugugguacagucaugaaauaaguacuacuuuuuuuguuuguuuugagacagagucucacucuguugcccaggcuggaauucaaugacacaaucuugauucacugcaaccuccaccuucccaggucaagcaaugaaaauacuacuuuuaauauaaaagaagaaacuacuacaugcugcaacacagaucuguugcaaaagcacuguucuaagcaaaagaaaacagacacaugauuccauuucuaugaaauucaaaaaggaaaagcauuacagugagagaaagcagaacaaugguugcuagguagccaggaccuagccuagggggaagugacugaaaauacaaagggaaaccagguaacuuuuuggggugaugaaaauguccuguaccuggauugugguggugauuacacaacuguacacauuugccgaaauucaucaaacuguacaccuaaaauggguuaauuuuacugaauguaaaguauaacucaauaaagaugaaagagucaaagacauuuuauuaagugauacugucagaaauugaacaaauaacaguacuuuagcugugcaaguaacauaaauuguguauuuacaaguaaaauaacauuaaauauuaauaccuucuuuaauauccugacaaaaugacaauguuacaaagcaugguuaucuaagaauuuaucguauuucuaauuuggaagggguuuuguuaccacuacacugauugucucaagaaaguaauaagaaauaugaucucagagaauaauuucuuauagccaaguucaauugacuaauaccucaccugucuauuaguucaugaaaaugcugcaaacuuuucacaugacaaucuuauuucucaaagugaccccauggaaaaaucacugaauuucaagaauccugucuuaucauccuuaucuaacaauuacaagugacugcugacaaaaaaugcugucauaccggagguuaagaaguuauagcacugaggccuggcacaguggcucacgccuguaaucccaacacccugggaggcuaaggcaggugaacaccugaggucgggaguucgagaccagccugaccaacauggucaaaccccgucuccacuaaaaauacaaaauuagccaggcgugguggcucacaccuauaaucucagccacuugggaagcugaggcaggagaaucacuugaacccgggaggcggaaguugcagugagcagagaucacgccacugcacucgagccugggcaacaagagcgaaacuccaucucaaaaaaaaaaaaaaaaaaaaaaaguuacagcacugagcuuuaaggaacuaaauaauuccccaguggccccuucuucuaagguuacaauccaaauucuaagguuauucuacaaaugucaaauuuuuuaacauguuagaacccaaucagcuuuauuaaguaaaauuaucaaaauugucaaucagaaauaagcauuuaugagacaacaggaaaaucugggcaauuuuguuauuaagguuuuuucagguuuuuuuuuaaaggcuucauauuuugaaauauauagugaagauacagcaauuaaauuaccugauagaggagaauaaauggggagagaguugaaaucagauuggccaugaguugacaacuguuaagacugugugaugggaacaugguuguucaucauacuauucucucuacucuuguauaugcuuaaaauuuuccaaaauaaaaggcuuaaaaauaauacucaggggaaaacuuaaaaaccaguucuaaaaauaaaccaacaauucauaaccacagugagccaagagaagaggcuauuuucacaugaccagaaugccaaggagucaaaaugacagaaacauggaugcuaacuagagucuguuuucuuaauuagaaauauguauaauaugggcgagcgcaguggcucccgccuguaaucccaacacuuugggaggccuaggugggcagaucacgaggucaggaguucaagaccagcgugaucaacacggugaaaccccaucucuacuaaaaauacaaaaauuagccagguaugguggcgugcgccuguacucccagcuacucaggaggcugaggcagcagaaucgcuugaacccgggaggcggagguugcagugagccaagauugugccaaaauggcaccacugcauuccagcgugggcaagagcgagacucaaaaaacaaaauaaauauguaugauaaaaugagggaggggagacauuaaguacauccuccuguaacauaaaauugcuuccuuuaauauaccuuauaagaucuacguccauguaacucagucuucagcaauuaaauuuuccuuuggaaacuauuuccuaaauaaccuaauggucuaauuguuaggggaaaaaacccugaccuuuccuaauuucaccuauuauuccuagucguauuccuguguauccuguaauuuucuucacaagugucuguuuauuccuaggccuaugauucagucacagauauccugauuuauaaaauugcucugccuuuguuuugauuuucuauuuugcuuggcuauucuacacccugcuguuaaucuuacuuaagcaaauucauuuaaacauuuuaguuaggccagacuguacuuuuccaauacaauaaaucuaguauugguuuuuuauuguuuguuuuugguuuuguuuuuguuuuugagauggagucucgcucugucacccaagcuggagugcaguggcgcaaucuuggcucacugcaaccuccaccucccagguucaagcaauucuccugccucagccucuugaguagcugcaacuacaggcaugcaccaccaugcccagcuaauuuuuguauuuuuaguagagaugggguuucaccauguuggccaggcuggucucaaacuucugaccucagaugauccgcccaccucagccucccaaagugcugggauuacaggcaugagccaccgcaccuggcauaaugcauuuaguauugcuuuuagguaacaaucucaauaaucaaauggugagauuuuucacugauuugguaauaugaugcuccaucccacacaaccuaaugucugggggguuuuuuuauugauuuuuuuguuuuuuuguuuuuuggugcaccacaauaaaauuucaagcagcuuucaacuauuauaaccucuacucaccacaaccuuuguuaugcuucauauaaucccuggcauauuuucuggcuccuacugagugaagauaugccugagucuuuaaaaccucaaaguucuuaauaaacauaaugagcacucacugaaugccaagacuugugcaaaaacacacuuucuaugccaacacuauccaagagaacuuucagugaugauggcacugcucuguauuugcacuguccaaugugguagugaguagcuacguggcacuacagugcacuuaaaaugugacuagcuacagaugaagugacuuaaauuuuuauuuaauuuuaaucaaucuuaauuaauuuuuuuuuccuuuuuuuugagacagagucuugcucugucgcccaggcuggagugcaguggcgcgaucuuggcucacugcaaccucugccucacgggcucaagcucugucucacaggcacaagcaauucuccugccucaaccucuugaguagcugggauuacaggcguccaccaccacacccagcuaauuuuuguauuuuuaguagagaugggguuucaccauguuggccaggcuaaggggucucgaacuccugaccucaagugauucgcccgccucagccacccaaagugcugggauuacaggcaugagccacuggccgggccuuaaucuuaauuuaaacagucauguuuuaaaaauuaagaauauauauugcggccagguacauuggcucaugccuguaaucccagcauuuugguaggcugaggcagauggaucaccugagguuagguucaagagcagccuagccaacaugacgaaaccccaucucuacuaaaaauacaaaaauuagccagacauagugguaugcgucuguaacuugggaggcugaggaaggagaaucgcuugaacccaggagguggacguugcauugagccgagauccggccacugccuccagccuaggagacaaagcaaaacugugucucaaaaaagaaaaaaaaaaagaacguauauugcuugaaauauucuucauaaaagucauuuucacuuauuuuuacaaccaaaugcauugaagaucaucuaggaugggcuuccuuaaccuuagcacaacugacauuuuggaccccguaauucuuuguugugggggcuauccuaugcauuauaggauguuuagcagcaucucuggccuccauccacuagaggccaguagcaaugccccagcugugacaauaaaaaaugucuccagacacugcccaauaaggggaggggguuguguguggagggugcaaaaucacaccaagcugagaaguacuaaucuagaacuaagagucgauucugcucugaaugcuaaggauauucuagggcaacucuuuugaguuccugcuuugcuaucuggaaaccaggcaacacguaaaaaguuaaaaguaaccaucucuucguaauguuuuccguagaauccacauuauaauauugaucuuuucccaucuacugucucaacuguuccucccugaccuugaggagagugcuacaccuaauucagagauugaugugggggguucuaagagguuaaaugacuaggcuaccagcgcagaguuugaaacuccugucuauaguaucuuaccuuguguuaugacaccugaaagggaaacucuaagcuuagagaaaaauccuuuugauaugacaaucucaauaaagacuguuuaugacugcacaauacguuguaaugccaaaaggcaaaucucacaggaaaauuccacauacagacaagcaauaagaacugguuuguuucguaacuaaccugcaucuugaggaauaauucaggacaaggacaauaaaugccauaaccacaucaccuuaagaagaccuauccuaaccuaguaccaagaaaagguuaagagcgucagccucugaaaaaaaggcauaaacccauuaggagcccuggaaagagcaguugaggggaaaacggaaucaaaacacuaagacagguggccacacugccugaaggcugggaugucugagacagcagaaccauucuggaauacaagccacgugaaguggaauggagcccuggacuuuaaagaaaagucagaagacccaucagguggaccucagcugucucucaguaguuguaucccugcauaaacacuguaaaucucugugccuauuuuuucagcucauuagugaggcacuuuccaggcuauuagugaggcaggccuuucagcucuccccucaagcucgacgaaccacauucuuuauauuguuuuacuguuucucugagacaauguuuuaagcaggaacguaguacuaacucaagaaauccauuggaaaggagaucaaaauguccaaaguaucugagcacugaaugguuucaauucagcucaaugaauauuugcuugagggcccagcauucugugccaggcaccuuguaaucauucugggaagucacagccaacauccucuucuuuccaccccagccauccccaccuguauuugucaauuucauccuggcaucauuauuauucauuauuggcaagucugaaaacacaaauuaugaaaaaaagauacuuuuuuaugcuuuguacauuuuagacacuugagacaucagacuaugaugcugaacaaaauauuugacuuuuuaagaggauguggguaaagaaagaaaacguauuugaagaaaacacuacuguuuugaggaccaaguuuucuucagcugagcaauuuauuugcaguaccauucugccugucuaaucuuacuacuuuuauuccaaaguauaaagucuauuuacacccuuuucauacauaacuaugauuaucauuuuauuugugacucucauacauuucucauaauaaaaaaagucaagcuacaguagcaguagcuuuuuuauugccccaacuuacuaaaacuugguaaaguuuuuaucuuuagaugaaaauacgcuuauucuaguuaauuaaaagguuccagaaaaccagucucuuuuggaaacagauuuuucucaagugacagguugauccuauuacaaguagguaugcaaaaaggagcccuccuuuugaaagggaaacacagaacagcuccugccacaaaucagcuacuucaaaacuuaggauaugugccuaucuuaaaugcugccuucacaaaucucaaaaggcaagacauguuuaccgcuacuagauacaaccauauagcucuuuauaauuucaccuacggcaccuuucuauuuuucaaauaucugccaccuugaugcacauguuaugacucaagucuacuuuuuuccuaauuucaugaaauuaaaagucacuaugaucuaaauauuuuuaauguuguauaaugauagaagaaucaaacaaagcugauuguuuauacuaggaauggaaaaagaagaguuagcauuuaaaaagauacauuacuuguaaauuucucaaauagcugaagcaaaaggaaugcucaaaaaugaaucaaagugcccaacacaaccgcaaaauagguuuuggcaugcacagccaacugaguaagcuagucagguuucuugguacauaaaguuaggacuaauauagaaaacaugcccuaccucucuucucucuggugcgguuuucuaaguaacaagacaagcacuaccaacaugguucuguuaaugaccguagagcuauccucacuacuagccuguuucuaaauuuuaccaaaaaauuuuauguuaaugucuccaaaagaucuuuaaugaaguaaagucaggcuaagaaccacauaacaaaauguuaaauaacuaaaaaguuauuucagaauuuaaaggaacuaugugacaacucugaguaguuaguauuuucaguaaguauuucaaaagauucccaaacauguuaaauacaauauggcuacagcaaagauuaggcaaauccgaaccaagugcagaaacuaaaccgccagcucuggauuuaaaagcugucugcuccacuugaggcgguuagauacacugacacaagaggccaguaucucagcagcaaguuaggccucuuccucccucugggaagcgcaugacaaacagggcaucaugcaacuuaagucacccggucacuuagcaaaaauucuauguaacuucuaaacuugggaccagauggccuucuauacgcaaaagaaauguagagagcagugaaguacugggagagaggaagacuuaaaaugcuccacuuugugauccuguaaacauuuagcccaucauuagaucugagucuuagauucuaagacaugcuuuaauggaggccucccucaaccuccugagucuguuuuccaacagugaaggaacuuuuccugccuuaucucaguucccugagagcaugcggcacugcaauucaauauccuaaacuggcaaggaacgguggcggaagaaaaggagaaauccaaaccaaaacagccuauaaaagacaaaacauaaaauaaaaucauaauucauccuccgcccauagcaaacccaacccagaaauuuacagcguguuaagaaaagcagcauugcgaacugcaaacguaagaguuuuccuuugacacucuacgcacgguuuucagcugucaaauuacaacucaggaaaacacuaucauuagaauagaaaaggaaacaaaaaagcucgcaccacaggggcuaguagcaggagcugccagcaccauuucaggaggagaguaaagggaauccaaugcacuuccccacccccgcuugaauccauccccucccggggcaggcaaaccucacugcaggggcucaaauuuaauaauaauaacaauaaucauggcgcuuccucccucacucccucccccaacuaucaccuuccccccaccccccgcccgcucccagcaaucugccgggaaucggcuucucuccccaacccgaccccgggauccccagguccagaccaccccaccggacacagcugccgggggcccgggacaagcccagcccagcccaccccggggccccuggccccgcuucuccucuucccucucuuuuuaccuccaccaucccccauccgcauugucugucucaauucaacuuugacuaauauggauuccucgggccuuggccgggcaguaauuaccgccugccccccgggagccagaaaccacccccccaucuccgccgaguucaacgccgcuccuugcgggagggggaaggggguuuacagagcgcucuccagucuacaccgcgagucccgucuacaccgcgcuccccccgcggcccccugcccccgggaugagaaguuugccccggaaggagccuagcaggaggcaguaaggacccccgcaccccaccccagcuggccggccggcgcguaaacacccgcacccgcccggcacggcccgugggggaggggagggagggaagggcgccccuccccccgcgcccgccgacccgccagcccuauuaccugucauugagcugguccucggugcccggcagcgggugaaccacgaaauggauggacgucauggugcuuuccuucucguccuccacucgagggcggcccccucccgcucucgcccgccccccagcccucuaccccuccccaaaacccacagccgccgccgccucccaguccccaaauggagggaagcaaauacgcaggggccgccgccgccucccugccgggcguguguccgcggcccggaggggcgggcaggagggcgaauccacacgccacccgcucccccggcgacagcgcggagugcgaggcaggcggccgggaccaggggcgcgccgccggccagcggcagacgggcguugggagaggggcggccgggggaggagaggggcggcugcuggcugcgggcuacggggacggucuggucccggcggcggacgggguccggacuaggggaggugaggaaggaggggaaggagaugagcccgcaccgcgcgucacuagcgagaagcugccgccgccaucuucacuucugccccaguuucuccgucucgcaggcu

SEQ ID NO: 17755 - RNA, 677 nt, Homo sapiens
caugagcucccagauucgucagaauuauuccacugacguggacgcagccgucaacagccuggucaauuuguaccugcaggccuccuacaccuaccucucucugggcuucuauuucgacggcgaucauguggcucuggaaggcgugagccacuucuuccgcgaauuggcugaggaaaagugcaagggcuacgagcgucuccugaagaugcaaaaccagcguggcagccgugcucucuuccaggacaucaagaagccagcugaagaugagugggguaagaccccggacaccaugaaagccgccauggccccggagagaaaacugaaucaggcucuuuuggaucuucaugcccuggguucugcucgcacggacccccaucucugugacuuccuggagagucacuuccuagaugaguaagugaaguucaucaagaagaugggugaccaccugaccacccuccacaggcuggccggcccggaggcugggcugggcgaguaacucuucgaaagacacucucucaagcaggacuaagagccuucugagcccagcgacuucugaagggccccuugcaaaguaacagggccucugccuaagccucucccuccagccacuaggcagcuuucuuaacuacccuaacaagccuuggaucaaauggaaauaaagcuuuuugaugcaaaaa

SEQ ID NO: 17756 - RNA, 11479 nt, Homo sapiens
ggcccuccgcagugccugggcgcgcugcagucgccgcgccuccccggccgcggcaccgccucucuaggcaggggcgggggacgaggggcaaggagugggcgaggggugggcgaggggcggggggcgucacucaaucagguggccucuggaguuccccggggcagggcagagggaacacgcugccggggauuguguacacgcuccacugacaccagcuucacgcugccgggcagucgccgaucacgcguggccccgcgagcccauuggccggcgccucacacaccuuugccguugauuggccggccucaggcuccgcccccacccccgcccgcggcgcggggcaggcugagcggcuaccugaauggggagggggcagacggcgcugagcgcggcggcggcgggagcggcgucgagugucuccgugcgcccgucuguggccaagcagccagcagccuagcagccagucagcuugccgccggcggccaagcagccaaccaugcucaacuucggugccucucuccagcagacugcgguaagucauuuggggaugccccugugcuuccucgccuggucuugucuggggggccaaagggggcgcgaaccccgagccccggacaucagccaugccugagaauuggggcugcagcggagucguggggaaggaaagggcuuccugccugcagacuaugggcauuagugagggcguguguguucgggagggggucgaaccagggggcugggaucuucagacagggacaggggucuugcucuagauguacugaggggaagggacaacuccgcauggagacccgagagggcuggugaggaggaggaugacgagcgggggaggaguggggagggggccguugcccugcagcgagguugggguacaguguggaacgagagucgcgggagggacaagggggcuacccucaccugguaccgaggagagaugcccggucuggcucaggaacgcgagccaggggaggaaggggcugcucgcaagcacucgggaggcgggguguccacaggagaggcgagugggcuacccauccugggggucugaacccacgcuuggaagacgggggcugcucagcagauagcucggggcugggggaaggggcgccugucgucggagcggggggaugacacgagggcccgccgacagcccugggggacgaguugcucccccagacgucuggagggggacucuuaccccaggggcagguggccgccuucugacgacuccuuggaagaggcggggagccgccucuggggcaggagggugggaagcgggacccagcagcuggggcgggaaggugggcggggggagcugggccgcgagacgcgggggccgcgcgucuggagccggggccugugggggcugcacgucugggaacccguggagacgcgcggcgggaggggccuggagcugccggaagccacggggagggggcgccgcgucuacagggagagacgggguggucugaggucccgugggccgcgugggcgggaagugccgagggcucggccggguucccgggggcugccggcgggaggagggcggcggccggguuuccgcggggaccuggcuccuccucccgcaucugaggcggaggccgggggugggccgggagcgggugcgcccggggagcuucucguccccgagugacccagccccggccuccgccaggggcgggagcgaggcccggccccgcugucgguuccuaagggaacggcggcucgcggggagcuggaaggggcgggcgccucccggagccuggcgcccgcagccccgccccuccccgcgggcccggcgcgcacggccgggcgguuggcggcggcgcccgcggccccucccccgggucgggcgcgggcgggggcccgcaagcucaggaaguaggggaaaggugacggcgcggcaauucccaguucacguuuccugcgccucccggagcagccgcugaucacgcuuuguucacaugccucgcccccuccucgcccacgcccccgccccgggccgcacagccaauccgggcucgggccgccgagccggccggccaauggcgggggcaggggcgcggggacgugcgagcggcgaggaauguucccagugacucacccgugagccucauugagguuagggcggccccauccgucggucuccgccagcuaggaucucccccgccguccgcccccgccccucgucugccucccccgcccgcgccuccgcccgcgcuucccuuuccugccucgcgccccacucccuuuccuccccucccuguuucccuuccuguccuucccagcucacgcucucuuucccugccgccugccuuucuuuuuuccuuuuuuugcauuggcgucuuggggcuguuacacacacgcgcgcuguccauugcagcuuacauaaaggcgggcgcgauuaugcaauuauauuguuagcgauauuucaagagcaauggcucguuuucuuaggauuucaacacgaaggcaucaugcauuuuugaaaaacuaguauugagaauaauaccuugcaacguaaagaauguuuuuugguauuuuuacacaaucucuacuuugaccaaacgagucuggacaguuuucuuuuaauggaaaauaggagaaauggugaguaguaccauuuuuuuuuagcguaguucaaagaacuuuacuauaaaacauuagguaguucuacaaauaagugcaaaaccugugcuguuauuuugucaucaagcaguucuuuaaggaauuaaaauagauucuacuuugauuaugcugacuuuuuaaagucgguuuuugcaaauuccaaguagaauauuaaauuuuuugauuauccaguuuuuaguaauauugcauuagcuauguuguaguuauguauggcaaaccauugugucaaauagauucaguaaaagggagcacaaauaugaagagguugaaaguuaauuaaaauaaacauuagaauuuuuuucuauguauaucacuugauuuuucuuuaccauaaucaagugaucaaauuuuagaucuuaaauaaugcaauuuuaacuugaaagauacccugaggaucccuuaucuuuugauuuuuaucccaaagugcaaagugacuuuccaaaggucagacccauaacaacaggccagagcucuacuacauuuugucuuuauuagaagguuuuggcuauuuuuuuuuucuaucagcaauuuguaccucaaaagaccucauaccauaccuguaauauuuaagaagauaaauuuuuugccgcacucuuaguuuuuuugcccgacuccaguugcagguagcuacucuggaaagucuauauaaaauacuccuuuucuucuuagccaaauacuucuccuuuuggaucacaaaugcauugauaauuuucgucuuaguccccuuaaugguaguaggugugccucucucccaugaacggauaucgcuuuaucaguguuaaagucuaaauguuaacagaaaaaaugaggaagauuuuauugccacuacugugagguuuggguuaccuaccuaacaaguguagcugaacuuccuuaguaucauaguaagugugagaggaaaauuauuucugauuuuaauuuggaaaguugugugaguuguaaaaaaaaaaaaaaaaaaaauuugcucauuuuucugugugucauuuggaugacaaaaaauaugcuuauaagcuuuccucuuuuguuuuuauaggaggaaagaauggaaaugauuucugaaaggccaaaagagaguauguauuccuggaacaaaacugcagagaaaagugauuuugaagcuguagaagcacuuaugucaaugagcugcaguuggaagucugauuuuaagaaauacguugaaaacagaccuguuacaccaguaucugauuugucagaggaagagaaucugcuuccgggaacaccugauuuucauacaaucccagcauuuguaaguauuauuguuuuuaagauagacguaaauuauauaauuucuuaaaauuuauauaauaaacuguagauuucucaugcuauguauuucccuuuucuuuaguguuugacuccaccuuacaguccuucugacuuugaacccucucaagugucaaaucugauggcaccagcgccaucuacuguacacuucaagucacucucagauacugccaaaccucacauugccgcaccuuucaaagaggaagaaaagagcccaguaucugcccccaaacuccccaaagcucaggcaacaagugugauucgucauacagcugaugcccagcuauguaaccaccagaccugcccaaugaaagcagccagcauccucaacuaucagaacaauucuuuuagaagaagaacccaccuaaauguugaggcugcaagaaagaacauaccaugugccgcugugucaccaaacagauccaaaugugagagaaacacaguggcagauguugaugagaaagcaagugcugcacuuuaugacuuuucugugccuuccucagagacggucaucugcaggucucagccagccccuguguccccacaacagaagucaguguuggucucuccaccugcaguaucugcagggggagugccaccuaugccggucaucugccagaugguuccccuuccugccaacaacccuguugugacaacagucguucccagcacuccucccagccagccaccagccguuugccccccuguuguguucaugggcacacaaguccccaaaggcgcugucauguuugugguaccccagcccguugugcagaguucaaagccuccgguggugagcccgaauggcaccagacucucucccauugccccugcuccuggguuuuccccuucagcagcaaaagucacuccucagauugauucaucaaggauaaggagucacaucuguagccacccaggauguggcaagacauacuuuaaaaguucccaucugaaggcccacacgaggacgcacacagguaccagccacuucuuauaucuuuaguguuuaaaugaagagauuuuggcugugaucacacauuuaaacccaggaugauaaggaauaacuugccuuuagcuaguuuagaggaugguauuuaccagugcaagguccuccaaaaggcuguauuggaggccgcucacgagugccauaauccuugcacuuuaggagaccaaggugggaggauuguuugagcauaggaguucaaaaccagccugugcaacauacugagaccucaucucuacaaauaauuuaaaaauaaguauguaaauacuuuauugaugugcuuuuguuucagucucucaaaugaugauucuguagaugucugaguaguuacuuuaauaagguaucuuuaaagccuuugaaucauaguuaaagucaggaagucuuuucauuuuuggcuuuuuuuaagggaugaaaaaaaacugcucuguugcccaaacuggucucaaacuucugggcucaagcuauccuccugccccagccuucugaguaguugggacuacaggugccuacuacuccacccggcugccuuauuucauguggggaagaguuuuguaaaugugaucaagugacaaguugaaauuggagcaauacauaucucauauucauuugacaguuugauuuauuagcuuuuauuauuuaaaauguaucuucucauauacuuuuagacagaauugaacauauaauuuacggcaaucuuaugcauaauaaugauuuguaugucuuuguuuuaggagaaaagccuuucagcuguagcuggaaagguugugaaaggagguuugcccguucugaugaacuguccagacacaggcgaacccacacgggugagaagaaauuugcgugccccaugugugaccggcgguucaugaggagugaccauuugaccaagcaugcccggcgccaucuaucagccaagaagcuaccaaacuggcagauggaagugagcaagcuaaaugacauugcucuaccuccaaccccugcucccacacagugacagaccggaaagugaagagucagaacuaacuuuggucucagcgggagccaguggugauguaaaaaugcuuccacugcaagucuguggccccacaacgugggcuuaaagcagaagccccacagccuggcacgaaggccccgccuggguuaggugacuaaaagggcuucggccacaggcaggucacagaaaggcagguuucauuucuuaucacauaagagagaugagaaagcuuuuauuccuuugaauauuuuuugaagguuucagaugaggucaacacagguagcacagauuuugaaucugugugcauauuuguuacuuuacuuuugcuguuuauacuugagaccaacuuuucaaugugauucuucuaaagcacugguuucaagaauauggaggcuggaaggaaauaaacauuacgguacagacauggagauguaaaaugaguuuguauuauuacaaauauugucaucuuuuucuagaguuaucuucuuuauuauuccuagucuuuccagucaacaucguggauguagugauuaaauauaucuagaacuaucauuuuuacacuauugugaauauuuggaauugaacgacuguauauugcuaagagggcccaaagaauuggaauccuccuuaauuuaauugcuuugaagcauagcuacaauuuguuuuugcauuuuuguuuugaaaguuuaacaaaugacuguaucuaggcauuucauuaugcuuugaacuuuaguuugccugcaguuucuuguguagauuugaaaauuguauaccaauguguuuucuguagacucuaagauacacugcacuuuguuuagaaaaaaaacugaagaugaaauauauauuguaaagaagggauauuaagaaucuuagauaacuucuugaaaaagauggcuuaugucaucaguaaaguaccuuuauguuaugaggauauaaugugugcuuuauugaauuagaaaauuagugaccauuauucacagguggacaaauguugauguuguccuguuaauuuauaggcguuuuuuggggauguggagguaguuggguagaaaaauuauuagaacauucacuuuuguuaacaguauuucucuuuuauucuguuauauaguggaugauauacacaguggcaaaacaaaaguacauugcuuaaaauauauagugaaaaaugucacuauaucuucccauuuaacauuguuuuuguauauuggguguagauuucugacaucaaaacuuggacccuuggaaaacaaaaguuuuaauuaaaaaaaauccuugugacuuacaauuugcacaauauuucuuuuguuguacuuuauaucuuguuuacaauaaagaauucccuuugguauauggaauggucauugcauuucuuaaaaaccauucucaacucucaccuugacauugaucacuuauauuauccaaggacuuagugucugaauuucucuaagggucucauucaaauuuagaacuguaggaguaugucuuuaacaugaauccauuuagagaguauacaaagugaggccaaauaucuauuuggugagguaauaugugaaccagccaguucuaagaaaacacauuuaauuuuuaaacauuguuuuuuauuuuucaagacacaguuucacucugucacccaggcuggagugcaguggcaugaucucagcucacuacaaccuccaccucccagauucaagugauucuccuaccucagccuccagaguagcugggauuacaggugugcaccaccaugcccggcuaauuuuuauauuaguagagacgggguuucgccguguuggucaggcuggucucaaacuccugaccucaagugauccgcccaucuuggccucccaaagugcuaauuuuuaagcauucuugaauauuuugauauuuaacaauauuuugauauuaacgaaaucuuguuaaguaguauucaaguuaaagggaacaccacagugaauaauuacaagcaaugaaacugccguggcaaaugaaaagaaggcugacuuauuaaauagcgaguaaauugcuuaccucuagaaguuagacaauuaagugauaccuuaaaugcaauaaacauauugguacuuaagccucaugaaaaguaauccaccucugaagagaaacacuuguuagucacucaucaguggaaggaacuaagggcuguaaaugcuacuugguguauagaguauaauuuuguagauuacuauuuuagcuugcacugaaauccccuuguggucaggagaacaucuuccacaaugcccaacuuaaccagugaccuagagucugccucauuguugaauaaacaccaugguaagggaccguguacucacuuggcagcaguuguaggacagguuucucaggacaucuguacaccuguugcuacuuuucuuggaaacuuaauaccacaugaguaugacauagcugcuggagagaggcuuugccauucuggccucugguguagcuuugguguugggcaccuggaccauccucuugcuuuagagcuuuucaugguggcagguguccagaagugggaauggaggaagaugacugaaauauucucugccucccccaaugcucagucccuuguaaugauguggcccaugaaacuaugccacccguuggccguauucuuugcaguccuaguugguaucugagaucuuuccuuaggaaucuuguaaauagaguuacuguuuuugaguugaacguugaagcaggaucuaauuuuuuuuuuuuuagacagagucucacucuguugcccaggcuggagugcaguggcaugaucucagcucucugcaaacucugccuccuggguucaagugauucuccugccucagccuucccaaguagcugggauuacaggcgcccaaaauuaauaaguuaaacuugguacaauacuauuaaguuuucauaaggauacuaaaauggagaaaaguugaagcagaaacaccuuuuuacuagcuuaauuuuuuacuagcuuuucuacuuuuuccuauuacaggaccuaauccaggaucucaaauugcauuuaguugucaugucucugcagccuccuccaaucuguaguaguuccucaguccugucauuugaacauuacuugucaguuauuuugcagaaugucccuuaauguggguuugucugauguuuauucaugauuagauugaggcuaugggguaugugggaaagaugccccagagugauaauacccuucucagcacaucuuaccuacgaaaacaugguguccauaugcacuccugaugcugcuaaccucacucacuuuggcuagggugauaucuguuggaauuuuccacuguaaauuuaccauuuuucuacuuauaauuauuaaauauguagagggacauacuuuaagauuaugcaaauaaccuguuucugcuuacacuuuuccccauuuauuuuaguguccuuauggaaauguugccuggggcaauuauuacugugauaugcuaauuuccucauuauuuauuaaguuggaauucuguaagaguuguuucuucuccauuuauucaguuuuuuuaaaugucagcauggacuugaauauuuaucucauucuuugaguuguaacacuauacuuaauuauuuugugacucauuugucccaccuuuggcccuuguuagcucuuucaguauucaaccacuuuuaauaaaugaagaugaaaauuuuauaugguucaaccuaucauuucucacuggaacgagagcuguuugguauuaguaacuacuuuuuuaaaguguuuucuaccugcguugcugccacccugucuaauccagcaucucucacucaagccagugcagccaccccuaacuggccucccugccucuguccugucuucuuacuauccagucuccucacaacagagucuuuugaaaaugcaaaccugauaaugucacuuuucuguuuaaaacacuucagaaaucucccaaugcucucagagucaagucuagguuuuauaacauggucuagaacaguacugucuaauagaaauauaaugugagccauauguaauuugaaauuuucuaguagccgcaucaaaaaaguaaaaaaaaaaguuuauauuuaaaauuuguauuuaaaaaacauuuaauuuaauguucgugguaaucuuugaaaucuagucuagucucaguagggacuagccucauuccaagugcucuguagccacagguggcugcugcaguggaccgagcaggucuagaagaccgugcacguuuaggcuucuaccaaccucccaccacaccacuuuccaucuuguacucuacauuguguccaagcucugagccuuccuaugugcuaugucuucugcugggaauguuuucccugccccccaacccuuuuuuucccccccaagacauagucucacuguugcccagccuggagugcaauggugugaucucggcucacugcaaccucugccucccagguucaagugauucucccgccucagccucccgaguagcugggauuacaggugcccaccaccacaccuggcuuauuuuuguauuuuuaguagagaggggguuucaucauguugaccaggcuggucuugaacuccugaccuuaggcgauccacccaccuuggccuccuaaaguguugggauuacaggcaugagccacgcacccggccuucccugcccuuuuaccuugacauuuccacugucauaauaaucauuauuacccuuuacuucaugucuuuuuuccccugacuguaaaacuucaugaggaaaagcacccugugggucuagcucacugcuacaucaccagcaucuagcacagucccugacacguagcacaggcuuaacaauuuugccaaacugaaaguugagccgugaagaggccugugcaauuuuagggagggagaacaacuaagaaguuguuacaugcaggauauagaaaaaggagacgagaagcugaagauugccuuuuucuuguucccauuauucuuugcuagugcuggaaggaccauuuauuccaccuuccagacucuuaaagagucucauggcauuugaauucucuucauugcauuuuuaagggggcagggaagaaaucugaucaagacacauacacuaggcucacuaagucccuucgugugagucuaaugcuucagccuggaagggcugaaaaguguugccuuggcucuuacccuacccuuucucuuuagaagacuuucagaauaaggcagagacagaaauggagacuuccaucaagggcacuggacaucagcagagcccuggaacuagaugagaucuucugggcaacaccuuaagggaauuuuauucugaugccuuaauccaguccuggcauuuugcugaccaacuuaagcagagcuugagaaaugauaaaguugauuuucgaagagcacugccucuaauuuuuuacacagguaacugugcccuggaggugucaguaucagggaaagaucaaaagaucaaaaugaucaaauuaaaagaccugguauauuaagguucucccagaaaaauagaaccaauggaacaaacagaaca

SEQ ID NO: 17757 - RNA, 1354 nt, Homo sapiens
cgccgccgccgggggcacagacagccgccgccgccauguucgaggcggccggccgcggggcgcugcggggacgucuuaagggcggcggggcccagccggagccccccagccgccccccaaggccagccccgcguccuggccccucccgcgcuccucggcucgguacucacgugagauaacggcccaaagagucggguaaagcgucuucucuuuuucggcggaauuuuuaaagagggaugugguuaccuugagcagaaauacccaaggcggccugggccauaggcugcgggaacgacuuggggguaaaagcgcggcaccgacaccagcugugugcagcaguggcggcggcggccgaaggagaaauagaacagcgcaggcaaaagaagaaaggcgcgggcugggugggaagaggauucggacucgucacacugcagagcagcagagcgagaaaggaugagaagaggcagagaaggcgacggcagaagaaaaaaggaaaaacugcggccgcgaucagagccugaaagugugagaaggcggcgccagcgacgccaguauuuauauuagggggcguggccuggugacaucacagcuggccgggcagccgcgcgagcggggcggaacccgguugcagcccggagaaaagggagggggacggaagaggaaggaggacugagcccgggagagagaggggaggggucggcgcgcgaccgggucaugcaggugcagacuggccggucgcuucccgcccuccagccacccgcagcuccccggcaggcgaagggcggccgcgcgggugugggccgagagagggaggcggcucggcuggagcgcgccguccgcccgacccccgccgccucucgggcgccugcgcucacgcugcggggcccagcgcauugugagccgggucgagcuccacgcuggcagcgucugagagcuguccugggccggagguggcgcgaacccugugcggccuagagugggccugggguaagccugucggcgccgcugccgagccuucgcguccagcucccuccgcuuugugaggccuguaguuuacccuggggaguguccucccgggcugaggcgcccgcccucggugaugcgguacuccuuuagggaagcgaguuccucguggccagaaaggaccggcccaguguccggguguuaaaaaggguugugaccacgugaaaauguccucagugcucgaacguugcaauacggugcaguggaaauuuuuuaaaggaauauggcuuuuaugucuucauuuuuaaaaggauugguggagucagucccaagcaggacccgcguuggagaggggauuacugauguuacaagcgcacauuacuucaauccc

SEQ ID NO: 17758 - RNA, 1354 nt, Homo sapiens
gggauugaaguaaugugcgcuuguaacaucaguaauccccucuccaacgcggguccugcuugggacugacuccaccaauccuuuuaaaaaugaagacauaaaagccauauuccuuuaaaaaauuuccacugcaccguauugcaacguucgagcacugaggacauuuucacguggucacaacccuuuuuaacacccggacacugggccgguccuuucuggccacgaggaacucgcuucccuaaaggaguaccgcaucaccgagggcgggcgccucagcccgggaggacacuccccaggguaaacuacaggccucacaaagcggagggagcuggacgcgaaggcucggcagcggcgccgacaggcuuaccccaggcccacucuaggccgcacaggguucgcgccaccuccggcccaggacagcucucagacgcugccagcguggagcucgacccggcucacaaugcgcugggccccgcagcgugagcgcaggcgcccgagaggcggcgggggucgggcggacggcgcgcuccagccgagccgccucccucucucggcccacacccgcgcggccgcccuucgccugccggggagcugcggguggcuggagggcgggaagcgaccggccagucugcaccugcaugacccggucgcgcgccgaccccuccccucucucucccgggcucaguccuccuuccucuuccgucccccucccuuuucuccgggcugcaaccggguuccgccccgcucgcgcggcugcccggccagcugugaugucaccaggccacgcccccuaauauaaauacuggcgucgcuggcgccgccuucucacacuuucaggcucugaucgcggccgcaguuuuuccuuuuuucuucugccgucgccuucucugccucuucucauccuuucucgcucugcugcucugcagugugacgaguccgaauccucuucccacccagcccgcgccuuucuucuuuugccugcgcuguucuauuucuccuucggccgccgccgccacugcugcacacagcuggugucggugccgcgcuuuuacccccaagucguucccgcagccuauggcccaggccgccuuggguauuucugcucaagguaaccacaucccucuuuaaaaauuccgccgaaaaagagaagacgcuuuacccgacucuuugggccguuaucucacgugaguaccgagccgaggagcgcgggaggggccaggacgcggggcuggccuuggggggcggcuggggggcuccggcugggccccgccgcccuuaagacguccccgcagcgccccgcggccggccgccucgaacauggcggcggcggcugucugugcccccggcggcggcg

SEQ ID NO: 17759 - RNA, 22111 nt, Homo sapiens
cccagccgcgcgcgagucagacucgggugggggucccggcggcgguagcggcggcggcggugcgagcaugucguggcucuucggcauuaacaagggccccaagggugaaggcgcggggccgccgccgccuuugccgcccgcgcagcccggggccgagggcggcggggaccgcggguugggagaccggccggcgcccaaggacaaauggagcaacuucgaccccaccggccuggagcgcgccgccaaggcggcgcgcgagcuggagcacucgcgugagugcggcggggcggggcggcgcgggcgggcgggcgggacgggccggggaagcgggagcccuggcccuugccgcuccucgccgcugucggcagccacuucccgggcgagacugcgcccccggagcacccccggccggagccgugucgcgugccgggaggaucggacucuuuccgucacccguuugcaccucugcagcugucaggagcgggucaggugcggaaagcggugcggagguggcgcucauagguuacaggggucagggucuggggcuggccguggucuucaguuaccgccgagcgugcgggauccuucugcgcuugccgccuccacguggcacaggccaaggcguggccagauggguagauggguuuguugggugguugcuagcaguuuccacguaacaagggaagcguauuugagaguuacuugauucuaacgagacuagcagauuugcacuucuuguuggaagacguuagcauuugcacggcgaggucugugaagccacaggccaggccgugcugcucagcuugaguaaaccccugacccaaggcccucagggugugagcacucaccauguuguucaggcuggucuugaauucuggccucaggugauucgcccaccucggccucccaaagcgcugggaugacaggcgugagccgcugcucauggccuuccucgguaauuuuaaccaucagguuaggaugggaaucaagggcuggacuucagggcaccucggaggacagcggauguuggugacugacuuucuugcugcaggcuuauuuggaggguuccuuuguguccuaguuccuggggguuuucacccgcuaacuucacuuagagauugaaacuucucccacuuccagaagcugaaucguagugaucagccugcggcccccugcagugguacaggccugguugagcagccucaggccgccuccccauagugcagaccugugccucugaguugcuccaguccuggcggccccggagcuccugacccgcaguccgcucugccggcguugccagugccuuggucugcccucucugugguggagcggggcccggggcagggucuccaggugcaccguggggagcccuccaucaggcuuuuguuuccuguggauuguguuccaggugugggcucuuucauucugaucccuucccuccuuccuggccucacugcuggcaggugagagagguuucuccagaguugacugcccccuuuccccgggugcccccugcccugccccucugccugguagccccucugcaagcccggccccucccgacgcuccuggcuuccuccgugccccuuuccuggcagcgggucgccgagauucggccggagcccauugcuuuguccuugcugcucuccaggcaaacgggcggcuccuccucaccgacugccuccucugucccuugaggcuauagccccaugccgccugguucccagagugcccugaccccuccuccggccuguccuuggaagucacagcaguacauuaucccagaacugucugugagcaccagcgcucgcccugcacuccacagagggggugccuggaggagagccucgugcccugugggugugaauucacgcgcugggacgcacgucccuggcacagggucacaccaaaguggugaaugauuguucucacucuaauaaccgagaggccacacgggcaccugaccugcucuuuccccucuccuccuccccagagucacuggggguaggaacugucaaugagccauuuucaggggagggaguggccucagcuuaauccagccaaagguccccucgggaggaaacaggcagagcuccucaccgugacacccacguuccugucacugcucuguggcaggacccugggugacugacacacccucaguccccucggggucagagugagagugguugagagcccggggucgcuucagcccuuggcuucccgagcuuagcagccaaacccguugaccuggcacugucuucccugagaggcaggucccggucucaucugugcucuguucacuggggcccccgagguuagcuaccaaggcgcuuccugaaaucugacacugaugcccgucagcccaguucgugccuaaccacaggcccaagcagacccaccccaacaccaaagcgucgcugccucugucuaaaugcaacgagugcuccccacggcacuucccccugcgucagucaccuccaaaaauuacaccugagcugagaacagacgcugggcucuaguuagugacguguuugcugcaguugacucugaaggcuuaaaaaagugagacgggcugcgggaggaagagagacgggaacaacgcaccaacccaggagcaucgggggucccugccuacuuuacgugucuuucuguguuagcagauuuauauguuuauuuauuuauuugagauggaguugccguccgucgcccaggcuggagugcaguggugcaaccucgguucaucgcaacauccaccuccuggguucaagcaguucuccagccuuggccucccaaguagcugagaucacaggcgugcaccacugugcccugcucuuuuuuugucuuuuuaguggagacaggguuucgccauguuggcccggauggagauuuuucuuuuuuaagucucucucugucuagcuggagugcagcggugcgaucuggguucacugcagccucugucuccgggguucaagccauccucccaccucagccucagaguagcugggauuacaggcguccgccacugcgcccagcuaauuuuuguauauuuaguagagaugggguuucaccacauuggucaggccggucucuaacuccuggacucaagugauccacccgucucagccucucaaagugcugggaguacaguagugagccaccgcgcccagccaaaagauuuuuaugguaaaguuuuaugaugggaaaacugucaucccagaaaauuuugagaccugaugcugaggccucagcagcucagagaauacguacuucugucccacgacacccaaacaucgaccugugucaguuccccucuaggaacaaaacguaacugaggacguugucagaugcuuguccucgucacccugagcuuguuggcugguauccuauucuuauucauucccuuucuugccugcaugugcuugauagcagaucaaugacaacagccauuggaagcuuaggaaaagcgaauguaacgugaaaaaauagaggacacuuuagccaucgccugacuuucuguugaauugggaaagagccuccucccguccacgugggauggccuuccugauguggcucuccaagaccaucccuggggggauaaaaccucacaaaugcaucaggccgugugcuggggauggugcaucgucacgccaggucugacuaggaaggaggauggggaggcagggcugggggcuuugaggucgaggcguggccguggauuccagaaagccccuuggcuggugugcgugccugcccagcggcauccguguauccuaacaccugcccuccguguccuugcgucugcagguuaugccaaggacgcccugaaucuggcacagaugcaggagcagacgcugcaguuggagcaacaguccaagcucaaagugaguggggccgguguggguggggaggccggggcgcacaugggguucgggcauggagauugguagggcuacugccgguggguagggccggggguguguacaugggcagcaguggggcccagggccaagcuugggcgccucauuucacagaaggaaacaaagggaggugagagacgcugccgcagagccgcccgagagggagggcugguguuggugagggcgucuggucguccggagggagggccgguguuggugagggcgucuggucguccggauggccuggaucuucucauuucauuacacucagcaggauuuuuuuguuuuauuucguuuuauuuauuuauuuugaaacggagucucuguuucccaggcuggaguucuguggugccaucugggcucacugcaaccuccgcuccuggguucaagcaauucuccugccucagccuccugaauagcugggauuacaggcacccgccaccacaccuggcuaauuuuuauauuuuuaguagagucgggguuucaccauguuggccagccuggucuugaacuccugacuucaagugauccaccugccucggccucccaaagugcugggauuacaggcuugugccacugugccugccuuguuucauauuauuauuuuuuuauagacagagucuuagucugucuuccaggccggugugcaguggcgugaucucagcucaccgcaaccucuaccucccggguucaaccucuuuccucagccuccgagcagcugggacuacaagagcccgccaccacaucuggcuaauuuuuguauuuuuaguagagaugggguuucaccauguuguucaggcuggucucgaacuacuaaccucaguugauccacccacuuuggccucccaaagugcugggauuauaagcgagagccgucgcacccgguccacucagcaggauuccuaaaauaagcaugagcucugcccucagugcaguccaaaaggggguguccggccucccucccggggggccuucgcgggcuucugcuggugcuucugugccugugggucuggauuccuccagggccugauccugggugcagaugcggcuggaagcccugagccugcugcacacacuagucugggcauggagucucugccgugccggagccgugcagacacaggagcggcugucaggcagugccagcccugagcaagugccagcuggugagugcugugcucugcaggaguaugaggccgccguggagcagcucaagagcgagcagauccgggcgcaggcugaggagaggaggaagacccugagcgaggagacccggcagcaccaggccguaagagcgcaagaggccgcgagggaggccgcccggcugcggggagcggccuggggcaggacugggagcuggguguggucccggggcacucuggagucagccauuagagcugcccucggaacggccuugcacaaacgccuaagaccuguaaggucccucacugcugagccggacgggagguccccgcgccuccccacguuugugugaggcugauggcgcgucggaguccccggcgcuccgcccagucggcccagacugcagcucccggcugagaugugucuuugccgcccucuucucccccagagggcccaguaucaagacaagcuggcccggcagcgcuacgaggaccaacugaagcagcaggugagcucagccuccccugcgaggcgccugcgucccugagaacguagguggcuuugugggaccagucagugggucagaggccacggggcaagaacgcugggguugcugacggugggugcuagagcaggggaaacuacucggacagacacgcaccagcacacguguacaggcacacaugcagacgugugcacacauguacauggagacacaggcaccuacccacacggacacacacuccucgcacacacacucccagcacacacagacaggugcacccacuucugcacacacgggcacacacacaccccugcacacacgggcccacacacagacacccccacacagaggccugcacucacacacccgcaaacauacccccacacaacacgggcaggcacacacccacauggacacucacaccuguaaacacacccccauacagacagguacgcacauacaccccgcacacacacacacagauacgcacacacacaccacacacagguacguacccccccacacacacacaggcgcacacauaccccccacaggcucacuggcacccgcgcacucgggcacacacacagccccacacacacaggcgcacacccacacacacaugggcaugcccccccauagacggacacacacacacccacacacaugggcgcgcguacaccccccuauacacaugggcacagcccccccgcacacaugggcacgcacacaacccccccacaugggcgcacagaccccacacacacauacgggcacacacgccuucccgucacagggacacacacacacacccgcacaugggcacacacccacacacgggcguacacacccccccccacaggcacgcacaacccccccaccccccgcacggguacacacacacacacacacacacacccaaacgggugcacaacccacccacacaugggcacaaucacccccacacacaugggcacagucacccgccugcacauucgggcaccgucaccccccgcaaacgggcaccgucacaccccgcaaacgggcacacucaccccccugcacacucgggcacagucaucccccgcacacaugggcacagucacagguuuuaaaggcuuuucucuuuuucugcggcuucuucucagcaacuucucaaugaggagaauuuacggaagcaggaggaguccgugcagaagcaggaagccaugcggcgagguaggcugucugcucuccuggcuggggcggagguggcgggggcugcuuguggacccggcgugcacucugagccugaguucugccgcccggccccucauagcuaccagugcagugggcgaggccugcuggggcuccgcgggguggggcugccucucggaagacaccucugucugcgaguggacgccaggaucuguucagggagggcaggagcugcuucacuucaugggaaguacaggggccuuuuuuuuuuuuuugagacggagucucgcucugucacccaggcaggagugcaauagcacgaucucagcucacugcaaccucugccucccagguuuaagcaauucuccugccucagccucccgaguagcugggauuauaggcucccgccaccacgcccagcuaauuuuuuuguaucuucaguagagaaaggguuucacuguguuggccaggcuggucuugaacuucuugaucucauuauccgccugccuuggccuuccacagugcugggauuacaggcgugagccucugcguucugccuagaacaugggucuuuacuguccugguuucaguggggaucacagguauuuggugccauguggcauuuguuggcgagugcuccaggcaaacgucugucaccacucuucaccgugggugggcuuguggcgaggugugugcguuuaauguucaguagccaggcacguggcacgucacgcgugucugaguucugacagcuguguuucugugugaggggggcuuccuucagaacuccgcguucugguuuuuugcuucaaagagcucguccugagaaguugccuaggccucugggucggauuucugcccuaauccaugggcagggccggccuguggcgcugucccuaccaaggucugugugugucuguggcauggaccuguccguggccuuagccuauuggcggcgugggccugucuguggcgugggccuguccguggccuuagccugucagcagugugggccuguccauggcgugggccgguccguggcaugggccugucuguggcguuggucuguccguggcgugggccgguccguggcgugggccgguccacaguguggguggagguggacgcgcugcacugcauggugcugagcugcccugccucucuggggcagccaccguggagcgggagauggagcugcggcacaagaaugagaugcugcgaguggaggccgaggcccgggcgcgcgccaaggccgagcgggagaaugcagacaucauccgcgagcagauccgccugaaggcggccgagcaccgucagaccgucuuggaguccaucaggugagcacugccgaggcccgggccggccacagauggagccccgcaggugugagucgcuggucccagggcgcucuccagcucuuccaggccuugccgccguaggcugacuccuuggugggggcacugccccucuguccuggcaaggccgugccgccaugucagggccucacccucaaccugcucucgcugcguggcacggaucuucguguccuuccuggucacaccacugcuuuccccgcaggacggcuggcaccuuguuuggggaaggauuccgugccuuugugacagacugggacaaagugacagccacgguaaacauacucauaaaacagggcuggcagguggcugaggggcagcaugugggggccuccuggagccccagguccugucccugccggcucugcacagcccuguagcucucccagcagggaggaagcccacguuguaccugcuggccucggcuucuccucccuucucaagcugggagaagaaaacgcaguugccagccugggccacacagugagaccccaucucuacaaaaaaucaaauauuagcugggugugguggcagccccuguggucccacuacucaagaggcugagguaggaggaucacuuaagcccagggagguugcagcugcacugagcugagaucgcagcacugcacuccauccugggcgacaaaguccuugucucaagaaaaaaauugucgauagucguggcucacaccuguaaucccagcacuuugggaggcagaggcagaggcgggcggaucacgauaucgggaucgagaccauccuggcuaacacggugaaaccccgucucuacuaaaaaaauacaaaaaauuagccgggcgcaguggcgggcgccuauagucccagcuacucaagaggcugaggcaggagaaucaccugaacccgggaggcggagcuugcagugagucgagaucacgcuacugcacuccagccugggccacauagugaggcuucuucucaaaaaaaaaaaaaaaaaaaaaaaaaaaaaaaccagaaggcaacccugacuccauuuugcaaaaaccuucuuuauuccuuauaaaacccugagaguuugaaguucacagauucuucucucguuuaaagccucacucuuuugugcccagccuccggccugcugugguggcgccccacgucccacauggcuguguccuccguccccaccccgcccagcacacgguaggugcccggcacugagugggcacuugcucugccguggugccggcgcccagagcugugacugcagcgccugccgguggccuggucagugugacggugaauguugcaggugguguugccaccauguuggugagaccgugucacgugaggacaugacggagcugcuuaaugcgccgaugacuuuuguuuguuuguuuuuagagacagggucuugcucuguggucagacuggagugcaauggugccaucucggcucacugcaaccuccaccuccccaguucaagcaguucuccugccucagccucccaagugacugggauuacaggcucacgucaccacacucagcuaauauaggccugugccaccaggcccggccaauuuuuguauuuuuaguagagauggguuuucaccauguuggccaggcuggucacgaacuucugaccuuaagugauccagccgucuuggccucccaaagugcugggauuacacgggugagccaccgggccuggccuaauucauuuuuuguuuguuuguuuuuugagacagaguuuugcucuuguugcauaggcuggaguguaguggcgcggguccagcucauugcaaccuuugccuuccggguucaagagauucuccugccucagccucccaaguagaugggauuacaggcaugugccaccauggccagcuaauuuuuuguauuuuuaguagagacgggguuucuccauguggguuaggcuggucuugaacucuugaccucaggugauccaccugccucagccucccaaagugcugggauuacagaccugagcuacugugcccagccagccuaauugauuuuuaaaacgaguuagagauuuuggguuagucuuguuuuccaggaauaaaguaccauuuuuaguggccaagaauguaccagaggguguggcccugugacauccggcugggucuguccagggccccgcucagcgaccgaggcuuucuaggauuuaugcugccaguugcagagaaaauggcccugagugagggcgcugugacugccccaccugccuccuguaaccgcguggcugugggauucggggccgggaauucgcguuccuguggggccagugcacggcccugugcuucucccucgggcggagagagggugggggcagccccgugcgucuccugcucuaagagggagggacggugggggccggugcgccagugcggugucucugcugcagguggcugggcugacgcugcuggcuguuggggucuacucagccaagaaugccacgcuugucgccggccgcuucaucgaggcucggcuggggaagccgucccuagugagggagacgucccgcaucacggugcuugaggcgcugcggcaccccauccagguagcagcgcaggccuggcccucccugagugcaguuccuggcugagucccuucugccccacgagcacagcccacgcacacccucccgucccuucccuuuccccggauaacgggcacccgcacacugcuucacggguggguuuuccugucuggcgcuguaccuuaggggucugcaucagugagacccuuccccugucugccucgguguccccugcucagggcucuugauggggccugggagcacaucgggguccuugcaagacccgggacuugggugugcggccgucuaucagggaagcugcuacaggccacggcgucugguggccucccuggggagccgcgccgcucgccgcccccgaggugccugcucuccacaggucacuggguaggugguuaagaaaauaaaagccaauaaggaaccggaaaaugccccuaaucccagcaauagccgccuggucuccgggcggggcaggguuccagcuccgggccgguccuggcugugcuuuggggcagcuccguuucugcguguuaccgagcgugugugugcgcguugguggcuguuccguggcuguggcaggugacccgauggcgcuuccccuuccccuccggcaggucagccggcggcuccucagucgaccccaggacgcgcuggaggguguugugcucaguguaagucggugugccugggaccggggaggcgcagggaggggacccuggagcugggccgggcuguggcccuugcuggcgcucgugguggcacccaggagcuuuuggguccugagaugcgacugcuuggaccgugcuggggauagauaggcugccccugaggugggaggcuucccgaggagccgagucugcacccaggcauucccgcagccccuuccccugaggcuuccaugggugcacagugucuccuccaaacccccgucuuccccggcagcccagccuggaagcacgggugcgcgacaucgccauagcaacaaggaacaccaagaagaaccgcagccuguacaggaacauccugauguacgggccaccaggcaccgggaagacgcuguuugccaaggugagagcgccuggcugaacaggugggccaggggccgcuggggucucaccugccugcaggugucuggggggcucagcugccuggggaauggaccccccuuaggccuuugcccacccucguguaggcucagggugcuggugugggcagcagcgccucccaucuuccaggcgggggacgucuccugucuggcaggcuguggcuuccaggcagggacgcugggcagagccuccacacuccggguggagugugcaggcuuugcagaggcggagggaacaucugcucugucuccccucacucuuccuguccagaaacucgcccugcacucaggcauggacuacgccaucaugacaggcggggacguggcccccauggggcgggaaggcgugaccgccaugcacaagcucuuugacugggccaauaccagccggcgcgggugagacguccccacagcaugcaccaggcccuuggcugcggcccagcaggcugccuucugggaaggggguccaggugucucuuggggacccugucuuucugcagcucuguccuuguggccacgcaggaggcccaguggagggucccucggagggaaaguccccugaguguggacccugguggacacgaggcccccagcguguggaggcugccagugggauacuuggcucagggcagaagggaggugggugggugcagggggagaggagucuucacagcugcaggggaggcuccuccacagccgcccuccccccaacacgccugcaggugggcgugggcacugguugccuuuucuagaaccauuugaaaguuagcugaagacagcauggcacacucccuucaauaggucccacagugaccccgcgcagggcacagcccgggcacccuuguggccucggcuguccucguuggaaccacgaugcucaugguuggcacccuccccucuggccuuugaccuuucacuuuagaagaccugucccugucguggacucuaagcggccaccagugcugcacugggccgggugggggugaagccuguggggcggaguucgucgcccccgugugugguugguuucccacggccuucugaggcugggccguggucagcugcccagaggccaggcugaucggcuucugucgaguccaggacuuagggcugcugauggggcagagccugaccccguggggaucugccugcuuggccugcuccugccgcggccggacgcugcugugggcugcuccuggugucacucucgcccugcuuggccucccucucguucacagccuccugcucuuuguggaugaagcggacgccuuccuucggaagcgagccaccgugagugucacuaagccucuggccacaauggggugguggggugggcacagccgucugccugggccaggcugcagcccucuguucaguuucuuuuucucuguaagcuuugugugaaaaacagcuuuuuuuuuuuuuuuuuuugagaagaaaucucgcucuaucacccaggcuggagugcaauggccccaucucggcucacugcaagcuccaccucccagguucacgccauucucccgccucagccucccaaguagcugggacuacaggcucccgccaccacaccuggcuaauuuuuuguguuuuuagcagagacgggguuucaccguguuagccaggauggucucgaucuccugaccucgugauccucccgccuuggccucccaaagugcugggauuacaggcgugagccaccacgcccagccuuuuaauuaucauucuaagacagggucucugucgcccaggcuggagugcaggggcgaucacagcucacuguugccucgaccucuggagcucaagcaauccuccugccucagccgccugaguagcugggacugcaggggcacaguggaauaccugucuaauuuuuuuguaauuuuaguagagauggaguuuccucacguugcccagacugggcucaaacuucugagcuaaagagauuugccucccuugacguucugaagugcugggauuacagaugugagcccccgugcccggucaggcuuucuuuucuuuuucuuuuuuuuuuuuuuaaggcagaauuuuacucuguugcccacgcuggagugcagcggugcaauuucagcucacuacaaccucugccucccagguuucagugauucucgugccucagccucccacguagcugggacuacaggugcgccaccacgccuggcuaauuuuuguauuuuuaguagagacggggucucaccauguuggccaggauggucucaaacuccuuaccucgugugaucugcccgccucagccucccaaaauccagguuacauucgugagccaccgccccuggcccuggucaggcuuuugagaguagauccaugaaagugucgccaugucccugcucccugcaggagggaggccugugggacuuucugcuguggcuguuuacaaggcuuugcuccuggugccuaaggcuggaaccuucucucugcaggagaagauaagcgaggaccucagggccacacugaacgccuuccuguaccgcacgggccagcacagcaacaagugagggagccccucggguccugggcccccgggcagggcugugcagccgucgcccuugguucccaccgagggaccugaggggcccuggcucacagugcugggcagcugccguggccucaacaugcccaccucggauguccccugggaacggcccagcucgggacagcacggggugucacugaggaacaugcgggggccucccgggcagagcuggggucaguccuguccucacggcccugugcgccgccgccccagcuugcaggucccucugccccuagguuucugcgguccugugccugcaagggagguggucucaucgugugaggcucugcugggucucccuuggagggugugugugcccuggggugggagauggagacaaguuugcucccacgggaaguuggacaccagcagguccugugugucggggcggaaccugggaccuuggucccccgcccggaugcuggccaagggugcacccuccaggcuuggggcccacccgacuuuguguggccucugugggcugccgcccagaggucccccauagggugaccgccccauggccaggcucccuagucccucccaaguccccuaauuuugaguuuucuuggucuccugggccccuccagccccagucacgugucacacggaggaucaaguccugcuggucggccguggcugacuccucaggcacguugggcucccaggucagcugcugccgguggaugcucccuggagcccugacucggguccuucccagagaggcaaggcuggggcccugcugagccuccagugaacccgggccccugagguccugcuccuggcacgugugggcgacuucucgacauggacuccgggucccgaaucccugcucccagcacagcaggggucaggcagcaggagagagugguguucccggcacugccuaucaggcugggcgagggucagcgggaaagcacuauauggagggagaacagaggcccaggaagccaggccgggggacagcugggugcaguggggcagguggccgaccagggcugugcccguguccucguguuucccgccacuuuagguucucccugugggggcugaggaggccccguuccccuuggugcagcucggccggcagccccagcauccucauccucauccccgccccgcagguucaugcugguccuggccagcaaccaaccagagcaguucgacugggccaucaaugaccgcaucaaugagaugguccacuucgaccugccagggcaggaggaacgggagcgccuggugagaauguauuuugacaaguauguucuuaagccggccacagaaggaaagcaguaagugucccgccccaccagcccccguccaggggcccucgcucaggguccaccccgacccacaguccaccaucacuuacaaaccuuuaacauuccuuuuuuuuuuuuuuuuuugagacaaagucucauucuugucgcccaggcuggagugcagugacacgaucucagcugacugcaaccucugccucccggguucaaacaauccucuugccucagccuccugaguagcugagauuacaggcgcccaccaccaugccuggcuaauuuuuuuuuaauuuuuaguagaaaugggguuuuaccauguuggccagguucgucucaaacuccugaccucaagugauucacucuccucagccucccaaagugcagggauuacagaugugagccaccgcgcccggcgucuuuuccauuccucuucacuacgaggagggcugugaggaaaucuugugcucggccacccccaggcccuggcugugaggggaggugauacggaguguugcucugagacccccgugucgggauucgaaggagucucuccucaugagacccccgugucgggacuggagggagaggcuccucaugguccacugcuggcuucuggccuggccucccuccagcugccacacccggcccuggagccucgugguguggggcacggcucuugcugcucacgugccuugaggcugucaggcucccuguugcuggcggugggugcagcaggcacggugggcagagcccuccaggugaugaggggcccuggcaccacacaccggcugccucgggaacacuccagaugagcagaggcugcuccacuucuuggcgucccccgggccccgguuucugaguccuucugugcaccugacccaaaucccugcugucgccagugaugacaaaagagagccugguugccgcugccgccugcuccaugccagcccagcuuuccgggccucaguuucccuaugcccuccccuucccugggcucccccacccccauggcugcucguagcccuggcaccaugacuuggcuucuguggccuccaggcagacgcuuuugcuagaagucggggcuccgccacugccagcauaaaggccaccugcccugcgggugcugagugagcagcugugggcagggcuggugugaggagugguuggggccaucuccaggcccugcagccacucccugcucaguccgggccuggccugcagcagggaggauguggagcugggcugucagaaguagagagccccuccaaagaggauguuuggcgugggugucggccucgcugccugucuuccggccuccaccucguguugugggagcugcugccuuggccggcccacuugggaacuccuuccccaggcgccugaagcuggcccaguuugacuacgggaggaagugcucggaggucgcucggcugacggagggcaugucgggccgggagaucgcucagcuggccguguccuggcaggugagucaggcuccggcacguccacccagacgggaccccagcugcuguggagaugcucaguugcgccaggccugucccagcaccggugucacgcgggagcuucuguugagggguuuucagugcacagaggugacacagggcccccugccccagucaggccacuccacgaggcaucgcgcaccugcucgugcccucaggaggguggagccaugucgguggcugacagucacccggggcucucuggaggccagucuggcaucgccguagcccgagcuuugccagguggggcuggaggcuucugacucucaccuuggccaauaggcaccucccuguguaaauggucguuaggacaggccccaugugaguuggggguucgggguggagggacauuguguuuucuggaccaagucugugggcuugguccugcuugacacaugggugggaguggccucugguugucccacagccaguuguucuucggggacaccccuccugcagcuccguggcugcuccagggcugaggagccaggacucacaggagugugggcguggccauccagaaagcuuuggucuuuggggguugcuggaaaagcaaaaccagguugguggggcagaaggcacccuggccacgcacaggcaucaccaccucugggguccgcagagucuguguaacaaccugguuccucaaucuagcagugcuuuugaaugaacgugugacagcuuaaugaagcagccgaguaccuugauuugaauguuggagccgggguucacagggggcuguauuagucaguacaggcuggguuaugccacugugacaaagagccccagaucucaaaccccguccuugugggucagcugaggucucuguuccaggccauccccacuuggaaccaggucuguuuccacaacuaagaaagcagaggccggguauggugguggcugacgcuuguauucccagcauuuggggaggccaaguuagauuauuugaagccagggguuuaggaccagccuggaaagcaaggcaagaccccaucucuacaaaaaaugaaaaaauuagcuggaccugguggcacaugccuguaaugccagcugcuugggaggcugaggugggaggaucacuugaguccaggagguggaggcugcagugagcugugauugccacugcacuccagccuggauuacagagcaagacccugucuuaaaaacuaagaauaauggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcaugaacccgggaggcggagcuugcagugagccgagaucccgccacugcacuccagccugggcgacagagcgagacuccgucucaaaaaaaaaaaaaaaaaaaaaaaaaaacuaagaauaauuuggaacgagugcgguggcucacuccuguaaucccagcacguugggaggcugaagugagaauaucauacaccugaggucaggaguuugagagcagccuggccaacaaggccaaucucaccuccacuaaaaauacaaaaauuaccccggcacauuugugguguaugccuguagucccagcuacucaggaggcugagccaggagaaucucuugaauccaggaggcggaggaugcggugagcugagauggugccacugcccuccagccugagcaauagcgugagacuccaucuuaaaaaaauaguaauaggccaggugcaguggcucacaccuguaauccuagcacuuugggaggccaaggcgggcagaucacgaggucaagagauggagaccaucuggccaaauggugaaaccccaucucuacuaaaaauacaaaaauuagcugggugugguggcgcaugccuguaaucccagcuacuugggagaaugaggcaggagaaucacuugaacccgggaggcggagguugcaaagagccgagauugcaccacugcacuccagccuggcaacacagugagacuccaucccaaaaaacgaaaacgaaaacuaaaaauaauaauaacuggggcuggacgggcgcgguggcucaugccuguaaucccagcacuuugggaggccgagaugggcggaucaugaagucaggaaaucaagaccauccuggcuaacacgguggaaccccaucucuaauaaaaaauacaaaaaaaaaauuagccagaugugguggcgggugccuguagucccagcuacuugggaggcugaggcaggagaauggcaugaacccgggaggcagagcuugcagugagccgagaucgcaccacugcacuccagccugggcgacagagcaagacucugucucaaaaauaaaaaaauaaaaaauaaaauaauaauuugggcugggcacgguggcucacaccuguaaccacagcacuuugggaggcugaggcaguggaucuccuugaguucaggugaucugcccccuuuguccucccaaagugcugggauuacaggugugagccaccaugcacggcaucuugaauucuuuucucauaaaaggguuuugaauuuggucgaaugcuuuuccugcaucagaugagagggucauguaguuuccuuccuccacucggcuaauauugauugauuuuuguauguugaacauuuuuuauguggaacauugauugauuuuuguacguugaacuauccuugcauuccaggaauaaauccugcuuggucaggguguauaauuuuuuuauuauacuccugaauugguuuugcuggcauuuuguugaggacuuuuccaacgaugcuuaucagggauauuggcaugucauuuuucuuguggugucuuugucuggcuuugauaugaggguaaugcuggccucuuaggaugagugaggaaauguucuucaauuuguccaagaguuugaggagugauacugauucuucuuaauguuuugugaauucacaugugaagacaucagguccaggucuugucuuucaacuuuuauaguuugaagauuuuagguucccagaaaaguugcaagaguagcacagagacuuccugggccugggaccuugccacguggugaacaucaugugucacuguuggacccaccugugacuggguuuugccccagaaucccacccaggacgccacgugacauuuagcugucacuucuggugggcuccugccaggucccgugcuuccuggagggguggccccgugagcaucugcauagccccuuuccucugcugggcccuggguggggugcagccacucggguggacccugagggucccugcaccuguuugcccucucuugggugcgcucaagaccaaaaaugauguugagcaguccugggccccggacccacagugguggugcggcucuggucagugucuccugcgcucccaggccccugacccacaguggcggugcggcucuggucagugucuccugcacuccggggccccugacccacaguggcggugcggcuccggucagugucuccugcgcucccgggcccccgacccacaguggugguccggcuccggucagugucuccccacacaguggcucuuggugaggggugggcgcuugcagaggggacgggcaccacguggucauccccauggcagguuccgucguggcgacgguguugugggaggauggugugcugcugccccugcaccccgugagaugaauccugccucugggagguacagcugggacggggcgagggacccacucagcuguccaggaaggguccccugcccugugcuuccuccagguguccuggugcgcuccugagcacggugcccaguggggguccccacacccugacccugacccugacccacgggugccuccccuuggggacuccacgcccuucgcuggcauugggauggagagugacccguucauugcagaagggcuggaccugaggcugccugaagccacaccaagggccacagccccagcagcuccagccuucacgugccagaugccaagcccugugcucaggaggacagggaggugggggcagagguggccuuggugccaccacucaugugccucaaggugggcaguggcugccucugcccuggaggccugugagggucagggucugagggucugaggugcacuaugacccgggggcacugccuggccacggcugagacucgcagagggucugcaguucccaccugccucucggaagcugcccugggucggcggucagugaggcuccgccuugggcuuucuauuauuagaaagucauugagcaacagcagugcugaggacgcaggcagggcugugggcacugcaggggcugcucccgguguccacacacgugcugggcucugccgaggugcgggaagccuguguuucacgcucaggccauccuggagccccugguuuggucccuccccaccucggggcccuggcgugcauuuggggugggggguucccauggcggccucccucagcugccucucuccccacuaggccacggcguaugccuccgaggacgggguccugaccgaggccaugauggacacccgcgugcaagaugcuguccagcagcaccagcagaagaugugcuggcugaaggcggaagggccugggcguggggacgagcccuccccauccugaguccacagggagauccacagcucacggagccuggccgcggaccccucccaccccugccuugccggccccugcacauuuaggauaugcuccuggguggggacugggcugugcccagggccucugucccccaggaugucuuguggugcgggucggccguucugccccccagggcacccccuguuguaggcacuggcuagggaggggcaggccuccuuccugccccucgagacacucuuggga

SEQ ID NO: 17760 - RNA, 22111 nt, Homo sapiens
ucccaagagugucucgaggggcaggaaggaggccugccccucccuagccagugccuacaacagggggugcccuggggggcagaacggccgacccgcaccacaagacauccugggggacagaggcccugggcacagcccaguccccacccaggagcauauccuaaaugugcaggggccggcaaggcaggggugggagggguccgcggccaggcuccgugagcuguggaucucccuguggacucaggauggggagggcucguccccacgcccaggcccuuccgccuucagccagcacaucuucugcuggugcugcuggacagcaucuugcacgcggguguccaucauggccucggucaggaccccguccucggaggcauacgccguggccuaguggggagagaggcagcugagggaggccgccaugggaaccccccaccccaaaugcacgccagggccccgagguggggagggaccaaaccaggggcuccaggauggccugagcgugaaacacaggcuucccgcaccucggcagagcccagcacguguguggacaccgggagcagccccugcagugcccacagcccugccugcguccucagcacugcuguugcucaaugacuuucuaauaauagaaagcccaaggcggagccucacugaccgccgacccagggcagcuuccgagaggcaggugggaacugcagacccucugcgagucucagccguggccaggcagugcccccgggucauagugcaccucagacccucagacccugacccucacaggccuccagggcagaggcagccacugcccaccuugaggcacaugagugguggcaccaaggccaccucugcccccaccucccuguccuccugagcacagggcuuggcaucuggcacgugaaggcuggagcugcuggggcuguggcccuugguguggcuucaggcagccucagguccagcccuucugcaaugaacgggucacucuccaucccaaugccagcgaagggcguggaguccccaaggggaggcacccgugggucagggucagggucaggguguggggacccccacugggcaccgugcucaggagcgcaccaggacaccuggaggaagcacagggcaggggacccuuccuggacagcugagugggucccucgccccgucccagcuguaccucccagaggcaggauucaucucacggggugcaggggcagcagcacaccauccucccacaacaccgucgccacgacggaaccugccauggggaugaccacguggugcccguccccucugcaagcgcccaccccucaccaagagccacuguguggggagacacugaccggagccggaccaccacugugggucgggggcccgggagcgcaggagacacugaccggagccgcaccgccacugugggucaggggccccggagugcaggagacacugaccagagccgcaccgccacugugggucaggggccugggagcgcaggagacacugaccagagccgcaccaccacuguggguccggggcccaggacugcucaacaucauuuuuggucuugagcgcacccaagagagggcaaacaggugcagggacccucaggguccacccgaguggcugcaccccacccagggcccagcagaggaaaggggcuaugcagaugcucacggggccaccccuccaggaagcacgggaccuggcaggagcccaccagaagugacagcuaaaugucacguggcguccugggugggauucuggggcaaaacccagucacagguggguccaacagugacacaugauguucaccacguggcaaggucccaggcccaggaagucucugugcuacucuugcaacuuuucugggaaccuaaaaucuucaaacuauaaaaguugaaagacaagaccuggaccugaugucuucacaugugaauucacaaaacauuaagaagaaucaguaucacuccucaaacucuuggacaaauugaagaacauuuccucacucauccuaagaggccagcauuacccucauaucaaagccagacaaagacaccacaagaaaaaugacaugccaauaucccugauaagcaucguuggaaaaguccucaacaaaaugccagcaaaaccaauucaggaguauaauaaaaaaauuauacacccugaccaagcaggauuuauuccuggaaugcaaggauaguucaacguacaaaaaucaaucaauguuccacauaaaaaauguucaacauacaaaaaucaaucaauauuagccgaguggaggaaggaaacuacaugacccucucaucugaugcaggaaaagcauucgaccaaauucaaaacccuuuuaugagaaaagaauucaagaugccgugcaugguggcucacaccuguaaucccagcacuuugggaggacaaagggggcagaucaccugaacucaaggagauccacugccucagccucccaaagugcugugguuacaggugugagccaccgugcccagcccaaauuauuauuuuauuuuuuauuuuuuuauuuuugagacagagucuugcucugucgcccaggcuggagugcaguggugcgaucucggcucacugcaagcucugccucccggguucaugccauucuccugccucagccucccaaguagcugggacuacaggcacccgccaccacaucuggcuaauuuuuuuuuuguauuuuuuauuagagaugggguuccaccguguuagccaggauggucuugauuuccugacuucaugauccgcccaucucggccucccaaagugcugggauuacaggcaugagccaccgcgcccguccagccccaguuauuauuauuuuuaguuuucguuuucguuuuuugggauggagucucacuguguugccaggcuggagugcaguggugcaaucucggcucuuugcaaccuccgccucccggguucaagugauucuccugccucauucucccaaguagcugggauuacaggcaugcgccaccacacccagcuaauuuuuguauuuuuaguagagaugggguuucaccauuuggccagauggucuccaucucuugaccucgugaucugcccgccuuggccucccaaagugcuaggauuacaggugugagccacugcaccuggccuauuacuauuuuuuuaagauggagucucacgcuauugcucaggcuggagggcaguggcaccaucucagcucaccgcauccuccgccuccuggauucaagagauucuccuggcucagccuccugaguagcugggacuacaggcauacaccacaaaugugccgggguaauuuuuguauuuuuaguggaggugagauuggccuuguuggccaggcugcucucaaacuccugaccucagguguaugauauucucacuucagccucccaacgugcugggauuacaggagugagccaccgcacucguuccaaauuauucuuaguuuuuuuuuuuuuuuuuuuuuuuuuuugagacggagucucgcucugucgcccaggcuggagugcaguggcgggaucucggcucacugcaagcuccgccucccggguucaugccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccauuauucuuaguuuuuaagacagggucuugcucuguaauccaggcuggagugcaguggcaaucacagcucacugcagccuccaccuccuggacucaagugauccucccaccucagccucccaagcagcuggcauuacaggcaugugccaccagguccagcuaauuuuuucauuuuuuguagagauggggucuugccuugcuuuccaggcugguccuaaaccccuggcuucaaauaaucuaacuuggccuccccaaaugcugggaauacaagcgucagccaccaccauacccggccucugcuuucuuaguuguggaaacagaccugguuccaaguggggauggccuggaacagagaccucagcugacccacaaggacgggguuugagaucuggggcucuuugucacaguggcauaacccagccuguacugacuaauacagcccccugugaaccccggcuccaacauucaaaucaagguacucggcugcuucauuaagcugucacacguucauucaaaagcacugcuagauugaggaaccagguuguuacacagacucugcggaccccagagguggugaugccugugcguggccagggugccuucugccccaccaaccugguuuugcuuuuccagcaacccccaaagaccaaagcuuucuggauggccacgcccacacuccugugaguccuggcuccucagcccuggagcagccacggagcugcaggagggguguccccgaagaacaacuggcugugggacaaccagaggccacucccacccaugugucaagcaggaccaagcccacagacuugguccagaaaacacaaugucccuccaccccgaacccccaacucacauggggccuguccuaacgaccauuuacacagggaggugccuauuggccaaggugagagucagaagccuccagccccaccuggcaaagcucgggcuacggcgaugccagacuggccuccagagagccccgggugacugucagccaccgacauggcuccacccuccugagggcacgagcaggugcgcgaugccucguggaguggccugacuggggcagggggcccugugucaccucugugcacugaaaaccccucaacagaagcucccgcgugacaccggugcugggacaggccuggcgcaacugagcaucuccacagcagcuggggucccgucuggguggacgugccggagccugacucaccugccaggacacggccagcugagcgaucucccggcccgacaugcccuccgucagccgagcgaccuccgagcacuuccucccguagucaaacugggccagcuucaggcgccuggggaaggaguucccaagugggccggccaaggcagcagcucccacaacacgagguggaggccggaagacaggcagcgaggccgacacccacgccaaacauccucuuuggaggggcucucuacuucugacagcccagcuccacauccucccugcugcaggccaggcccggacugagcagggaguggcugcagggccuggagauggccccaaccacuccucacaccagcccugcccacagcugcucacucagcacccgcagggcagguggccuuuaugcuggcaguggcggagccccgacuucuagcaaaagcgucugccuggaggccacagaagccaagucauggugccagggcuacgagcagccaugggggugggggagcccagggaaggggagggcauagggaaacugaggcccggaaagcugggcuggcauggagcaggcggcagcggcaaccaggcucucuuuugucaucacuggcgacagcagggauuugggucaggugcacagaaggacucagaaaccggggcccgggggacgccaagaaguggagcagccucugcucaucuggaguguucccgaggcagccgguguguggugccagggccccucaucaccuggagggcucugcccaccgugccugcugcacccaccgccagcaacagggagccugacagccucaaggcacgugagcagcaagagccgugccccacaccacgaggcuccagggccggguguggcagcuggagggaggccaggccagaagccagcaguggaccaugaggagccucucccuccagucccgacacgggggucucaugaggagagacuccuucgaaucccgacacgggggucucagagcaacacuccguaucaccuccccucacagccagggccuggggguggccgagcacaagauuuccucacagcccuccucguagugaagaggaauggaaaagacgccgggcgcgguggcucacaucuguaaucccugcacuuugggaggcugaggagagugaaucacuugaggucaggaguuugagacgaaccuggccaacaugguaaaaccccauuucuacuaaaaauuaaaaaaaaauuagccaggcaugguggugggcgccuguaaucucagcuacucaggaggcugaggcaagaggauuguuugaacccgggaggcagagguugcagucagcugagaucgugucacugcacuccagccugggcgacaagaaugagacuuugucucaaaaaaaaaaaaaaaaaaggaauguuaaagguuuguaagugaugguggacugugggucgggguggacccugagcgagggccccuggacgggggcugguggggcgggacacuuacugcuuuccuucuguggccggcuuaagaacauacuugucaaaauacauucucaccaggcgcucccguuccuccugcccuggcaggucgaaguggaccaucucauugaugcggucauugauggcccagucgaacugcucugguugguugcuggccaggaccagcaugaaccugcggggcggggaugaggaugaggaugcuggggcugccggccgagcugcaccaaggggaacggggccuccucagcccccacagggagaaccuaaaguggcgggaaacacgaggacacgggcacagcccuggucggccaccugccccacugcacccagcugucccccggccuggcuuccugggccucuguucucccuccauauagugcuuucccgcugacccucgcccagccugauaggcagugccgggaacaccacucucuccugcugccugaccccugcugugcugggagcagggauucgggacccggaguccaugucgagaagucgcccacacgugccaggagcaggaccucaggggcccggguucacuggaggcucagcagggccccagccuugccucucugggaaggacccgagucagggcuccagggagcauccaccggcagcagcugaccugggagcccaacgugccugaggagucagccacggccgaccagcaggacuugauccuccgugugacacgugacuggggcuggaggggcccaggagaccaagaaaacucaaaauuaggggacuugggagggacuagggagccuggccauggggcggucacccuaugggggaccucugggcggcagcccacagaggccacacaaagucgggugggccccaagccuggagggugcacccuuggccagcauccgggcgggggaccaaggucccagguuccgccccgacacacaggaccugcugguguccaacuucccgugggagcaaacuugucuccaucucccaccccagggcacacacacccuccaagggagacccagcagagccucacacgaugagaccaccucccuugcaggcacaggaccgcagaaaccuaggggcagagggaccugcaagcuggggcggcggcgcacagggccgugaggacaggacugaccccagcucugcccgggaggcccccgcauguuccucagugacaccccgugcugucccgagcugggccguucccaggggacauccgaggugggcauguugaggccacggcagcugcccagcacugugagccagggccccucaggucccucggugggaaccaagggcgacggcugcacagcccugcccgggggcccaggacccgaggggcucccucacuuguugcugugcuggcccgugcgguacaggaaggcguucaguguggcccugagguccucgcuuaucuucuccugcagagagaagguuccagccuuaggcaccaggagcaaagccuuguaaacagccacagcagaaagucccacaggccucccuccugcagggagcagggacauggcgacacuuucauggaucuacucucaaaagccugaccagggccaggggcgguggcucacgaauguaaccuggauuuugggaggcugaggcgggcagaucacacgagguaaggaguuugagaccauccuggccaacauggugagaccccgucucuacuaaaaauacaaaaauuagccaggcgugguggcgcaccuguagucccagcuacgugggaggcugaggcacgagaaucacugaaaccugggaggcagagguuguagugagcugaaauugcaccgcugcacuccagcgugggcaacagaguaaaauucugccuuaaaaaaaaaaaaaagaaaaagaaaagaaagccugaccgggcacgggggcucacaucuguaaucccagcacuucagaacgucaagggaggcaaaucucuuuagcucagaaguuugagcccagucugggcaacgugaggaaacuccaucucuacuaaaauuacaaaaaaauuagacagguauuccacugugccccugcagucccagcuacucaggcggcugaggcaggaggauugcuugagcuccagaggucgaggcaacagugagcugugaucgccccugcacuccagccugggcgacagagacccugucuuagaaugauaauuaaaaggcugggcgugguggcucacgccuguaaucccagcacuuugggaggccaaggcgggaggaucacgaggucaggagaucgagaccauccuggcuaacacggugaaaccccgucucugcuaaaaacacaaaaaauuagccaggugugguggcgggagccuguagucccagcuacuugggaggcugaggcgggagaauggcgugaaccugggagguggagcuugcagugagccgagauggggccauugcacuccagccugggugauagagcgagauuucuucucaaaaaaaaaaaaaaaaaaagcuguuuuucacacaaagcuuacagagaaaaagaaacugaacagagggcugcagccuggcccaggcagacggcugugcccaccccaccaccccauuguggccagaggcuuagugacacucacgguggcucgcuuccgaaggaaggcguccgcuucauccacaaagagcaggaggcugugaacgagagggaggccaagcagggcgagagugacaccaggagcagcccacagcagcguccggccgcggcaggagcaggccaagcaggcagauccccacggggucaggcucugccccaucagcagcccuaaguccuggacucgacagaagccgaucagccuggccucugggcagcugaccacggcccagccucagaaggccgugggaaaccaaccacacacgggggcgacgaacuccgccccacaggcuucacccccacccggcccagugcagcacugguggccgcuuagaguccacgacagggacaggucuucuaaagugaaaggucaaaggccagaggggagggugccaaccaugagcaucgugguuccaacgaggacagccgaggccacaagggugcccgggcugugcccugcgcggggucacugugggaccuauugaagggagugugccaugcugucuucagcuaacuuucaaaugguucuagaaaaggcaaccagugcccacgcccaccugcaggcguguuggggggagggcggcuguggaggagccuccccugcagcugugaagacuccucucccccugcacccacccaccucccuucugcccugagccaaguaucccacuggcagccuccacacgcugggggccucguguccaccaggguccacacucaggggacuuucccuccgagggacccuccacugggccuccugcguggccacaaggacagagcugcagaaagacaggguccccaagagacaccuggacccccuucccagaaggcagccugcugggccgcagccaagggccuggugcaugcuguggggacgucucacccgcgccggcugguauuggcccagucaaagagcuugugcauggcggucacgccuucccgccccaugggggccacguccccgccugucaugauggcguaguccaugccugagugcagggcgaguuucuggacaggaagagugaggggagacagagcagauguucccuccgccucugcaaagccugcacacuccacccggaguguggaggcucugcccagcgucccugccuggaagccacagccugccagacaggagacgucccccgccuggaagaugggaggcgcugcugcccacaccagcacccugagccuacacgagggugggcaaaggccuaagggggguccauuccccaggcagcugagccccccagacaccugcaggcaggugagaccccagcggccccuggcccaccuguucagccaggcgcucucaccuuggcaaacagcgucuucccggugccugguggcccguacaucaggauguuccuguacaggcugcgguucuucuugguguuccuuguugcuauggcgaugucgcgcacccgugcuuccaggcugggcugccggggaagacggggguuuggaggagacacugugcacccauggaagccucaggggaaggggcugcgggaaugccugggugcagacucggcuccucgggaagccucccaccucaggggcagccuaucuauccccagcacgguccaagcagucgcaucucaggacccaaaagcuccugggugccaccacgagcgccagcaagggccacagcccggcccagcuccaggguccccucccugcgccuccccggucccaggcacaccgacuuacacugagcacaacacccuccagcgcguccuggggucgacugaggagccgccggcugaccugccggaggggaaggggaagcgccaucgggucaccugccacagccacggaacagccaccaacgcgcacacacacgcucgguaacacgcagaaacggagcugccccaaagcacagccaggaccggcccggagcuggaacccugccccgcccggagaccaggcggcuauugcugggauuaggggcauuuuccgguuccuuauuggcuuuuauuuucuuaaccaccuacccagugaccuguggagagcaggcaccucgggggcggcgagcggcgcggcuccccagggaggccaccagacgccguggccuguagcagcuucccugauagacggccgcacacccaagucccgggucuugcaaggaccccgaugugcucccaggccccaucaagagcccugagcaggggacaccgaggcagacaggggaagggucucacugaugcagaccccuaagguacagcgccagacaggaaaacccacccgugaagcagugugcgggugcccguuauccggggaaagggaagggacgggagggugugcgugggcugugcucguggggcagaagggacucagccaggaacugcacucagggagggccaggccugcgcugcuaccuggauggggugccgcagcgccucaagcaccgugaugcgggacgucucccucacuagggacggcuuccccagccgagccucgaugaagcggccggcgacaagcguggcauucuuggcugaguagaccccaacagccagcagcgucagcccagccaccugcagcagagacaccgcacuggcgcaccggcccccaccgucccucccucuuagagcaggagacgcacggggcugcccccacccucucuccgcccgagggagaagcacagggccgugcacuggccccacaggaacgcgaauucccggccccgaaucccacagccacgcgguuacaggaggcagguggggcagucacagcgcccucacucagggccauuuucucugcaacuggcagcauaaauccuagaaagccucggucgcugagcggggcccuggacagacccagccggaugucacagggccacacccucugguacauucuuggccacuaaaaaugguacuuuauuccuggaaaacaagacuaacccaaaaucucuaacucguuuuaaaaaucaauuaggcuggcugggcacaguagcucaggucuguaaucccagcacuuugggaggcugaggcagguggaucaccugaggucaagaguucaagaccagccuaacccacauggagaaaccccgucucuacuaaaaauacaaaaaauuagcuggccaugguggcacaugccuguaaucccaucuacuugggaggcugaggcaggagaaucucuugaacccggaaggcaaagguugcaaugagcuggacccgcgccacuacacuccagccuaugcaacaagagcaaaacucugucucaaaaaacaaacaaacaaaaaaugaauuaggccaggcccgguggcucacccguguaaucccagcacuuugggaggccaagacggcuggaucacuuaaggucagaaguucgugaccagccuggccaacauggugaaaacccaucucuacuaaaaauacaaaaauuggccgggccugguggcacaggccuauauuagcugaguguggugacgugagccuguaaucccagucacuugggaggcugaggcaggagaacugcuugaacuggggagguggagguugcagugagccgagauggcaccauugcacuccagucugaccacagagcaagacccugucucuaaaaacaaacaaacaaaagucaucggcgcauuaagcagcuccgucauguccucacgugacacggucucaccaacaugguggcaacaccaccugcaacauucaccgucacacugaccaggccaccggcaggcgcugcagucacagcucugggcgccggcaccacggcagagcaagugcccacucagugccgggcaccuaccgugugcugggcgggguggggacggaggacacagccaugugggacguggggcgccaccacagcaggccggaggcugggcacaaaagagugaggcuuuaaacgagagaagaaucugugaacuucaaacucucaggguuuuauaaggaauaaagaagguuuuugcaaaauggagucaggguugccuucugguuuuuuuuuuuuuuuuuuuuuuuuuuuuuuugagaagaagccucacuauguggcccaggcuggagugcaguagcgugaucucgacucacugcaagcuccgccucccggguucaggugauucuccugccucagccucuugaguagcugggacuauaggcgcccgccacugcgcccggcuaauuuuuuguauuuuuuuaguagagacgggguuucaccguguuagccaggauggucucgaucccgauaucgugauccgcccgccucugccucugccucccaaagugcugggauuacaggugugagccacgacuaucgacaauuuuuuucuugagacaaggacuuugucgcccaggauggagugcagugcugcgaucucagcucagugcagcugcaaccucccugggcuuaagugauccuccuaccucagccucuugaguagugggaccacaggggcugccaccacacccagcuaauauuugauuuuuuguagagauggggucucacuguguggcccaggcuggcaacugcguuuucuucucccagcuugagaagggaggagaagccgaggccagcagguacaacgugggcuuccucccugcugggagagcuacagggcugugcagagccggcagggacaggaccuggggcuccaggaggcccccacaugcugccccucagccaccugccagcccuguuuuaugaguauguuuaccguggcugucacuuugucccagucugucacaaaggcacggaauccuuccccaaacaaggugccagccguccugcggggaaagcaguggugugaccaggaaggacacgaagauccgugccacgcagcgagagcagguugagggugaggcccugacauggcggcacggccuugccaggacagaggggcagugcccccaccaaggagucagccuacggcggcaaggccuggaagagcuggagagcgcccugggaccagcgacucacaccugcggggcuccaucuguggccggcccgggccucggcagugcucaccugauggacuccaagacggucugacggugcucggccgccuucaggcggaucugcucgcggaugaugucugcauucucccgcucggccuuggcgcgcgcccgggccucggccuccacucgcagcaucucauucuugugccgcagcuccaucucccgcuccacgguggcugccccagagaggcagggcagcucagcaccaugcagugcagcgcguccaccuccacccacacuguggaccggcccacgccacggaccggcccacgccacggacagaccaacgccacagacaggcccaugccacggaccggcccacgccauggacaggcccacacugcugacaggcuaaggccacggacaggcccacgccacagacaggcccacgccgccaauaggcuaaggccacggacagguccaugccacagacacacacagaccuugguagggacagcgccacaggccggcccugcccauggauuagggcagaaauccgacccagaggccuaggcaacuucucaggacgagcucuuugaagcaaaaaaccagaacgcggaguucugaaggaagccccccucacacagaaacacagcugucagaacucagacacgcgugacgugccacgugccuggcuacugaacauuaaacgcacacaccucgccacaagcccacccacggugaagaguggugacagacguuugccuggagcacucgccaacaaaugccacauggcaccaaauaccugugauccccacugaaaccaggacaguaaagacccauguucuaggcagaacgcagaggcucacgccuguaaucccagcacuguggaaggccaaggcaggcggauaaugagaucaagaaguucaagaccagccuggccaacacagugaaacccuuucucuacugaagauacaaaaaaauuagcugggcgugguggcgggagccuauaaucccagcuacucgggaggcugaggcaggagaauugcuuaaaccugggaggcagagguugcagugagcugagaucgugcuauugcacuccugccugggugacagagcgagacuccgucucaaaaaaaaaaaaaaggccccuguacuucccaugaagugaagcagcuccugcccucccugaacagauccuggcguccacucgcagacagaggugucuuccgagaggcagccccaccccgcggagccccagcaggccucgcccacugcacugguagcuaugaggggccgggcggcagaacucaggcucagagugcacgccggguccacaagcagcccccgccaccuccgccccagccaggagagcagacagccuaccucgccgcauggcuuccugcuucugcacggacuccuccugcuuccguaaauucuccucauugagaaguugcugagaagaagccgcagaaaaagagaaaagccuuuaaaaccugugacugugcccaugugugcgggggaugacugugcccgagugugcaggggggugagugugcccguuugcggggugugacggugcccguuugcggggggugacggugcccgaaugugcaggcgggugacugugcccaugugugugggggugauugugcccauguguggguggguugugcacccguuuggguguguguguguguguguguguguacccgugcgggggguggggggguugugcgugccuguggggggggguguguacgcccgugugugggugugugcccaugugcgggugugugugugugucccugugacgggaaggcgugugugcccguauguguguguggggucugugcgcccauguggggggguugugugcgugcccaugugugcgggggggcugugcccauguguauagggggguguacgcgcgcccauguguguggguguguguguguccgucuaugggggggcaugcccaugugugugugggugugcgccuguguguguggggcugugugugugcccgagugcgcgggugccagugagccugugggggguaugugugcgccuguguguguguggggggguacguaccuguguguggugugugugugcguaucugugugugugugugcgggguguaugugcguaccugucuguauggggguguguuuacaggugugaguguccaugugggugugugccugcccguguuguguggggguauguuugcgggugugugagugcaggccucugugugggggugucugugugugggcccgugugugcaggggugugugugugcccgugugugcagaagugggugcaccugucugugugugcugggagugugugugcgaggaguguguguccguguggguaggugccugugucuccauguacaugugugcacacgucugcaugugugccuguacacgugugcuggugcgugucuguccgaguaguuuccccugcucuagcacccaccgucagcaaccccagcguucuugccccguggccucugacccacugacuggucccacaaagccaccuacguucucagggacgcaggcgccucgcaggggaggcugagcucaccugcugcuucaguugguccucguagcgcugccgggccagcuugucuugauacugggcccucugggggagaagagggcggcaaagacacaucucagccgggagcugcagucugggccgacugggcggagcgccggggacuccgacgcgccaucagccucacacaaacguggggaggcgcggggaccucccguccggcucagcagugagggaccuuacaggucuuaggcguuugugcaaggccguuccgagggcagcucuaauggcugacuccagagugccccgggaccacacccagcucccaguccugccccaggccgcuccccgcagccgggcggccucccucgcggccucuugcgcucuuacggccuggugcugccgggucuccucgcucagggucuuccuccucuccucagccugcgcccggaucugcucgcucuugagcugcuccacggcggccucauacuccugcagagcacagcacucaccagcuggcacuugcucagggcuggcacugccugacagccgcuccugugucugcacggcuccggcacggcagagacuccaugcccagacuagugugugcagcaggcucagggcuuccagccgcaucugcacccaggaucaggcccuggaggaauccagacccacaggcacagaagcaccagcagaagcccgcgaaggccccccgggagggaggccggacacccccuuuuggacugcacugagggcagagcucaugcuuauuuuaggaauccugcugaguggaccgggugcgacggcucucgcuuauaaucccagcacuuugggaggccaaaguggguggaucaacugagguuaguaguucgagaccagccugaacaacauggugaaaccccaucucuacuaaaaauacaaaaauuagccagaugugguggcgggcucuuguagucccagcugcucggaggcugaggaaagagguugaacccgggagguagagguugcggugagcugagaucacgccacugcacaccggccuggaagacagacuaagacucugucuauaaaaaaauaauaauaugaaacaaggcaggcacaguggcacaagccuguaaucccagcacuuugggaggccgaggcagguggaucacuugaagucaggaguucaagaccaggcuggccaacauggugaaaccccgacucuacuaaaaauauaaaaauuagccaggugugguggcgggugccuguaaucccagcuauucaggaggcugaggcaggagaauugcuugaacccaggagcggagguugcagugagcccagauggcaccacagaacuccagccugggaaacagagacuccguuucaaaauaaauaaauaaaacgaaauaaaacaaaaaaauccugcugaguguaaugaaaugagaagauccaggccauccggacgaccagacgcccucaccaacaccggcccucccuccggacgaccagacgcccucaccaacaccagcccucccucucgggcggcucugcggcagcgucucucaccucccuuuguuuccuucugugaaaugaggcgcccaagcuuggcccugggccccacugcugcccauguacacacccccggcccuacccaccggcaguagcccuaccaaucuccaugcccgaaccccaugugcgccccggccuccccacccacaccggccccacucacuuugagcuuggacuguugcuccaacugcagcgucugcuccugcaucugugccagauucagggcguccuuggcauaaccugcagacgcaaggacacggagggcagguguuaggauacacggaugccgcugggcaggcacgcacaccagccaaggggcuuucuggaauccacggccacgccucgaccucaaagcccccagcccugccuccccauccuccuuccuagucagaccuggcgugacgaugcaccauccccagcacacggccugaugcauuugugagguuuuauccccccagggauggucuuggagagccacaucaggaaggccaucccacguggacgggaggaggcucuuucccaauucaacagaaagucaggcgauggcuaaaguguccucuauuuuuucacguuacauucgcuuuuccuaagcuuccaauggcuguugucauugaucugcuaucaagcacaugcaggcaagaaagggaaugaauaagaauaggauaccagccaacaagcucagggugacgaggacaagcaucugacaacguccucaguuacguuuuguuccuagaggggaacugacacaggucgauguuugggugucgugggacagaaguacguauucucugagcugcugaggccucagcaucaggucucaaaauuuucugggaugacaguuuucccaucauaaaacuuuaccauaaaaaucuuuuggcugggcgcgguggcucacuacuguacucccagcacuuugagaggcugagacggguggaucacuugaguccaggaguuagagaccggccugaccaauguggugaaaccccaucucuacuaaauauacaaaaauuagcugggcgcaguggcggacgccuguaaucccagcuacucugaggcugaggugggaggauggcuugaaccccggagacagaggcugcagugaacccagaucgcaccgcugcacuccagcuagacagagagagacuuaaaaaagaaaaaucuccauccgggccaacauggcgaaacccugucuccacuaaaaagacaaaaaaagagcagggcacaguggugcacgccugugaucucagcuacuugggaggccaaggcuggagaacugcuugaacccaggagguggauguugcgaugaaccgagguugcaccacugcacuccagccugggcgacggacggcaacuccaucucaaauaaauaaauaaacauauaaaucugcuaacacagaaagacacguaaaguaggcagggacccccgaugcuccuggguuggugcguuguucccgucucucuuccucccgcagcccgucucacuuuuuuaagccuucagagucaacugcagcaaacacgucacuaacuagagcccagcgucuguucucagcucagguguaauuuuuggaggugacugacgcagggggaagugccguggggagcacucguugcauuuagacagaggcagcgacgcuuugguguuggggugggucugcuugggccugugguuaggcacgaacugggcugacgggcaucagugucagauuucaggaagcgccuugguagcuaaccucgggggccccagugaacagagcacagaugagaccgggaccugccucucagggaagacagugccaggucaacggguuuggcugcuaagcucgggaagccaagggcugaagcgaccccgggcucucaaccacucucacucugaccccgaggggacugagggugugucagucacccaggguccugccacagagcagugacaggaacgugggugucacggugaggagcucugccuguuuccucccgaggggaccuuuggcuggauuaagcugaggccacucccuccccugaaaauggcucauugacaguuccuacccccagugacucuggggaggaggagaggggaaagagcaggucaggugcccguguggccucucgguuauuagagugagaacaaucauucaccacuuuggugugacccugugccagggacgugcgucccagcgcgugaauucacacccacagggcacgaggcucuccuccaggcacccccucuguggagugcagggcgagcgcuggugcucacagacaguucugggauaauguacugcugugacuuccaaggacaggccggaggaggggucagggcacucugggaaccaggcggcauggggcuauagccucaagggacagaggaggcagucggugaggaggagccgcccguuugccuggagagcagcaaggacaaagcaaugggcuccggccgaaucucggcgacccgcugccaggaaaggggcacggaggaagccaggagcgucgggaggggccgggcuugcagaggggcuaccaggcagaggggcagggcagggggcacccggggaaagggggcagucaacucuggagaaaccucucucaccugccagcagugaggccaggaaggagggaagggaucagaaugaaagagcccacaccuggaacacaauccacaggaaacaaaagccugauggagggcuccccacggugcaccuggagacccugccccgggccccgcuccaccacagagagggcagaccaaggcacuggcaacgccggcagagcggacugcgggucaggagcuccggggccgccaggacuggagcaacucagaggcacaggucugcacuauggggaggcggccugaggcugcucaaccaggccuguaccacugcagggggccgcaggcugaucacuacgauucagcuucuggaagugggagaaguuucaaucucuaagugaaguuagcgggugaaaacccccaggaacuaggacacaaaggaacccuccaaauaagccugcagcaagaaagucagucaccaacauccgcuguccuccgaggugcccugaaguccagcccuugauucccauccuaaccugaugguuaaaauuaccgaggaaggccaugagcagcggcucacgccugucaucccagcgcuuugggaggccgaggugggcgaaucaccugaggccagaauucaagaccagccugaacaacauggugagugcucacacccugagggccuugggucagggguuuacucaagcugagcagcacggccuggccuguggcuucacagaccucgccgugcaaaugcuaacgucuuccaacaagaagugcaaaucugcuagucucguuagaaucaaguaacucucaaauacgcuucccuuguuacguggaaacugcuagcaaccacccaacaaacccaucuacccaucuggccacgccuuggccugugccacguggaggcggcaagcgcagaaggaucccgcacgcucggcgguaacugaagaccacggccagccccagacccugaccccuguaaccuaugagcgccaccuccgcaccgcuuuccgcaccugacccgcuccugacagcugcagaggugcaaacgggugacggaaagaguccgauccucccggcacgcgacacggcuccggccgggggugcuccgggggcgcagucucgcccgggaaguggcugccgacagcggcgaggagcggcaagggccagggcucccgcuuccccggcccgucccgcccgcccgcccgcgccgccccgccccgccgcacucacgcgagugcuccagcucgcgcgccgccuuggcggcgcgcuccaggccgguggggucgaaguugcuccauuuguccuugggcgccggccggucucccaacccgcgguccccgccgcccucggccccgggcugcgcgggcggcaaaggcggcggcggccccgcgccuucacccuuggggcccuuguuaaugccgaagagccacgacaugcucgcaccgccgccgccgcuaccgccgccgggacccccacccgagucugacucgcgcgcggcuggg

SEQ ID NO: 17761 - RNA, 34431 nt, Homo sapiens
uucgaacucaagucacuugggcaauuggcuuuacaaagcaaauuggcuccguuuaaggauucuugacuccugaaauccgcaaggaaguggguucuuuuagagccagcgccaagagcuucaaaaaauccuucuaaggugaaccccuccggacccggauagcgagauggggcucagccuugcgccucgggggucguaacagacggcaagguggagguggcuucccggccccgcagccggaccucggcaccccgagcccguucaccggggccggguccuggcgggccgcggagugaggccgggcggcgcagcgcaggcggugcccgggcgcagggccagucccgccgccgccgccgccgccgccgccgccgccgccgcgagcccggaccugcccgcccgaccuggcggcgcagucucgcgggaucgcucagcucucgcuccccgugcggcucucgaggcagcuccagucccggacgcaaccccggagccgucucaggucccuggggggaacgguggguuagacggggacgggaagggacagcggccuucgaccgccccccgaggugaggcuuccacggcugggacugggcaggggccgggcgggugccgggggaagcggggagggccucgaggggcgaggggccgcggcugggaugaggcgcgccgggagccgcaggugcuggggaggcaacggcgggacggcccgcaccugaguuuccucggaagcgggaaccggcucugaaaggcgaugccggggccccgcggcgccgcgcaggccaggaacgcugcugucuggcucuaggccuggggcagguucccggguguggggcgcuggcggaccgggcaucaguguguguuggggcgcggguaauucguaauccggggccuacagccuuccucccgcaaggggacugccuucgcccuucccccgggacagauuugcgcacuuuccuuucgacggcagcacuacacccuccuagccagugaaaacugcaauguugcuccuccacuggaggaauccuaaaagucucccucuaguuggccuuacgaaaaucgagaaaacuacauacccagaagacugccacaaaaacugacucuucagagucuuuuacaaguuuaagaacucuuugggucuuaaggaauuucccagggccuuaguuuucuuguacuuaauaagcuuuccaacaggggcccuuagauuguaugcuuauauuaauccuuuauaauuuacuccgaaucaccagcuuuccuuuuuuccuccaucuuacucuugccauucccucuuuuuaacccugucuuccauacagcaccaaccuccuagcaucgguuuccuagaggugcagcuuccuuagcaaaugauauauuccaugcuaaggcagguggaagaguaucucguuaggacagaauuuuccguuguuuuuccaguguuuguuaccuggggugaaaaucuuaacucugcacuuugacuccacauuugaguuuaugacaaauguugcugauacacccuccuuuuguuuuuacaguaauugacccaggacucauuuucaggaaagccugaaaaugaguaaaauagugaaaugaggaauuugaacauuuuaucuuuggauggggaucuucugaggaugcaaagagugauucauccaagccaugugguaaaaucaggaauuugaagaaaauggaaauguuuacauuuuuguugacguguauuuuucuaccccuccuaagagggcacagucucuucaccugugaaccaauuacuguucccagauguaugaaaauggccuacaacaugacguuuuucccuaaucugaugggucauuaugaccagaguauugccgcgguggaaauggaggugaguagugcuucauacguuuauugaauaguaguuuaugcucuguucuagaauaaacuaguaaaaauaagucuauuuuuaaacagagccgauuucuucaaguuguguacaaguuguguuuugaaaaguccuuuugaaaauuaaaucccucuacugacuuauguuuuguguaccuuugcggcccuguuuaguagauucguuugaauaggguucauuuuauauaaugaaguaugguuacacaugauuucuaaauaccuuguaccuagaaaauauuuugcuuuccugaaucaaguaugauaguucuucuagaaaugcgaauucugaauauuuuucuacuucacugaacauguaauauuuauugccuggacuaaaacugaagaaauuuacaaguuuuuauaaguaguuguaauauucacuugguacaguuuuucugaaauaaauaaauuaucagaauauuuuguugcuguagacuguauuuuaaggcuaucacaaagucacuaaaaagugacuuuguuuucuaagcauagcacuuauauguucuuuauaagauacuuguuaaaagaaaccacuugggaggaguacagugacacuaaagauugccuuaggugccuuaguuaccugucucugguuuagagauaugcaaauuacuagggagugugagaagaaagcuaccuguacagacaggaaccugccuucccauacagauuuguuagguuguuaagucuccugaaggaaacuagacacaugcauuguuuuuguaguuuuucuccagaaaaacagaauaguaaaggcuuuuuucccucagauuguugcuaagagaggaaaucccuacaaauuuaauauauauacuauuuuuaaaauugauuagauuugauuuugcagcuuugaaaguuuucuauuguuguucaguugaauaguugucugacugccucauuguggacucaugucuggaauaggaaagcuuauaaauacuaaguagauguuauuuaaaaggauaguacagauuauauuauuguuaucuuucagugguuuuuuucaaacugaugcuagauguccuuuugaacugaacaaaugaugcacugagacuuucaugaaucagaaccauuuugaugguucaaucugauucaauaugaaguauauagugagaacacugugaagcaauaauuacaucauucauucacuuuuuugcugaugauaauauguuuuguaguguucauguuuuaauaguguuccuaaauuuuuuaaaucuaauuuccuuuguaugugguaacuacauacauuuuaagguuuuuguuuuuucuuuuagagauggggucuuacuauguugcccaggcuggucucaaacuccuaggcucaagugauccguccugccucagcaucccaaagugcuaggauuacaggcgcgagcuacugcaccuggcugaccauuuuaaguuugaaugcuaacagugaccuuauaaauucauaucaccuagacucaagagagaugcaucccugcuauuaaaugccuguaauuauaagaugguagcaacuagcuuuguucugcacgucuuuuuaaaaccaaauuuuuuuuacuuucaaaaaaauuacuuuuuaauuuaccuagcuucuuucccaaguaguuuugugccuggauauuaucaagaaggcuuuuuguucuuaccucuuuuauaugauugcuaauacuaccaaucucuucauuauauaauuuuccacuuauaacuaaccuuucucauagccuuuacuaaugaaguuuuuuuuuuugcuauaaaucauacuucaguaaauuuaaggauacaaaagaagagagccaucaagcagucacaauaccagcauuaaccuaagucuauagaagaaaggaaagagaaaugaaaaggcaaaaauaaugucacccuggcucagacuuuuaaucccuauauguaauuucucaguguauacuauuguguuuuuccuacugccccuuuccuauuuauccauauacaguaguauucucuuuuaguuccuguauuugaauguccaaaauccuauaaguugagaguuguaagugacccuaaagaucauauagagcuucuuaaccuuuuuuaugacauuaaccccuucucaagauaagagaaguuuuaauauuuaaauaaauaaaauguguaggauuacaaagaaaacaaauuauauugaaauauagcucagguaaagaacccccgaacccuucauuauacagaugaagaaacugaaacccagaaaagcugcgauuugucccuuugagcacucuaaucugauagucuucucugucuacauggaccauaaugucaucuuuaacugguuuuuuuuuaggcccuuguccugauuggauaaacaagauaauauuucuuaugauuuagaaugcaauguguaaauuucagacuuugcuacuuauuugcaaacuucauuuagauaaaaauuaaacugggugauuguuuuaccucuguuuagcucugucucucuuuuuccuucuuacaagugccuugaauacaaagucuuguuagaccaaaaauaaaaucucuguggcgcacaccuguagucccaucuacucuggaggcugaggugggaggaucacuuaagcccaagaguuggaggcugcagugagcuaugaucguuccacugcacuccagucugggcaacagagugagacuucaacucaacaaaacaaaaugaaaacaacaaaaacaaagcaaaaguuaacucccuaaucuucagucucucuaguggugccacaaugauuuuauuauaauucaaauuugugcaguccacuuuaggguuaaaauccuucaucauuuucccuaaagcuggggaaaaaaagaccugguucuagagcacuccaggcccuucaugugggacccuggcugcuuguccagucucucaucuuguaccuucccacauugcacacucugcuucagccaacugaccuauuuggagaauucaaauccauauuacuguccaucaccucuguaucuuuacacacacucuauccucuggugagccgucugucuaccuaccuuucuucaccugcucaauuccuucaguucucaguuaaagcaauaacuguuuuuagcgaacccuucuuucaccuuucuccugagcaaauuuaaucaccccacucuacacccuuacaguacuuauaauguacaguuguucuuaugcuauuuuacagugaaucuacaugucucuagauugagaguuuguugaagguagggaugguguuuuuuuuucaucuguaucccuaauacuaaguacaaugccucugagcaugguagaggcuacauaaaagcuaaauaaagaaaaagguaggauuuuaugucccaauaagguagcaaagggaauuuucccuccaaaucuuuacauuccacuucuaucaucuacaguguccaagucaaagacauacuaauauuuuuaggugguuuacauaucauucuuuuucauucugucugagccuagcuguaaugaaauauaucaguugacauccucuauuuuguuucccacauuagcucuacacauauucauuagaauuugcuuaaagaauuugauuuuuaaccauuucuaguuauuuauaugaaguaaaggaauucaacuuuugaucggaccguuggauuauaagcuauaugagucaguuuuuuuuuuuucaaacauuguacuuuaguccuuaaguguauauuccaguugaguacuaaauuauagcugcuuguaacuuggcuuuuacuaaaaauguguuuuauagcuucucuaaagaucagauuggguuuuacaccuccaacccgauuaccuuuaguuucugcugguuccuauugaauuuccaggauucacugugaauuaguguuaggaugaggggcugaaaaauugccugauggcuauggcaaugaauuguacucucuuagucacugagaauuccguauaagucaaaagaucuaucucacuccuuuuuuguuccuaguuuucauuuuguaacagcuagccuguuuuauagaauuuaagcauuuauggucauuuuuaaucugugauuauaugagaugguuuagagcagugguucuuaaacuuuaguucauagaccagcagcuugugagcuuguuggaaaugcaagcucacagacuccuaucccaacuuacugaaucaugaucucugaagauggagcgcagcugugguuucacaagcugcccagguguuucuuuugaguguuaaaguucaagacccacugguuuagaaguuuggauugcaaauuuuuacuguaaaagaccaaauuauuuugacuuuccagaccauacagucuccgucacagcuauucaacuuugaaauuguagcacagaagcagucagacaauaugccaacaaaugaguguggcugugucucaauaaaacuuuauuuacaaaaacaggcagugggcuauauuuggcccaggggcuacaguuugcugaaccuugguuuaaaguacuugaaaauguuuuaaggauaguauagaaugaaauaaguggacauuauugugcauucuuauguuaauacauuaacugaguuauuuguuacuuacuuuccacauaaauuuuuuaaaguaaaauuuaucacaaaccaaaaggaucugacugggacaucuugguucuuuaguuuuguuucagagauugcuuaaaaugagggacuucaguuuuuuccuaauuuuauuaugugaaccugaaaucauuuguauuacaaagaguuaauuuacaauucugcauaguaacggggcuuuguaaugaaaaggauguacagucuaacucucccaaguggaaaaacaaauggcuacugguuuuccauuguguuccuuuuguuucauaucuagagcauugugagauugaggucccuugagagacugauuucauccagaaagagcugagacugaucuagggaaaauggaaacaggaauguuguauuuuucuuuuucaauugccuucauugaggucuaggcaaaagccaggucacguauuguguuuggagcagcaaguggucauucccuuuuuaaacagucuaaagggaagugggccaaaagaaaaaaaacaacuuuccuuuccaccuguuaauaugugcuguuagaaugucucuauucaguuaaaaauaaauggagaaaaacuggauaaacagacuuuuaaggaaaauaucuauuucuguuguauaguggcuuuuaagcauuuuuauuuuccugcuuuuagaagaguccagucccuuccugcuuucaccuuucuuccauauucucuacccuuguauguccauacacaaauaaagaaaauguuuagugagauuaaccuguuuguuuuucaggaaagacuaucugaaaauaacuguagcuauucugaaaguaagacauuaaucauauaaaaugaaauaaauagugagaaguguuccaagccaguugcguguauaaugacuacuguuguguuuuaaagguagaaaccuuccuucgugauguugcauugcaguagcagggaaagucccuugacuccuucuuuugaaacugcagaauaagggcaggccuguaugugaagagaaaggauauuucuccugggaggcucugcugauaagcacaagguuccuaguccauuccuuaguauuccaugggaagacuguugugauuauuuccuuuccccaagaauguggcauguaaauaaugaagcuuuauuacucuagguuauauauuugucauguguucauucauauuuauugaauauguaccugaauauguagcucucccagaauuacaguuuuucaaguucuaagguuuacauuaaaaaaguaauuuauucuagacacauuccuuuguaguaucaaucaguuaauauguacauuugucuaauuuccaaagguacucucuucuggagaaaugauuuaaauuuucuaauggucccucacaagaaauaguuuaaaaauaacaaguuuuccauuauggaaauaauguaaauuccugcuuuuuguucucuuguauuccaggcuccacuuuacauuuuuuaaagaagcugacuugccugagauugaucacauucgugaaaauagguagcaaaauuugcaccacuuuccuauacaguaguccauugacauucucaaagaauuuacucaagacuuuuguaaccacuuaaacaguauuugcccagugaagucuaacugaaaacauuuaagggccccuuuagacuuuagugagccuguuguuuugcuaagguucaucacuuuuuuuuuuuuuuuuuuuuuuuuuuugagacagagucucguucugucacccaggcuggagugcaguggcgccaucucgcucacugcaagcucccucuccuggguucacgccauucuccugccucagccucccgaguagcugggacuacaggcgcccgucaccaagcccggcuaauuuuuuuguauuuuuuuaguagagacgggguuuaaccauguuagccaggauggucucaaucuccugaccucaagauccacccaccucggccucccaaagugcugggauuacaggcgugagccaccgcgccuggccccagguucaucacuuuuuuuaaugacauuuuaaauuuccuucacucaguuuuaaucaccaucacuguaaaucgacuuuguuuuuggugccaauuuagagcaagaaauauagcuuuucucacugcaugggaguuacuguguaugucaccaugaguagaaagcacaaauccugagcuuaggaucagaggcuuuggagucacuuggucuuguucacuggugauguggcuugcuuccauguaccagugggauucugauucaugcuucagaaaagugacaaacguuuauguaucccauauuuucaguacucagggaagcaaggcacugccaagauacugccacaggaccacucugcuuagguuaugcuuuauauauuuuuaagaaaccaaauaguuccuucuuuugaccccucucaauuaaaauucuagcccagacuuucccuucaggaucuuacagugccaccaaccccaggcccauauuaugguuccuuucauuaucauauuauuauagcaucaggagcuagcugguccuuucccuguauauuucacugagacuagcugguguuuauucauucaacaaauauuugaaugccuaaauaaauaaauauuugaagcacuguucagauacuugacauacaguaaugcacaaacagaccuauaugcccucacagaauuuauauucuaguggagggaauguaaaacaaccuaucuguuuuugucauuguacuuucaguucuacuuuuugacaaaggcuuauuuucuuagauuacuuuuuugcccuuguuuacucauuuccaaaaaauacuuuuagacuuauuuuaauauuauuuugcccuggucauucuuucauugauuuuauauagcucuuaauucuuuuaacucugaagaaggagccuccuuuccuuguguucuaagguguguuuuuuuuuuuucauguccuuuccaucuuaggguacccagacugguuaagcagaaaaggaauugauuauaagaguagcagguagcucauagaaucgccaggugggcuagaauucaagcucaggcuguaaggaaacaugcuacagcuaagaugcuggcacagguauggucuacuugggaacuuauaagcaagggauuucagugaggacaacucuuggauggaaauuauccaggauacuucuuaaccugacacuagauaguugguugauccugcuggaacaugauaccauauugagggcuuaagguugguuacugcucugcuucuggcaaaugaacuacucagcaguagccagaucaccccaagaaggaaaagucuaugcuauuggaucugggcacucuucugccaccauggccguuuuguuccugagccuguuaagccuauacuggugcaacuagagaaaaggcugauugacauccacagaguagauuauuuagucuacacauuuaagagccuccucugucuuggggccuuuggguuugcauucacaugcaaaaaaaauuuuuuuugagauuauaggcccauuuuggagaaguccagucacacacugcuuuuccggacuccuaauaccaguucuguagaacucuuccaagcucuuguugcuugcaagucccuaucuuguuguaccauuagcuauagcccaugaaucaauauaacuucuuaccugagaccaucuuucuacugauaacauagacagugauugaaguucugccugcuagggccaccucugaauggaguuauaauccuauaguagcucacuuacaauagcuggggccagcuauuguaagccaggcuguaauuguuucuucaugagucauuuggugagagggaacucugcuugaagacguagguguguuuuaaggaaagaauuauaauauggcagaagcaggcauucugagaaugcaagcaauaugcuacuuucccguaucuuugagaucuauccagccacuugaagauggaaugcaguuggucccugacaucaugaguaggugaguucaguaacacucaauucaugagagguaacuugaccugaugaucucuagauguucucuccuguuuaguuucuaugaggaacuaguagcaaaagccaaggucccuuuuaauuauguaggguuaaucuccucaucugcacuuguaucuuacuauggcaucuaggguacaugucuauggccucaucagcuuuaugucuuugauaaguuagauuagugugauguccugugaagucggugauauguuucacugacugaaauugaggcacagagcugaagagcugaugauguuccccuaaagcugaagcucuuaagcuuugaugugcaucagaaucaucugaaggacuuguuaaaacacagaucacuggcuccaucccugaguuccugaaucaauaggucugggaugggauggaaaaauuccacaucuaacaaguuccuaggggaugcugaugcugcucacucaggggccacuuguugggaaccacugcucuaaggcaaguuggcaaagauaugcugcugucccuacugggugagaacaaauugcuuuuguagaagaaagaacuggcuagcuuagagaggcauacaaagugccugagcuuuacuauuugcuacaggaaagagaccacaucuggagaaucaccuuagccaauugaguugagguugcuuaagacaauccacuggaaaguugaaaugagcaggugguaggaacuguuaccccugaauauguuucuagugguguugccaaucucugaaaauccccuugaucugcaguauuguuuuugauuuucuuucaugguagggagggagaccucuaaugguuuuuguuuggccccuaccauaauaacauuuauccaggaaacaaauaugccuauuguguuuuugcuaaauacagcuauuuuagguguacauacauggacuuggaaaauugcaguggguuggauuuaggucucacugaaccccugucagaagcccauuuaucaucuuaccuccaaaagcccagucucucugaagcuagcacacugaaucuagaaucucugagaaauaaccccaugucaguaugucuuagccccaucuaaaauuguauucuuuccucuucaauucguaacccucagaaaccaauauaaauuaacagucuuacaacuaguuuguaggucuuuuuuucagauuugauuuugacuugaugcucccaaggcgugcuggggugaaacucuaguuacagguugagacauugaagacuggugggauggggcagggggcuauuuauuuucuucuuacagaaagggucuaccuugagagcugcagguucagagcacucugcgauauccugagccuugucauguguccccacuacagaacucugggucucaguuuccuaguuacaauaucaccaggucucuuaugugaaugggaagcacauuaaacugauauaauuuagccaccugcagaucaaacugugcuugguuuucaacuccuugagccuuaaguccuuuuuguccuuuuguguguguguuucauuuuuuuuaaagacagggucucacucuguugccugggcuggagugcaguggcacaaucauagcucacugcaaccuggaacuccugggcucaagugaaccucaggccucagccccggaagcagcugggacuguagggcugugugcauugacaaccugcuauuuuuuuuuaagagacagggucuugcuauguugccccggcuggucucgaccuccuggcauaaaccaguccuuccaccuuggccucccaaagugcugagauuacaggugugagccaccaugcccagccuaguguuuuacuucccaccuugagucaaaaauucagagaugccaguuuguuauucucuuccuaaaccaagcaguaccauuagaaguccucacccuacccuacaaucugauaacucaugcucguuauauuauuuucugguucucuggcagcaggcacucauuugaucucccacagccucguguucauggggcauaucauucuauuauguacagagaagcuaagcuaaaaccaagcuaagugguuacaaggauaauuuaauucacuuugccauggguugccagauuuccaucuuuaaauacuaacaggaugcucacugccuuuggccuuagaccagaaacccaguucuagaguuccuccuguuuugcugagaucacuugcaaaccauucuuuauguuuuuuuucuguacuaguuggucuucuugauuacaaacaacagaaaccaauucugacuaagcagaaaauugauggauuuuggacagcuuguaagaucaaugggaaggcaggagaaccggguucaaaauguaaggaggagcaaagggaacuggggcauagcuaaggucauaccauaggauuaguuugucaccagugccaauaccauuggauacuuccugagccauugucacuggaugcuuauuuggccacugcaaggauuacugaucgcauugcagcuuccucaaauaaucugacuauaucuguucuuuugcauaacccucuccccaggaaucacaauacccagaguauacagauggccaagcuuagauuaggugccuauguuuucauugccaggcuguaucccugcaucccucuuagcuuccauagugucuuaccuacuuuuggauucccccaaauaguaaauauucacucuagagcacaguguaaaacaguguuacucucugggaacagugguucauaccuguaaucccagcauuuugggaggcugaggcaggagaaucacuugagcucaggaguucaagauccgucugggcaacacagacucuaucucuacuugggaggcugaggccugaggcucacuugagcccaggaauuggaggcugcagugaacuaugauugugccacugcacuccagccugggccacagagugagaaccugucucuuaaaaaaaaaaaaaaaaaaaaaguguuaacuuaccaaggagaaaauuucaccauagcaccuacaguuguuuugaaauugaucuccaguucuucuacucaauucuuuguuacccucuucauaaacuuuugagccauagaaguuagguaucauaaaucuccuuagugaucaucgaguucaucacugucacuuuacugauggauacucugagacucagaaacagaaaacuaccugccaaagguagcacagguaguuaaacuaaauaguuagaauuaaaguauuagaauuaaauaagaauuagaacuuaguuagaaauaaaaugcuagcauuauuuccagugaaggauuauagaaaauacucuauguauuuugauucucauuuuucauuuaucuuacuguuggcucaggcuguuuuucacgauagagaugugaauugccuucucacuugcccucuucuuucucaucucugccaguacuaauaguaacugcuauuuccagggauuucugccagggacugaccauuuccuuaaaggagccuaccuuuuauuucuugauuuuugaaacuguaauuaauaacgcuguuuuaguuauugaaugguagaaucucagaaccaauauuaauaguuauuagaugaguuuuuugagaaugaaauuugaaaggaggaguuuauaagugagaucaugaaagcacuggguuacuaagagaguugaagaagguggugucacuaaaggugaguaaaaggaacagacugaugcgaccagguuugauauuugcucaauucauagauuugcacuuuaauucaugaguuuaauucacagguuuggcacuuaacgugcuaaauccuaguuuaaugaugugaugaaauucauagcauaaaauuaaggacauaagaaauaucucaaugagucauguuagauuugguuucugagaaugguacccaggacauuuugaggaagaacauaaaacauuucaaucacaauuuuuacuucaaaagacugugaaaauauguucaucccaguuauguuucaacugauugguauaaugaguucaauacuaggcugacuacccauuauuuaaagugcugugauuuguucugaaaguacuccauaugauggaauacuugcucuugcuucaggagauaacgcaucaucuggaaugugaucaacauagcuugagguuuuauagucuuugauauguauccugugaacauuuauuuuuuuuaacugaagaguuucuuucauguggaagagucccaauccucuugauauauuuucuucccuucauccucauuggcauuuuugccugucgcugugcuuugggaaaggguaauuuucagggagaaauggguagcagcacagagugaagguuaaagaggacauacucuggaguccuaggaacauagguucauauccuaguucugcuucuuacuacuauugugacuauacaaguuacuuaaccucucagagccucaguugccucagcugcaagguggagagaagaacagguugugauaaaggaaaaugguauaugaaaaagcacagugccugguuuaugguaaguaccaaauaagccaaagcucugauuuauuaucaguagccauagaauugguaaaaguagcauucgaucaggaauaaagauaccuaacuucuaauucagaguacauuuuggaaugugaguaacaauuuuaauaagaaauuggcuucaguuuucucacuugauccaagggcuuagauuaggucagugguuuuccaauugugaucucuggaggugcucugaggucacugguagcaaaggggaauggugagaaguaucucagcagggagagcuuccuuuucagcccaagaaacuaugccuuuauuuauuuaguauaucggccuccuuuuaacuucuuauuuaaagaaaauguuucuuggcaaagugugcaugugugcacacacagacacacauacacuucgaaaauaauuaacuuaaagguuuucucucaagucccuuccaagucuaaaauucuuuaagucuauucaucugcaacugaacuuggaaguugguagcccacacuggaucugaccugagacuugauuuuucugugugugugugugugugugugugugugugugugugugugugucagggaaggggggggcccuguuucaaauguauagauuaaagugccaaaaucuaaaauuugggaaauuacacauaacaaucuagguucuguuuucuuaggaaaaauggauauaccugacaauucuaugcccccauuuccaaauaauagucugcuggaguugaguagcagcagcuucccaaauacucccuaucaucuuacaggcauuuucauuuaccugccuggccucugaagguaucugaguuuucagcauucaguuuauccucuacacagugcaggaacaucaacauuauuggauuagccaacuuuggcacuguaaaagaauuaaauuagggaagugacuuguguuuuccauguaagaaaauuguuuuuguauagcaaaaguacauguauugcauucauuuugccugcccuugaacuauauaauuacuucuuaagugcugaccaccaguuaaucauggcuucugaguuagaagaauuaaauaaacauaguguguuuuaauucuuuccaccaaaggaucugauuaccacauagucaaaaaauuuaggaacuaggcuuuuuugggacaguaaacaaagaguuuaccacaguuuacuaguugcccgcagcuccccuucuccuaccucaggcucagaggaggauuugcacacugucugggcacucucuccccuucacgauggaggaaacugagaaaaguacugugcuguuugcacuccaaguuccugugaggugacaaaggauccaaucucagagcaucauucaaauaaaagcaauaauauaugucaaccauggcaacccugucucugcucagucacuugccccaucaggacaggggaacuucccacugguccaacauccuucauagcuauuguccucuaauuguuggguguggguucuguauaugcccuuuaagucagacuuguuaauuguagucuguaaucaaggcuuauauuuaccuauuaauuuuugucugcuugaccguucauuuacuaaagcagauauauugaaauuucucaugaccauggaaguguccauuucuccuuauaguuuuauugcuuuuuguuuauauguuuuaaggcuauuuuuaagguguauacagugcucagcaaugcauuucaaaguauauguguugcacuuuauccagaaccugaauguuuuguggcaggagauauuuaguuggccauacugaugaaagaaguugucauuccuucuuuuuaucuuucaaaaauuucccaaagcuuauagggagcccuuucuuuauuuuuuuaaugcaguuauggauuuguuuuuuaccuuuaaaccuuuucuuucauuucaauggcauuucgaguggaaggagaugcuaauauauagagucaguguauuucccuugaaucagaauuuucaucuucucucacucuacuuauucuccuuagguaauuucagccaguuauuucaauuaccacuuuuauacugaugacuuguaaauccauauccuuaauuuaaagucucacuucuacguagcuuuauuuaacugccugcuaguagauauuucacacucaaaugugcacuucagacuguccaucaacugguaaaugguuaagaaaauuaugguacagccauacaguggaauauuacucagcaauuaaaaggaaugaacuacugaugcaucagacaacaugacugaaucacaaaacaaugaugcuaagugaaagaagccagacaaaaaagaaaacacacuauaugauuccacuuacguaaaauuauagaaaauaccacuccgcagugacagaaggcagaucaguuguugucaggcgugagaguuacugagggggugaggaggauggaagagcaggagggaugacaagggagccagaggaaacuucugguggugagggauacauuuauuaccuugauugugauaaucauuucaaaacuuaucaaauuguacacuuuauacauguucaguuuaucauacaucagcuauaccugaauaaagcuggaaaagaaaacccucaauacuaaaaggcuuugaacagaaaaauaacaguccuugcccacccuuuuccacccauaucccaguccugcccuugagaggcagccucuuugaacuguuuuagguguuccucugguaugcaggccacauucuaacuaacagguuuacucuguugguuauagauuaaucaguuuagcacuuuaggccguuucuguuuauucuuuccuauuaggguaauugauaauucauuucucuuacccugccacuuuuacuucuccuccugauacaguuuuugauuaaaugaauagucagugauaauauuacuagaaauauuaaauauuguacacugcugagucagguaguauacuuugauuacauuuauuuuuuuaauacccucccaacaauuaacacaguaguuguauuuucauuuguuuuuuauguaacaaugucugacuauuuuuagauauccuaacagacuugucauacaccuagcagcaauuuuccuagugcucaaaauaacauauacucugucaaucucaauccccgcuccuuucccuuggagaccuuucuucuucagccaucugcccuucugucaaauguguucugauuacuucuggacuagauuuguaguugucacauggagaauuucucuugucauucuucaguguugaaucagcuaauuccugggucccauauuauuuuccuuccuuguuuauucauauauuccuucaauuuguuucaggaauauuacaucuucuaguugcuuccuaaacagggauacuugaaaguuuaaauuuuguauuccuuacagugccaaaaaugucaguagucuacucucuaaauguuuggguggaucuagaauucuagguugaaaugcauuuuucuuuagaauuuuauagucauuuuuucauuuucuucuagcuucugauauugucaaauauucacaguuuaauuuaguuacauguauucuguuuuuuuccccccucuggaaacauuuaugaccuucucuuugucuugaugcucugaaauguuuuauugauaugcuuugucaguguucauuuauuguuuuggagaaucaugcauuuauucuguaaauauagagaaauggccauguagcagacacugcuuuaggcacuggagauagagcagugaacagaauagacaaaauccuuucccucuuugaauuuacacucuagugguaaaggcaaaaauuaaauaaacuaguacauaaugaaaugccagauaguaauaaggauuuaagagaaaugcaaaccaugguaaugggaaagauaagagcaggauaauuuuagauaggaugggcaggaaugccucuuugaggugaauugaguggagacucaaaugagggcacaagacucacuaucugggugaagaggugaggggaacagcaagugcaaagacucugagacagaaauacacauggaacuauaagaaguagaaguccaguuuaguggcaauggaguaaauaagagacaaaguggucagaaaugaaacuggagacauagcggggaacacggaaauuuaaaggcucaugggaauuggaaaagacuuuggaauuuauuuuacuggagucuuugaacaaggauaaacuuacguuuuaaagaaucgcauugguuggaaaauugacuguaagauuagcaagugugggaaguagugagaccuguuaggaggccauuuuaguaguugaggugaaagauaauaguggcuuagacugggugguaauagugagaaauggucagauuuggaauauacuuuaaagggagagccaacaggauuugcugauggguuggagauggagugaaagaagagaggaguaaagaauaaguuguaagaccagccuggccaacauggugaaacuucgucucuacuaaaaauacaaaaauuagccgggcguaguggcaugcgccuauaguccuagcugcuugggaggcugaggcaggagaauugcuugaaccugggaggcagagguuguggugagcugagauuaugccacugcacuccagccugggcaacagagcaagacucugucucaaaaaaaaaaaaaaaagaaagaaagaaagaaagaaaaaagaaugaguuguaagauucuuggccugagcaacuugguaaaugguggcauuauuuacugagauggagaguacuaagggaguguuugggaggcagagauacggugggauugaguuguauuuugcauacuuuggguucaagaugcccauuaacagccaaauggaguugucccggagcagaugcucauucaagucugugguucacaguagacauggggacuggaugaguuucccuugagagucaguagagauagagaagaggucuuggggacugagcucuggagcauuucaaugaucauaauugggaaauggaagaggacuagaaaaggaacagccagugagacagccagaaauccaagagaauucguguccuagaagacaagugcaaaaggggccucaagaggaagcuaggagucacugugucgauugcuguuaagagcugaguagaagggauguucagaauuuaccaucagauuugacaauguggaguuuguuggugacucuggcaagugauuucacuggaauaauccaugucuucuugaaaaauauaugauugaauaaaauaguaguaucccauuguguaugaagaguucauaagucugauagagggagauuuaaagauucuuuugcaguauaagugaaaaagcauauacuuuaaacaguaaauauauuaauuuuauucauuuguuauuaaaauguuuucuaacuguaucuugaugucuuuaauagcauuuucuuccucucgcaaaucuggaauguucaccaaacauugaaacuuuccucugcaaagcauuuguaccaaccugcauagaacaaauucaugugguuccaccuugucguaaacuuugugagaaaguauauucugauugcaaaaaauuaauugacacuuuugggauccgauggccugaggagcuugaaugugacagguaaacaauguuuuucauggaaagcuacuaaugguauuuuacuacugguacuagcucucugggauguuagugagaagcuuucauuauuuaauuccauaaauguuuauuacacacuuaauauaugucaggcacuauggugcuaagugcuguggacacaaaggugggcaaaaaacagacuugguucuugcucucagggaacuuacagugaggugagagggacagacaguaaucaaauaauuaugcaaauaagugcaaaauuaugacugugauagauacaacaaaggaaagguagauaauucuaugagaauauauaaugauaccuuugaccuaaacuggggaaaggggaaggaaaugacuguugagcuaaaguacgaaggguaaggguaagacagagguaacuaggcaaugagaggagggaagagcauuucgggcagugggaauagcuuauuuagagacccugcagggccccugaacagggagugagggagcauggcauauacagggaauucaaaagcuaguauagcuggagugaugagagugagaaagaauauggugcaagauaaggaaagagagagaagcagcagucagaccacccagggcccaucuuucauauuuuuaugcugaaagcagugaggucuuuaauauuuuaagacaggaauggguagcacaauccugugagcuucuguguagagcauggcaccugugucagucuccugaggguugggcagcacucuggcaguuucuguuaggaauccaggacacuuccauccuccaacucugucagccagguggaugggagagagaagguagagaacucacgccuuuucuugagugccucagaugggaaguguuauaccuuuuccacaugcauuccuguuggcaagaugucagucaugugguuauaacugaaacaaauagggaaaauaguaaauguguguccugaaggaaaaaagcauucaaggcagaggacaugucaggugcugccagucaaaaagaacauuaccuuaugcuauuucacuagagugacuggggcaaaggacagaucacaguaggugaaggagugaagaggaaguaaagccagaaacagaguucuuagggaagcuggcuauaaaagaggaaaguuuaugaguuuaaugggaaagaacuauuuuaagaacuacuaggaaaaaggaagaggcaagcauauaugggguagaagaggucaucaauaguaguuuucuaagaaggagauaggaucccaagcauagaugacauuuuggccauggaugggaggaacaucuguuguaacaguaggaaaggauaggauggcuguggauauaguagguuuguguguuugguaagaguuguugcaauaauuucuuucugaugguuucuauuuccauugugacauaguaagagucaaggagguccucuguugugagucugggaaagaaggauauguguucgagagaaguggucaucauggagcaugggagaaugagucaauuagagaggcuucguaacauuuuagguaaaucaggcgauccugaauguguggaucucaucuggccuguugagaacuucuccagcuguggugggaugcuuggggcuaagcacagagaaggcagauaguugugcucaucugugguugggguuuugucagauggauucagugcaaagauaaaggugcacuaaaaaaugaaggauaaugagaaggguguuacugaaacaauagccuaugaaagucuaaauagauggggagcgaaaugaagagagaaaugaacuaauguauggagacaagcuggaggagaucuaucccaaugagguuuuuuuuuuaaaggcauaaugaggauuuuuuaaaaaaugaauugcaaggauaggagcuugcagacgaagggcaggaugcuugaguugauuuuuggagauaguguguacuugcagguuguggcaggguuccuugugugacuuugauuacagguggccacugcggguuagggauagucauuggagaugaggaggcuaaagagccgagaagccagaguguggauagcuuauucuuggucaagucaccaaggaugaugacagcaaaaggaaaggagacaaaacugaugauucauucaacucauauuucuuguacucuuacugugugccaggacuguucuaggcacuagaguuacaacaggcaaaaauuccugccaucauggaccuuacauuuuaguggagggaaggagaagauucaguaaauaaguuauauuuauaugagaagacggugaggccuguggagaaaauacuugcucuuucauuaugagauugccuacucaguuucaaagcaggggagguuauaacuuaaaaaaauuuacacuggcaccuaugcuuaauuucuaacucuguuggaguuuuggucuucguaacuugauuuuuggagaaacggaauuaaucuaaaucaaauuuauucguguuugagaaugcuugauacauugaauugggaaguagaauucauuuuuuaaaauuauuuaagcccuauauuaaaccaugucccauuaauauaaagcaaacccauuaacauccuuuuauacaauguuaguugggucagcugcacauaaaaauaauucuaguauggccuauacuggagaauauuuuuucauuucuauaaauaagaccuucaggcuuuuguggcaucuuauuuacuuugaaaacacacacaaagaaagaggggaaccucugauuaaaacacaaaaucuagcucauugaaagauuucuagcauaaugaaagauuuaacauaacugugguaaaaacaugaaggcugcaucuauuauuugagaaacggcagaacugugugguuauggcaugcauuaggcucuugguuccccaggagaaugccuuugccuuggaagaaaaaggugcauucauucuuugaggucuguaguuuccucagcucaucagagcacaggcacauucuuuucuacgugaagaguuuuguaaacugaacuuuguuuucaguuccggcuccagccauccucggguagcuugccaauagaugaaucccacucguuugacccaugacgcuccuucuuuucauuucucccucuuuccccacagcagugcauguccaccauaccaccugagagucuguggaaucuaauuuucuguuauacuucuuuccuuacacucauuuuccugucuuuauuaugauagucuaacuuuuucuccucaaagguauagcugccuugcuuucaugaaaacacacuuuccuauugugauuuaucagaggccuuuccauaucucagccacuaugcuaugacagauuuuauaauuaauaagugcauuucaaagugaaaacguuacaaacaugcuuaacagauguuuuuauaacaugaaauauucuacugcguuaagaucaaaaugcugacuauacuuguuccguauaccuucagaccacuguuaauguaauauuuuggcaaggugaauggucuuuuuuggauauaaaaaucucagcauaagccaggcauggugguacacagcuguauucucagcuauuuaagaggauugcuugaguccaggaaaucaagaccagccuggguaacauagugacacccagucuccauuaaaaaaaaaaaaaaaaaagaaucucaggcauauacaggcauauauuuaaaagaaauauucuaucuggaccuuuccgugauagugaauaaacuugaugaauacugacugacuugaucauuugcaauuagaguucauguggagaaaguaagauuuuaagcacaauuaacuuaugaaugaauguauccauucacugaccuuuuccacauuagucuugauuaauuuuuuuuuccuauucucuagacaguggaggcugcuaauuuauucuacugauacagugagaccucauauaauaaauuggggaaagaaacugguuagcuuuuuguuuuauuuuuaggcugaagaaacuauagaaccuauguggaacuuacacacuucugguagauacauaaucauuuucaagaacaauugaguaacauauaguaaaauggcagaugcuuaacccugcauccuaggaaauccccucccauagaaacucuuacacagagagucgugcacaagaauauugauuguagauuauuccuaauucuuuuaaugggaaaaaaucuaaaaguccaucauagaagaaugauuaguaaauugugauguacuuacacacuggaauacuaccauacaguugauaaaaugaauguaguugacccacaucugucgacauggauaaaucuagaaaauauaguguuaaauuuuaaaauguaaguuauagcaugcuauauacagcauggugucauuuauauaaaguucaaaaccugaaaaacaauacuuuauaagguuauaguuaguaaauaauguaauaaaaauauuuuaaaaugcuugagaguaaacaccgaauuugugguaaugaauacuucugaggagagagagaaggaacuaagaccagaaaggguccccacuguaucuauaauguuauauugcuuuauuuuaaaagauauaaagcaaaauugacauaauauuauguuuuaauaaagcugguaguuuuuuuuguauuucauuuuaugggcauauguuuuagucuguucuuaucuaagguauauuuaaaaugcuuucucauuuaaaaccuccaguacuuuuuuuuuuuuuccuugagacagagucucucugucucccaggcuggagugcaguggcucggucuugucucacugcaaccuccgccucccagguucaagugauucuccugccucagcuucccaaguagcugggauuacaggcaccugucaccacgcccagcuaauuuuuguauuuuuaguagagaugggguuucgccauguuggccagucuggucuugaacaccugaccucaaguuauccaccugccucagccucccaaagugcuggaauuauaggcaugagccaccguaccuggccaaaaccuccaauacuuuuuaaaccauuauagaucccccaaaauaauacugguauguacaaacucaacuuagugauaaagagauggaaauaucuccaucuaucacucaggacuguccauaaacaagggaggcaaagagcccaaccugaacaaaauggugauguucauuaagcugguccucagccugccucuugcugguauacuugccugucuuuaaaaacuugaacucuauccugucaauccagggaaggaucucauuucauucauuuuaauuaucaucacuuuaguuauaugguugcuuuacuuuucuuauggacauuagaaaauaaaagugaauagacaagauauauuucauaugauauaaagacauauuucauaugcuauaaagagacaagccaguacuuaucuggagccuaccaauuaagauaaauucuuuuaaauauuuagucuuaaaaacagaaauuauuuuaaaauuaugaauuggcuaauuuuuuccaaguaagugcauuuucauguucaccugcuuuguauuuaauauaaauuauuguguugaggccccauuaacagccacaaguuuuuagucaacuucaaaaauuucuacucaacucuuaucuguaauccauuuagauuuguaucucuucccaucaaucaugaauacauaagguaauauuuuauaguuggaaagcauugcuuaauauauugaaucaauaaaaauguugauuucauauauuuaauuuuuauaaucuuuacagauuacaauacugugaugagacuguuccuguaacuuuugauccacacacagaauuucuugguccucagaagaaaacagaacaaguccaaagagacauuggauuuugguguccaaggcaucuuaagacuucugggggacaaggauauaaguuucugggaauugaccagugugcgccuccaugccccaacauguauuuuaaaagugaugagcuagaguuugcaaaaaguuuuauuggaacaguuucaauauuuugucuuugugcaacucuguucacauuccuuacuuuuuuaauugauguuagaagauucagauacccagagagaccaauuauauauuacucugucuguuacagcauuguaucucuuauguacuucauuggauuuuugcuaggcgauagcacagccugcaauaaggcagaugagaagcuagaacuuggugacacuguuguccuaggcucucaaaauaaggcuugcaccguuuuguucaugcuuuuguauuuuuucacaauggcuggcacuguguggugggugauucuuaccauuacuugguucuuagcugcaggaagaaaauggaguugugaagccaucgagcaaaaagcagugugguuucaugcuguugcauggggaacaccagguuuccugacuguuaugcuucuugcuaugaacaaaguugaaggagacaacauuaguggaguuugcuuuguuggccuuuaugaccuggaugcuucucgcuacuuuguacucuugccacugugccuuuguguguuuguugggcucucucuucuuuuagcuggcauuauuuccuuaaaucauguucgacaagucauacaacaugauggccggaaccaagaaaaacuaaagaaauuuaugauucgaauuggagucuucagcggcuuguaucuugugccauuagugacacuucucggauguuacgucuaugagcaagugaacaggauuaccugggagauaacuugggucucugaucauugucgucaguaccauaucccauguccuuaucagguaaaagcuaucacuuggauuaugucucuauuuacauuuaauguagaaaauguuucauggaaauauacuugucauggauguaaaaguugauuucaggugagaaaauacaagagccauagguaaggauuuccuauacaucaacugaaacugggaugaauguuucaugacuuccuuccucaagcuuuagcuucaguuguauaguaaagcacuuccuuuauucucugaaaaauuaaauugagcugcaaaggcagauuaauagcaauaaagagcagagucagaagaacagaccuugacauugggagaaaaacagaagucacuuuugucgcauuggcaauuauuuuuaauuuuuuaguuaguaguaaaaaaucuuauuuggauauauuuaauuugaucauauuaucuuauagcuuuuuacauaguauauacuuacaaaaacagaauuugcuuuuugccugacucaucugucauuucucaauugaaaaaaacacaguuguaacaaaauaugcuuuaucuauuucugauucuuaugauuaguauaagggugguguuuuuaaaauuaauaaaaguaaauuucugaaaauauaaaauuucuuaaagcauuuuaguugaaguuuuguaaauagaaauuugguuuuguuuuaguagauuuuagacauuauuccugacucugugcgguauuaacugcauugaacaugagcacugccaucacaguguaucaaauuaagcaaugggaaugucaaacuauuucauauaauagcuuauauuucagaaaguuacugcuuuauaacauuguggaaucuauuuuuuauguugguauguggggauacuaguuuuacuugccuuauacguuguccauaaucuauuauccauaguuuguuuuuacuauauacuuaauaagaggcugugucuuaaagugauccugcuauauuaauaaugacuccuaguuuccucagucuuuuuggcaagguuggggagaggaaacuauuacauauuauuaaaaaguuuaagaucuaugguuuucaaguuuaagaucuguaguuauuauguuuuauguaagaaacuguaaaauauaauagaauuagaaaauuauaaucuucaaguggagaaggauauaauauuccuguaguuguagaaauuauaaaagauugcuaaauuugacuaaguaaaaaaaaauuuuuuuaaagauucugcgugacaaaaaaaaacaaacaaacaauccauaaucaaugucaaaagacuaacugggaaaguuuauuugcauaugacaucauagcugaaaggcuaauuucucuaauuuauaaagaguugcuacagaucaauaagaaaaaaaccauccaucugauauaaaaaugagaaaagaguaggaaaaagguucacaggaaauaaaaaugaaaaaacuauucuuaaacaugugaaaaaguuauaguaaaauaaauguaaaauuaaaauuaaauuauauuuccauguaugauacggcaaacaucuuaaagguguucuaaccacuguguggugaaacaauaaauagcaaaauacauauuuucagacuuugcuauuaagaguuaguucaaccuucuguugaagcaauuucgcgguauguacagauguauaauguguguacacugauacugcccuucugggaauuuauagacagauuugcuuacaaauaugagaaauuaaauaauaccaagauagucacuacaacauuauuugcaaaugacaauagauuggaaguaaguaucuauuaacagggauaguagaauaaguuaugguucacucacacaaugcaacagccuuuacaaagaauaaagagcucuggccgggugcgguggcuuacgccuguaauccuagcauuuugggaggcugaggagggcggauugccugagcucaagaguucaagaccagccugggcaacaugguaaaacccugucucuacuaaaauacaaaaaaauuagccaggcaugguggcguacacuuguagucccagcuacuugggaggcugaggcgggagaauugcuugaacgcgggaggcggagguuguagugagcugagaucacgccacugcacuccagccugggugacagagugagacuccaucucaaaaaauaaaaauaaaauaaaaaauaaaagaaauaaagagcucuauuuguauugauacagaauggucuccaagaaauauuaguaaguaaaaaaggcaagaaaugcagaguauguaauaucgugacccuugugcaauguuuaagguuagaauuucaaaguuuaugccugaauaaaaaguauaauuucaauucuuaggaaauuuucgcauuuuacugauacuuaauuuacuuuaaccaaguuuuuauaauauaaauauuaauaacguauaaaagcuguaaaauauuuguuaugaugaguuuaaauguauuuuugugguagauuauagugggggaaaauagguacauauuuagaggcaaauauucuggcaauuauaagaggcuacuguaucuaucgagaaaaaaaugcgaggaaaucaugccaagauuuaggagauuauucuuaaauauauuucaguauuuuccccuuucuagagauuugguacauaaaguuucuuuguucagcauuuagauaaaaaauguguugcacuuagagcaugcuucauuauauuauuucaaaccuuuuuaguaaaacaguugaagauuuauaacuuuuguucguuuuauauugacaauauagacuucuuuccacuuuaagugcaucacugaaaauauuauuauucacuauuuuuuguaggcaaaagcaaaagcucgaccagaauuggcuuuauuuaugauaaaauaccugaugacauuaauuguuggcaucucugcugucuucuggguuggaagcaaaaagacaugcacagaaugggcuggguuuuuuaaacgaaaucgcaagagagaguaagaaacuauugaauugucugacacaauuuuuaaauaaauagaucaaaauaccaaggaacuguucaaaucaauguacuagaguuucauuauaucaacuauuauuucaauuugauuugccaacugaaguuuggaaauuuuuuuuaugaaagagacgugcuuuauuuuugcauuuguuacaauagucuuugacauauacuauuuaucauauaguauaugucugugacauauacuauucuauuugaaauaugaaugaaugauuuaugaaaggcauauuuucuuuucaugauuuauaguauauccaguauuauuacugcugucauuggauucauuauuuuggguacagcauuuuaaauaauuuuauccuuuuuaucaaggauaaaagauuaagacuuaaguauauauaaagaaaccuauaaaguaugauucaaauauaagugauguguuauggucauuauuuacuaacuuuaaaucuuauuacacacagcuaugaccuaaacuuucacuuauuugucuuacuuaagauguuaaaauucaaacuuauggaauauucuauaacaaaauugauuuauauuuaugaguaauucauuuuaguuuuauauauauauauauauaugcacacacacuauauacaagguacuauagcuuuuuaaaaauuguuccccauugguuugcuuaacucauuucagaacuguagaccauuucacaaauaaguuucugaagucugaagaaucguauucaacuggauuuuuuugcacuauuauuauaugucuaucucauauuuauauacucacacuaauuucaguguaacuugcuaauuuuuaacguuagaaagaaaagacuuauauuuaaaugaagaccguuaauuauauucucuauccuuuucuucugguuuacuuuuauauuacauauuuauauauuauacaaauacaguauuauguauaguacguuuaugcuguuuugagccuccuugcccucauccuuugauucuugccuuaauuucuugccaguuuacuauuuauacugacaaaagcaacuuagaguguauacacaaaagauuuuauaaaaucaguuuauguccuaguauuuauaaucccagauuuuauaauauaaaccauagaauuuucaacuuuagugacuaaggauuuuuggcaaaagauaugugauauccuuuauauccucuacuuuauagccacacuucuaauuugaguaaauccucuccuucaauuuucuuauaguccaaucagugaaagucgaagaguacuacaggaaucaugugaguuuuucuuaaagcacaauucuaaaguuaaacacaaaaagaagcacuauaaaccaaguucacacaagcugaaggucauuuccaaauccaugggaaccagcacaggagcuacagcaaaucauggcacuucugcaguagcaauuacuagccaugauuaccuaggacaagaaacuuugacagaaauccaaaccucaccagaaacaucaaugagagaggugaaagcggacggagcuagcacccccagguuaagagaacaggacuguggugaaccugccucgccagcagcauccaucuccagacucucuggggaacaggucgacgggaagggccaggcaggcaguguaucugaaagugcgcggagugaaggaaggugagauuugauuuuauguaaaaucaucacuauuuuaaauacugcauuacacauuuuuuauuaaagcauaacacauuuggaaagcauuuugugauauauuaugucuguacucuuaccccaaggaaguuuggguucagccuauaaauaugcuauuuaguaguuuaauucuuagcuuugagaacagcuuuaauauaggugguucaaguaggaauguucauuucuguggcaauuguuaagaguuccuuguacauuuaaguaaaugcaauuuacccaaaauacaggcuaaguuuuaauuaauacuacauuauaauucugucuaaaaagugucaccuuauacaaaauuauaaugugucauuuuaucuaaaauuauuuuauuuucugaacaugaaaagauauugacauuaucuuuaaugaauuuucucaaauggccauaggugaccaaaacacagguaagccagaaugcagacagcuaauugcauuaagaucucaagguuaucuuaccuaguccucucagacuaggcuaaaugcaccuucucugugauccuauggcagcuuucauauauuuggauuguaauuagauacaugcuuuaucuucucguagauuuguaaccuucucaaugggagagcuaaagucuuacucaucuuuauguucccaguuucuuacaugguacugauccauggugggaaaucaauaaaacauuuguuaaacugaggacaggaauccugccuuauucuauuccccacaagauuccauguucagcccuauauauauaaguagugcuugaugaaguuucugaaguaagugaaaauuauauuuuaaacaauuauuuggccaggcacgguggcucacgccuguaaucccagcacuuugggaggccaaggugggcagaucacaaggucaggagaucgagaccauucuggcuaacauggugaaaccccaucucuacugaaaauacaaaaaauuagccgggugugguggcacccaccuguagucccagcuacucgggaggcugaggcaggagaaucgcuugaacccaagagguggagguugcagugagcugagaucacgcuauuauugcacuccagccuagcaacagagugagacucugucucaaaaaaaaaauuuguauuuugaaguguuaaaguacaccugaagacuguuagcuauuuauucucugauaaagguggacacugguuaggggugaaacucaugaaaaauggcaucauauuuguguuuguggaugugugugugucaacuuuuuuucuuuuaucuaggauuaguccaaagagugauauuacugacacuggccuggcacagagcaacaauuugcagguccccaguucuucagaaccaagcagccucaaagguuccacaucucugcuuguucacccgguuucaggagugagaaaagagcagggaggugguugucauucagauacuugaagaacauuuucucucguuacucagaagcaaauuuguguuacacuggaagugaccuaugcacuguuuuguaagaaucacuguuacauucuucuuuugcacuuaaaguugcauugccuacuguuauacuggaaaaaauagaguucaagaauaauaugacucauuucacacaaagguuaaugacaacaauauaccugaaaacagaaaaugugcagguuaauaauauuuuuuuaauagugugggaggacagaguuagaggaaucuuccuuuucuauuuaugaagauucuacucuugguaagaguauuuuaagauguacuaugcuauuuuacuuuuuugauauaaaaucaagauauuucuuugcugaaguauuuaaaucuuauccuuguaucuuuuuauacauauuugaaaauaagcuuauauguauuugaacuuuuuugaaauccuauucaaguauuuuuaucaugcuauugugauauuuuagcacuuugguagcuuuuacacugaauuucuaagaaaauuguaaaauagucuucuuuuauacuguaaaaaaagauauaccaaaaagucuuauaauaggaauuuaacuuuaaaaacccacuuauugauaccuuaccaucuaaaaugugugauuuuuauagucucguuuuaggaauuucacagaucuaaauuauguaacugaaauaaggugcuuacucaaagaguguccacuauugauuguauuaugcugcucacugauccuucugcauauuuaaaauaaaauguccuaaaggguuaguagacaaaauguuagucuuuuguauauuaggccaagugcaauugacuucccuuuuuuaauguuucaugaccacccauugauuguauuauaaccacuuacaguugcuuauauuuuuuguuuuaacuuuuguuuuuuaacauuuagaauauuacauuuuguauuauacaguaccuuucucagacauuuuguagaauucauuucggcagcucacuaggauuuugcugaacauuaaaaagugugauagcgauauuagugccaaucaaauggaaaaaagguaguuuuaauaaacaagacacaacguuuuuauacaacauacuuuaaaauauuaaggaguuuucuuaauuuuguuuccuauuaaguauuauucuuugggcaagauuuucugaugcuuuugauuuucucucaauuuagcauuugcuuuugguuuuuuucucuauuuagcauucuguuaaggcacaaaaacuauguacuguaugggaaauguuguaaauauuaccuuuuccacauuuuaaacagacaacuuugaauacaaaaacuuuguuuugugugaucuuuucauuaauaaaauuaucuuuguauaagaa

SEQ ID NO: 17762 - RNA, 11479 nt, Homo sapiens
gggggcgggaggaauuaagggagggagagaggcgcgcgggugaaaggcgcauugaugcagccugcggcggccucggagcgcggcggagccagacgcugaccacguuccucuccucggucuccuccgccuccagcuccgcgcugcccggcagccgggagccaugcgaccccagggccccgccgccuccccgcagcggcuccgcggccuccugcugcuccugcugcugcagcugcccgcgccgucgagcgccucugagauccccaaggggaagcaaaaggcgcagcuccggcagagggaggugguggaccuggugaguccgagggagccgagccgggaccgccgcgcugguggaggggaccuggccgcgcgccccacgggcagggcgucagucuggcuguugggggugucugucuguacagcugugugucgugugucuugcugcgccggggugucaugcuuuuuauuuacaggugaagaaggaccugguuaugcgugcagugagucuuggaacucagaggggagaccaaaaugggaggccaucguggagcggacaugcgauaugggcccggugggucuccccgaaguacagggagucccccaauaauuucuggccccagggggaccccuugggaagggugggagggauagggcggcagugagaguaggaugaggagcuuggguacguccgaaguggaccugggaaaaacccuggccucgcugaucacauggaccugggccugggccagggcggugcaacguguccuuuguuggggcugguggccacgucugccugcgagagagaauaacaacccccacaaagcauccguccaacucuuuguaacuugaagacuaugagucacguugggucaucuuccuagggaguaugggcugcaauuuacuuuguuggacaaccacagcuggggcuaggaaugguucagaagguuuaaggccggaaagggaaaugaaggggcccggcgcuaacccucuaaggaccuguuuugcuucuguuuaaaccaaaugggcagucugucauuacacacacccugggucuucauauguggccgccagguaggagcaucacagucaagcuacgggagaaaacaguuuccaggaaacuggaaaugaacggcccgagugcuuuccaggggcucaucugugggaagguauguuugcuuaaaauccuucccucuaaaaaucaacaaacccaguggagggcggagagguucucuggccugugguaugagggagccuuucagagcuaccguaguccuuggcauauuauaaacuucagucucacuugcagacaaacaugauuuacaggcauugcaagacauaaguuggggcauuuuuuuuuaauuaaaaagaaaguuuugaauuuguuaagcugccauuuuaaacugagcuaauauaccaaguucccuggcagcuaguucuguauuggauucaaaagugcugggaaaaaaauucccgccauuucacacagcacuuuuuggugguaggcuguguaauuuugauccacaaaaggggacuauguguucaggcaacaguucuauuuuaaguguccaaauuauuaaaacugugccaaaugaguaugguucauguguaguuugcauuuuaugagucuguaguuaugauacacaaaauacccauuuuuccugugaagcuugcuauuuuccccccuucaaggauuuacaguaccugugguuucccacaacucuagccagacuuggaaaagauuuugcagucaggcucaggugcauccuguagguuggauuugguuuugcugacagaagaaguccacagucauuaagguuucaacagauucuauaaagcaacuucuuuguauaggaucuuucaaagcguuccuuucaagcuuccacaaagcucugcccccugguggccagugaaagaaacaggggcguauaaaagugcgcuucccuucacaucuuuuuuuuuucauuccacagacauuuauugagaguacuaagcauauguuggguuagcauuuuaaaguagaagacugauguaacaccugcggaaucgagucaaguaaaguuauauagucuuugaaauguaucuuuuagaugaaaaggugaauaaaaauucccaauauggcacaauggacauguugggccagauaauucuuguggggacuuguccuguccguugucgcguguuuagcagcaucguuuguacauacuagaugccaguagcaauccccucucccaaguugugacaaccaaaaaugucucuagacauagccaaguguccccuggaggacaaaauuguccccaguugagauccacugauauauaaugaaguaaaauuuagucuguguagcaucuugcccugaggggaauaauagugaaaaaaaucaaagaauaucagaagcagucuuauucccauuugaaauguaugucuaaacauuguauauaucugcuugugagagugaauuaaauuacuaaaauaaaaauaaagucuaaaacacaccaaacuauuuugaaauauuuugcacuuuuaaaaugcuuuacuuuuugugucuuugaauacuuuuguaauuguuaaaugcuuuuucuuuucuuuuuuuuaacuauuucucugacaguaaauaaguaguagugucuuuuucuucuuacagucaggaaaauggcgaugucaaagacuuaaaaagucauuuaucaaaccaaaacucaaacuggcgauggagacacaaauugauuagcaagcaucagucuaauuauauaggauucuucccagacaacuauuggauuuuaucauccaaucccagauacuguagucaaaagauaagcuuugaaguuacuuuaauaucuaagaaacuuuguuuuuuguuuucauugggaaauauaguuauacagaauaauacuaggcaacuuacacaaauagaggaaauguuagaguaaacauuuaaauggauugcauuggguuuuggagugucuaauaaacggcaccuuuguuccuagcugaaccaauucagguguagacacaggaauuagacagguggggcacaggauaucaccuuuaccacugaucauacagcauuggcauguauggcuuaugugugcuaggcugguggguuugcuaaugcucucuuccccaggucuaaauccugaaagguccacccagggcaguggacacacuuacccagaguugcugccuugcacugguccuggggaacauaggaauaauaauggcugacacauacaguguuuacuguguuccaggcauuguucuaagcacauuuuauauauuauucacuuaaaucucauacaaacccuauaaaguaagacucuuuauuauuauccacauuuuacagauaaggaaacaggcaccaaaauguugaguaauuugcccuaucucacagagcuaauguaagguggagccgggacaaaauccaaagaaacuggcucuagaauccaugcauuuaaaugcuacaagauguccuucuccaaacaaacagaaaaucauaguccuuacagacaguuugacagauuguggaugguccccuauugagaacuaauggucacuugaaacugggucacuuacugcuucuccuuggggaagaggggugggaugagaggccagaaauguuauccaagcacugcuucccccacuuaaaaacagggagaagcagggauuuucauacccaaguuggagcuauugccaguacaagauaauuauugacucuuaagauuuuauuuuauaauuaugucccuaggaauuuaucuuaaggaaauaauucaaaagaagaaaaaggcuguauggauauuuucauuacaauaauauucauaauaaaaaaaguagaaauaaacuauccaaaaauagugcaauguuugcauaaaacuguaaaaauccaggucccuuugcaagauacagaguuagaagaaaaaagcagaauaucaaauuauucccaccuuggaauacagcuauuuaaaauuguguaugccuauaaugagcagaagggagcaggcaaauaauuuuguccuccucugaugugugugugugugcguguaaagucugugcacuaaaaaauaugaaggaaaucacaauauuuuagaaauaauuugaaaaugaauucucuguaauaacucaucuagaacacgggcaugugguaugaagggauucuugacuccaagggcucaaaauaaaugcauuucuaaucauacugagucuuugacucuuaaguggugagaguuuucuuugccuuuucuuucucauuauaguauaauggaaugugcuuacaagggccagcaggagugccuggucgagacgggagcccuggggccaauggcauuccggguacaccugggaucccaggucgggauggauucaaaggagaaaagggggaaugucugagggaaagcuuugaggaguccuggacacccaacuacaagcaguguucauggaguucauugaauuauggcauagaucuugggaaaauugcgguaaguuugaauuauuuuaaaauugaagcaagauuuaaggguuuucauauuuuaguguuaauuuuuaggugacauuuuauuuuuuuuuaacuaaaagacuuaaaaaagagaaguagguagcaugugacuuuuaauuuaaaacuaaugaaaaaguuuauaacauuucagaauuucauagagauauuucuaagacaaaugcuuaucauuuuaaccauaguaucuaaaauaacauacuuuuuaaaaaugcaaacaaaagagagcauaugugucuguguuggacaguaagcaacuuuccaaucuuauccuaaaguaaauuuaaauuuagucuaagaaauucuguccuggcuucagacauaaaggugggaaaaaauuuccaagaaauuaccacauugaucuggaagcagaaguccauugguguuugucuuuauuuaggaagcaugcccagcuuaaaacugcuaagccuaagagaagugaaauggguuagaugugagguacuacagugauuauuuuaaguuauucugcaacauuaaggcugaguggcagagaauuacucaaaauagccuguccggucauguauuuugacuaauguuucagucacuuugauuaguguuugcuucaaaaguaauuggcaaguccacugggauggaagagaguugaagaaguugaugcuauuuauaagccucuuuucucuguugaugaacucuguacaugguuccauauucacaacauauuacuucaugauuuuacugcuaccaucaagcaauuacaagaaauuuguuucauaaaacuccaagauuuuaagaugcacucuguguauaaucccuguuccuuaucucagcucuuucugcucuauuaagaguuugagacugucuuguuuugugauagaauuuccauguagcuuccauaguuaugaugacuaugaccuuuucuguguucauguguguuucuagaaaacauuuuguuaaaauguucccuaguuauuuaaacaucugacauugauagacugguuguuuauuuauaguuguucaucaaaaguuacugaguucuuucuaaaagcuauccuuguggguucugaauuauuaauauguuuucaaguuccuuuuagcaauggucaggauggguaugguaaccuucuaugaguaaaggauaauagguccaugagccaauagacagacaaauuugcauagaccaaugagaaaauaagcaaacaagaaaccugggccuuaucauugcaucauauagauaaagacuaaaaacccugccuauccuuuacucccucauacuguuugcuguugcucgaaaagaaacacgucaagagucaauacgaauggacagaacuagucuagaauguaaguuccaugaagguagggauucugguuuguuaacugcucuaucuguaccauuuagcacauaguuggggcucaguaaauauuuuuugaaugcaaaaaaaagaggaaauauauaaauugauuuuaucaaaaguacugaaggcuagccuuuuuugauaaaacugaaagauacccucaauggggcgaaaaguucugagaaagcugcaauuugauuuucuuagaguuccuauaucaaaaucucuuaccuagcuugcagaaaaucucccucccucuauaaaaguuaagcuuuauuuuuguuuauuuuaauuuuuuugagacagagucucacuuuuuugcccaggcuaaagugcaguggcacaauuucggcuuacugcaaccuccaccucuuggguucaagcgauucucacgucucagccucccgaguaacugggauuacaggcgugcgccaccacacccagcaaauuuuuuguauuuuuaguagagauggguuucgccauguuggccaggcuugucucuaaccccuggccucaaguaaucugccccccucggccucccaaaaugcugggauuacagguaugagccaccacacccggccaaguuaaacuuuuuaaauacauuuuggggaaaaggauaguuaaguaaaauucaccagucucaaaagcucuuuuuaauuaaaauagaaaauguuaauuaaaucccauuucuauguuugugacaggaguguacauuuacaaagaugcguucaaauagugcucuaagaguuuuguucaguggcucacuucggcuaaaaugcagaaaugcaugcugucagcguugguauuucacauucaauggagcugaauguucaggaccucuucccauugaagcuauaauuuauuuggaccaaggaagcccugaaaugaauucaacaauuaauauucaucgcacuucuucugguauguaaaauugugacauugcaagaugugccucagaucuaaguaagauuaguuuugagucccacuaucauguugguucacuagccuacuguaaagggaccucuagcaaguuuucaaugcaugauucuccacccuggguuguacuucugcauuaccucucgaucuuuuaaaaauacauagaugccugggcccuaucucugaugaacuaacgcagaaucucuagcaguaagaccacagcuucuguguuuuuuaaaagauccccuggugauucagaugugccccaggcuugaaaaucagugaguuaaaugacauggcaaaauagccaauaaugccauagagcaguggucuuucaaccuuggcuacauauugggcucacuguaggaacucugggaacuuuaaaaagaaaugccuaucccacccuuccagggagucagauuuaacaggucugggugcagacuuggcaaugggacuuucgaaguaucucuugguaggcugggcgugguagcucacaccuguaaucccagcacuuugggaggcugagacgggcaaucacuugagccuagcaguuugagacaaaccugggcaagagggcgaaaccccaucucuacaaaaaaaauaccaaaaaauuagucccaacuacuauggaggcugaggugggaggauggcuucagcccaggaggcagagguugcagugagcugaggcugccccacugcacuccauccugagugaugacagagugagaugcagucucaaaaaaaaaaaaucuccuggucauucuaauguucagccaaaauuuagaaccacuggcucagacuaauaaggagacugauuuuucugccuuauccuuuaaaaggguggauacugucugcugaauuuguaaaagacaaaauuuuuauacuguuucuguauucuguuuccaccuaguaugaggaaaagacauucaguggucacuuaaacugucagaaaaauaucauuggguuguuuuauguacuuauguauuuguuuauuuauuuauuuauuuuagagacagggucuugcucuguugcucagccuggaguacacuggcaggaucacagcucacugcaacuuugaacacuuggccucaagugauccuccugcucagcuucccaaagugccaugauuacaggcaugagccaccaugccuggccuguuuguucuauuuuaagauucauuaaagaaaguuuagaaaauaccagaaaauagaagaguuaaaaaaaaaaaaaacuauuaaucucauccuccagagacaccacuaucaauauuuuguugucagccauuuugguuucuugaguugcaguggauggcacaccaugguagcaucagaaaguguacauacuguuauauucauaugccuuuucauagaagaaaaauaagaaacuauacauaugguuagcaucauuuccuugauuuccugaagagauuuuucacuaaucuuauaauuaaaaaugguugaggggagggaggagauaaucucacucuucccuucccucaaaauaacauuucagcauucuuuagggcuccaagucagguacugaaccccaaaaccaauuuauuccuaagcaaucaagggcauccccuccacauuuucccucagauccccacaauauccuugaaacauaaagaagagauuuuaacccccucucuuugcauauugagaaacccagggaaauacagcgucuuacacgggacaguagaaucagcguucaggagagcagaaaccaacgcccuguucucuuggcucccaguucucuuuguaaucagauuaaaaacccucuucacuaaguacuuagauacaugugcuggaaaggaagaagugcuucccaucuaagaaauagucuuuaaaauaagaagaaucuagauauuaaaaauaaaauuugauuaggaagugauauguucagacagucguugauauaagcaacuuacauucuauucuguuaucuuuaagguguguguuaauauuuugcuaauguaagcccuuaggcccaggaacugugucauauacacgcauauacuuuauaaauaauuuaacacagcauuucccaaccauugugugcaaacucauuuggugugaucaguuggguggagugucacaaguaauuuguuauuaauaacaguuuuuguauuauuguggauuaaaaguuaccucuguaacagaaucacuuuuucugacauacugauagucucucuuaagggaaaggaaaggggugcacuuauaguuagcauaucagaggauggcuuaaagccuugauaugcccaugggaguuugacaaaugguugucaucuguuacauggucuaggaggaaaacagguugagaacucccaauccaacauaucguuuuuacuuaacaagcuaucauacuacauuaucacagcaaaaauguucauucaacauuauuucaucugcuaaagaccaugaagugaccauuugacuguccucagaugaggcugaugcaagacccaagcuugucugacguccuuaggccguagggggaagugaacaaguuucuaggccauggcugucaagacccugggaaaacaugagcauuuguaggcauuuucacuuggcaugguacuaagaauaccagauuaaaugggauugugggccuacuauuuaguucccccaacuugggaaggggacugaaccagagacaggucccuggauucugagagacuugcucuggauuuacuccugugauaguuuauguaagcagauugcuucagaccuacaucucugggucucagcaggaaugcacuaaccucaaucaaauaggaagccuaaccagucacauaaagucauccacuauaucaggauucauuuucuuuuuuuucuuuaguauuauuauuauuauacuuuaaguucuaggguacaugugcauaacgugcagguuuguuacuuauguauacaugugccauguuuguuugcugcacccauuaacucgccauuuacauuagguauuucuccuaaugcuaucccucccccagccccccaccccacaacaggcccggggugugauguuccccgcccuguguccaaguguucucauuguucaauucccacuuaugagugagcaaacuaucacaaggacagaaaaccaggauucauuuucuugaaucugccaaccuacaguuucuucuccagcuuuacacauacaucaaagguaccaugucuuuuugccugcuaaaaugacugagggauuuuuuuuuuuuaauuuaagagaagacuuugguaagauggaaugcaacuuguauuguuaguaggugaaaguccagaggacaugugaaaaggugcauaauuguaaugcauaaaaacacagaggaaaagcaggggggauuuucuguuuuauguuuuuucacuaugaggaaauucuguguaaaaugggauucccagauugaaggacugguguaaugauuauguagaauuucuuuuaauguuauaaaaguuauuucuucuggcugggcacgguggcucaugccuguaaucccagcacuuugggaggccgaaguggguaaaucacgaggucaggagaucgagaccauccuggcuaacacgaugaaacuccaucucuacuaaaaauacaaaaaauuagccaggcgugguggcaggugccuguagucccagcuacucaggaggcugagacaggaaaauugcuugaacgugggaagcggagguugcggugcacugagauugcgccagugcacuccagccugggugacagagcgagauuccaucucaaaaaaaaaaaaaaguuauuucgucuacuugucuagcaucacuuaucagcagauaagugucggaaagggcuuucuuuuuuuaaaaaagacuugcauaucaaaugaaagucuuggcuuuuaaaaguauauauagccuuucuuuguuuauucaaauaaauugcuuuuuuguuuuaagcuaucucuguaaguauacaaauucugguuuuaugcuugaaaccuguaagaacacugcuuguuaaacuuauaucauagaauggauauguauacaucuuuuaaaaauauuuauguaccaauuuagaaaaagaggacuucauuauaaaaaccuuaucaaguauuaaaauuuuuaaguagcauuacauuaaacagaauuacaaacuagcuuucugaaguuauaaaauuuaacuaaaggauuuugcucuuuguucuaaagaaagauguaacuuucaucuuugucuugcaguggaaggacuuugugaaggaauuggugcuggauuaguggauguugcuaucuggguugguacuuguucagauuacccaaaaggagaugcuucuacuggauggaauucaguuucucgcaucauuauugaagaacuaccaaaauaaaugcuuuaauuuucauuugcuaccucuuuuuuuauuaugccuuggaaugguucacuuaaaugacauuuuaaauaaguuuauguauacaucugaaugaaaagcaaagcuaaauauguuuacagaccaaagugugauuucacacuguuuuuaaaucuagcauuauucauuuugcuucaaucaaaagugguuucaauauuuuuuuuaguugguuagaauacuuucuucauagucacauucucucaaccuauaauuuggaauauuguuguggucuuuuguuuuuucucuuaguauagcauuuuuaaaaaaauauaaaagcuaccaaucuuuguacaauuuguaaauguuaagaauuuuuuuuauaucuguuaaauaaaa

SEQ ID NO: 17763 - RNA, 17129 nt, Homo sapiens
agaggcugggaccuccccuccaucgcgcuuuccgccggcgugacguagugucugugccccguucuugcccccucaguacuagagucuccggcuucgcucacgcgccuugggcauaagaguccucucguuggucccggaggugggguugcgcucacaaggggcgaccgucgccacgguggcggccacugcaucgcgucccaccuccgcggcccugggcgccguggugucgacgggccccgagccuaugacgggccagggccagucggcguccgggucgucggcguggagcacgguauuccgccacguccgguaugagaaccugauagcgggcgugagcggcggcgucuuauccaaccuugcgcugcauccgcucgaccucgugaagauccgcuucgccgguaagagcccgcccagacaccgggcugcauccucucacugucagcccgaacuggaucuccuccgucuuuuccguucuagggggaggaggagcguugaagggagcguugcuguccgcguuggcuaaccugaacuagauuugaggaaauggugcuugguggaggggucggccugcgaucuuccccgcuccucaagacuaagagagggggcauguauguagagaagucugagaaaaaacauccucauuggcagagaagaugggauucaaagccugauuuguaaaauaaagaagggauugucacauuuuaagguuuaguccucacacgugcaaaucauucacucuuggaggaacuuugaaaucuuagcauacccacgugguuuggcagcucgacuaguauugggauagggcguaaucuucagcgaaugguugggaguagauuuagaauagaauucucuugaauguuuguuuuuuggcauuuguagaaugguacaaguuucugugaaaaaauagcuagaaucgaaauacuauuuuaaguguauuagaugaauugaguauguugaaauuaacaaagcauuuuagaaguuaaacucaacacuaaagucuggaaagaguuucaaagaugaucuuugauaacugaaauugcagaaaauaguuuccaaauaaaguuauuacaaguuaaguucagccuugagaauuaaaucuacagaaguuguuuauuuuagcauuaggcaauucaguucacuugauuuauauucucuuaauauuuguagacugcuguaugggcuacagaaguaucuaauaaaguucuugccuucagggaacuuagaauuuaauuguaggcguuagacuuagucauauaaaagguaauucuagacaacauaaaaucaagaaauacaaaaacaaaauauaaauacagguaaaccguuaagaaaauucuacauuacugauggccauguguaucuuuaagguucaguggaagauuggggcuugggguuucccauagaagggcuaauauuuugacagcuggagaggaagcaagaacccguucuaugaaggaaaaucaucgaaaauuauggaguauuaucucuagaaaaaacaccacaaagacauauaaugucaugaaguuuuaugaugcaugcacaaauaauuauguuauugacaaguaaucuuuaucgaguauuuacuaggagcaaggcagugaacuaugcuuuagaugcauuaucucauuuauuauccuguaaaucuauucacaggaacaauccugugaguuuaugauaucugcuauacagaugaggauaacagaaguugacuaacuugcccaagucacaaguuuguaaagauggaucugggauuuaaacccagguaaucuaacucuggaacccucuggcacuuaaccccucaccguauuaccucuauaaguaccuguuauacaaugguuugaacauuggaagaauuuuagacuugccugcaggugcaggccuguaugacuugcugucugucuucaguagcauuuuaucuaggagcagaagaggugauagucgaggugaucauugaagaauagugugguuggccugaugaguuuagacagugcuuugaagcauaucauuccugaggaaagggaauucuugguaccugagaagauuaauagucuugaugaauugggaagaguauuaggagacuaguggggcugaggugacagauaaaaggauugaguuuggauuggaggccuaaauuaaagauccaggaguggaagcaggacuuuguaauaauaaagcucacaguguagcugugaaauggugauaggaggaaaacuuaagaagaugaauaacgaaauaaaaauuuauugauuaucaacaucagugcugaguaacauacuauaauuuuuaugcuuccauguaauuaaacucauuuaauaaaguuaaaaucuaaugaugacaggguguggggguuaauucugaaugcaugugcuauuaaaccaaaccuggaauuuuucugugaguucaaguauaaauuggaacucagagguguccagagugguagaaagauuagaaauuacuucauaugaaaaaugacuggaggaacuaguuuagcucgggagagaaaaaaaccucaagauauuuagagaacuuacaugugggaaagggggcugccuuauuguggguugauccuaaggucagacacagguugaguggaaauuacaaggaagcagauuuugguuuggcaauguggcagugcucagaaaugaaauugaugaugaucagaagugguucagauaguaguuggaugacagaaguuagaagauauucuuguauuagguggaaagauuggauuggaugauuauucaggccccuucuaacuuuacucuguaauuuuaaacccucaagaaugaugagagagccccaacaaagaaugagauguaaaaauaguaauuuucucaaauacccaaaagccuaaucugcaaguuaaaguugugugugagcuuuugugaagaauguagagacuaugacuacauccaaaauauuaaggaaccaaaacguaaaauucaguaacaguagugccgaguaaaguuguguaaguaugugguaucgcaagacccaguagcauaaauaaacuaguacuuacagagugcuugcaauaugucaggcauaauucuaagagcuuuauauguacuaacugauuuaauccuuuauaauuuuuagaguuagguucuauuauuuuuuccuaucuuacagaaaaacucaggcacagagcaaucaagugacuuacucaggguugcaaaguaauugcuagaacugggauucaagcucagaaagucuguuuccguaacauaugcuguuaguuugaaaccaugaguggguaguuugguauagcuaaaggguaaauuaaaaugcuagagauggaaauaaagaaugauuccagaaaguuaagcugccagauugacauuaucuuuuaugccaugugaaaauggaaacuggcaguagaaccacaacccuuaguagggcaggauguuaggaauaagagaccaggacuagaagcacagggauggcaguugaagccacuuaaugguugagacaccaccccuauuugguggaaauugugccuauaaaucagcauuuaaggaugggcagagaaaagggggccaaggaaauuuauuggcaaagaagcaagaggacauucaagaaaaugugguguuaaaugagccagaagagagggauuuacacaauaucagguguauuaagggguuccuaagaaagagagaacuccaaagugccuuugaagguucuuaauuagagcgcuugcaguaauugguaaagcucaaaccagauugcagcaggggugagagagucccugcugagauugucucgggggccagggaggggcugguuuucucauugcagacacuuaccugauaagggggcacugagaucaaagaggaaauacuuaggagagacuuaagucuauuuaaauacuaaugggaaagaacugaaaucaaggaagaaauugggaaauggaggcaggaggauaaagaguaacguaucuaacuaagguggguuaucugaagaagcaggaucuagaacaagcauuuuugaccagaacgcuuaguaggaaauaaauuuuaccuuugcuauccacacacaaacauuacugaaacacaaguuucaugaaacauuacuuauccuuaacuacuuguaaugucauuuauauuuguuuucaauuccagucugguuuuaaagaaaagauacuggcaaucuguucaauugguuucuugauucaucugcaauuuuaaaaacaccaauauagagcacagguaggggggagauuaauuuuauuaagagagacaaacuugucacagaggaaaggagggguaaaacuaacauccagcaaaugaaacagguuguguaagggugauagugcuagaugauaauuuuuuuaaagucauuauauugucuuucuuugaaaaugaauuuaaaauuaguguccugucuuggcuccuuucuguacaccaaacuuuuuaucuucagcuuguguccauuggcauuuuuuuagugcugugauaggccauuguaaguuauuugauagguacuuagaucuacauacuaauucauuaguggcaaauguuuuuaaaaugaucaugaggucauuuaagccaguggucccuaaccuuuuuggcaccagggacugauuucauggaagacaauuuuuccaugaacggggguggaggagguauggaugauuucaggaugaaacuguuucaccucagaucaucaggcaauaaauucucauaaggagugugcagccuagaucccuugcaugugcaguucacaauaggguucgagauucuguaagaacccaaugccaccacugaucggacaggaggcagaguucaggcaguaaugcaagcaauggggagcagcuguaaguacagaugaagcuucgcucguacuccgcccaccuaggucaccugcugcugugugacccaauuccuaacaggccauggauugguacccggaguuggggaccccugauuuagaccaaaaaaauuuacuguauuuuaucgauauaacaauuuuaauuuuauguuagggagauuauaguucagcauugguuuauaccuaugaaaagaacagguaguguuuuuaugguugguuuugcuuuuuaccucaagagagaaaugguauugugaguuuauuauugagaggaaaauggaaaguucuuagaaaaagggaucuauacagaagaaugagacacacagaauccaggggaagcaucagaaaguuuauaaacuaugcaggaaaaccuuucucaagagccugucauucugcugccugccuuuaaacuuguugucuuauauaaaccucaaaaaacccggugagguacaugauuuauccccauuuuauaagugaggaugcugaagcucagaaaggguaagaccauguagcgaauuagggagguuacguaucaaacccaggucuucugacaaaaccugauguacuuuaaucucccuucaugcuguaacguuggcagguuaaugaugaaagaaauugacuuuucccccuuuuccuggcaaugguaaauagugauccuucuuugccaggcuggauuauacacagugagguaguggcaaggggacagugaaccagggaugcugguauggcuaguggaguguaauuuguauaaacuuucuggaaggcagguucaauacguauuuguaacuuaaguuuauacccauugacccauaucaguucccuuucuaauaacuaauucuaaggcaguaauaagcauucaugcagauuguuguacggaauguuguuuagaggacuuuuuauaauagccaaaaaaaaaaagaauucauaggucagguggagaaaugacuguguaaaucaugggauaucuauaagauggaaaaccauaaugucauauguuaaaaucuuauuugggggaaucuguugaauaacaagggggagugcucacaaauaaucuugaguggaaaacaaagcuguauacaaaauuauauauaguaaaauuacaaguuuggauauccuguaguauaauguagaaugguaugcauaauguagaaugccguugccgauuacugagauacuuaauacucuacuuauagaauuaagugauuuuucaaagcaguaaauaauugauacuguauuauuccuugugguuuucuauaaccugcucacaccuuuguaauuaguccuuuuaacuaccccucaugcccuagaguuacccuauuuugaaugugcuuucuguuuccuacagagagaugaaaugaaaagugccagauuuauaaucuagauuauauuuuuuacaaaauuagcaagaagacuacuuuaaaugcugaugauacuaguugaaaacugaugguaucucaaaguaggaugauggcagugugaacugagacauagacaggugcaagagaaauuugugauguggaaucaaaaggacuuguuauuugauaaaaagggaugggaaggaggaggguucauggauaguccccagguaucuggugugggcaucaaugcagaugaugauggcguuuguugaguuauauggaacacucuaguaagagcagcuucagaagggauggggaaaacuaguucaauuuuggauauguucaagugaaaugcuuuucuacuuucuacuuggauuuugacauauguugguggggaggauagaaagaauuuccaggaaaaaaaguuuaccccauccucugcauuuucuuuccugccacuccucagucuugauagcauucgauauaaauugaggcuccuagcuaguuuauuuuuugaguaauauuuuuuaacauucaaauccuuaaccuuggagcaaaaacaaaaccuaaguguugaaaccuaguuaccuaagagacuuuuggauuaagagcuaaucuaauauuuccuuaaauauuauuugagugcuuaguaugcccucaauaaacacuugaauaaauucaugaauguaguaguuuuaaaauauuaaagccugggcugggcauaguggcucacaccuguaaucccagcacuuuggaaggccgagguggguggaucaccugaggucagggguuugagaccaggcuggccaacauggugaaagccugucuguacuuaaaaaaaaaaaaauacaaaaauuagcugggcauggugauguguaccuguuaucccagcuacuaggggagcugaggcaggaggauugcuugaaccugggaggcggagauugcagugagccaagaucgugccacugcacuccagccggggcaauagagcgggacucugacacaaaaauguauauuuuacauauuuauauauauauauauuuauauauauauguaauauauauauaaaagccuggaaaauaauuuuuucuaccuaaaaaaguuuuucuucuaaguuuaucuccuuuauauaaccaauuguacagugucuguguuuauaugugauacagagcuagaacuuuguucuuaccugacuuuguguaucccuugaugcagugagugauggauuggaacugagaccgaaauauaauggaauuuuacauugcuugacuaccauuuggaaacuugauggacuacggggacuuuaucaaggaguaaccccaaauauauggggugcagguuuauccuggggacucuacuuuuucuugugaguagauuugggagauuuuacaguauuaaauuaaaaaggaauuuuuguuuucggugauuuuuacauguaaauguaaaaugauaaguugagucauuuaaucaguuucucugaauuggaaggaucaggaagaacaaaauggcugauuaguuauuugauuaguuugauucaaaauggcuuauuaguuugauuaucagaugccuauuaauagcuaauggcuuauuagcuauuaucagaggcauuauuuggucuggaagaaaauucuuaauaggaaaaaggcaaagagaugagguggaaugauacuuuuagagaagccauuucugugaggugaauucaggaagaugaaauguauaacugauuacuuuuguaagcuaaauacauauuaaagagagcuuuuuauuuuaguuaaagccauuugaaaaacagccaacuccagauaauucacaaugaaauuguagggccccaucgguguuuuauuagguguuuuggccauaucaauacauacuugugagcauuucuaauuagagucaaaauauuacuagauuagaaaaaguugaaucagucgguuuguuauuuauuagugauuuuggaaagugauguagagacuggaagagccugcagcuguuguccaaaaugaauccuguggauuucagcucucuuugguauucaauuuugauaaagaaagauuguuuaaauaacuaaguuauuuuuuccguuuaucagagauuaguuccggagugucccaaauagaaaauuuuauaaauacugaaguaucauuaauuacuuguuuauccucaaccagauucccaagauauuugagauggcuuacaaaaauacauuuguuuaugaugaagguggaaaaacagagaggauagaccuuaggguccucauaugaauagguaccacaggaaaucgcuguugggaacagaaagcaaaagccagugcauggccuaaaggguuugaggcaaauuguuucuucuuguuugaccugccccaucaucuucccagcucauugcuuuccuuacuccuucaccagucagauaucaucaccauuuaaaauaacugcucucaccugccuccugaagaagccauagaaaguuccuguggcaggcacauucagcuuauuuagugaacaagaacauggacacaaaccaucaucgcacuguauugcaggagcaugugcugcucugagcacgccucugaucugugaaacugaaaccaugaauaaggaagcuuuucuuugcuucaacagauuucauuuuuaggaaaacaucaguaucuaguguauuugccuuugucuucuuugugucauauauuuugcuugaucucccauaaguuuauggcaguauccaaaccaaucuuaaaguaucuuuuaagugaaagcaaaauaaaauucagccuuaaaauuguuuaaauauuuuuucucuuuuucuucucuuuagagaggugugugugaaacuauauacacacacaccccccuugacauauauauguguguauagaauguauguauauauguauauauagauauguuuauguauauguguguguguauauauauauauauacacacacacacacacaucaugaauuugaguuguauagauucuucaagacagcuucuaaggacaagccauauaaaauuuuugugauaagaauuucuugggccaggugcaguggcucacaccuguaaucccagcacuuuaggaggccaaggugggaggaucacaugagucugggaguucaggaccagccugggcaacauagugagaccuccaucucuucaaaaaauuuaaaaaagaauuagucuggcaucaugaugcugcaugccuguagucuuagcuaauuaggaggcugaggcaggaggauugcuugagccuagaaauucaagguuacagugagcuaugauugugucacugcacuccagccugggugauagagugagacucugucucugaaauaaaaaaaaaaagaaagaauguguucacuugacaucgucauccaagagaaaaguagaaaucggcauuaaaggaaauaggcugauuugacucccuuacucugaaacauuuaauggauauuuucuaccaaauaaaaugcaaaucucaaucuaccacucaaguguggccaauuuucccugucuucccacccacccuuauuacuuuucaccaugcucaucuuuuuccuuguugaaacugugccugucucaauacccagcucaauacuaccuccuacacaaagccuucugugaucucagucauaauuccugaauuucuucuauugucuguguugucuuuuauuaugauuuauuugugugccacuuaauaguccuuauuaauuuguuaagaaaaauucaucacuuguuuaucuuuuuaucaucuauuagaaagcuaacuauaguaccugaacguaggugcucaguauauauuuguuagguaccccuucuuuggucccuuuugucuuuuauggccagucuguguaccacuacuguacucuccccuccucccaguuuccuugucuuuugaaguuaauugaugagugucugauuaaaauauuuuacauuuguauugcuagccguauucauuugagagggaggggugguauaaucuugcagcaaaccacuuccagcaaauucauucuugaaaaaggucucauuuugugguugcauuaugcauugacuugugcuuuugggguacugcuguugacuuacauacacuuuaaaacagacuuaaugacaccuauucaaauuaaacugcucacauuuaauucuuuuaguuacaaugccaucaagucauauaaaacagaaggaagagcugaacguuuagaggcaacagaauaccuugucucagcugcugaagcugguaaggcaaugugugaaauauaaaaaugucaccuuccaaacuuaauuuucaguuuugguuuuugauuucuuuucuuugaacaccugaguuuaaauaugcccaucuaacuguauuaaaucaguuacauggaauuucuguuuuuuuuguuuguuuguuuuucgguuuuugguuuuuuuuuuugaggcggaguuucgcucuugucgcccaggcuggagugcgguggcgcuaucucggcucacugcaaccucugccuucggguuucaagcgauaauccugccucagccuccugaguagcugggacuacagacacgugccaccacgcccagcuaauuuuuuguauuuuuaguagagaugggguuucaccauguuggccagaauugucucgaucucuugaccucuugauccaccugccucugccucccaaagugcugggauuacaggcaugagccaccacgccuggcuguuauauggaauuucuuagcagaaauuauuaugauuacucugugcagauuucaagaauuuuacucaugacaaagugguaaaguuuagaaaaguuaugaaucccuaaugguuuaaaaugauuugguauaguguuucuuuaaaguauaauuuuaauuuucaaauuauacaauuuaguagccuuguuuaaucgccucacuuauguauacuauccagaaggaaaaaacaguaagagccguaagucuuuguaacuccuacuuuaauaccuugauuucuuaauguugauuagucaaaaccuaacuuaaucauuuuugaacacauagccacuagcaaaaaccugagucauaacaggaccaaauauuuguugaauaaaggacuacuuaggaaaccuggcaaaugagaaacuuaaccagaugaauuuuuuaauaaaauugucacucuauaaaggauguaaaaugugacuuacuguauuacauaauuauuuaauuuuugagggguaguaguuacuuuggauuugaggaagauugugauaaaguugggguagauauaugugucacaugcacagauuauuggggugccagauuccugguucuuuucgccuaucuucaaccccucugggauuauaccaugugcuacaccuaaggucuguaucugcuuaccaucuguucucugcaccaggccacguuguuuaggagucaagacauuuuugcuauccuuacacuucaaagagaaagcauuucacauuuccaucucccuuuuaauuuaccucuagcuaacugcaugaggaacuuuuuaugacuaccaaaaacaaugucuaccuuuugacccuaagacugugccucagaaacuacauuucacaguuucagauaugguccugugcauuaucuuuuuuuuuuuuuuuuuuuuuacauaaauguacuguuucuaauuuggguugucauaagugcgaaaguaucuguaugcugaauaaucuuauugaaaucucauuuuaggagccaugacccucugcauuacaaacccauuauggguaacaaaaacucgccuuauguuacaguaugaugcuguuguuaacuccccacaccgacaauauaaaggaauguuugauacacuugugaaaauauauaaguaugaaggugugcguggauuauauaagguaacaaauuaucaauauauuuuaaauaacugaaaaauuugaauuuccguuggcucuguugucuuaguucugaaugaccuauaguaaguccuaaaaagaagccacacuuaggcaaaaaacaauuuaaugaaaacugaaauauaguuaauaauacugaaauuguacuuuaagcuguuuguccccauuaacauaggauguaucaucaugacauuggugggcaugagaucugucuaaaacuuugucaaguuucuauuugauaaguuauacaaccaggucacuuauuccuuacuccauuccuuggaagcuguggucucuuggggaccugggauaauguagucuggagaagacauuagcaguucuaacaggaucuuauuuuauugaguuuuuuuauucaucucaaaucuuacauaaauuuaaaaauaacgaaacaaaucaaacccagccuuuugccuguuguaauauuuuaaaaauuuuuuuccuagugucagaucuguuuucugauuuuauaacuccuuuuuauuuuccccuuuucugccuucuauucccaucuauugcuuauccccauaaagaaauuuuuaggcauacauagguuaaaaucaaaauuagacacauugaauuucaguuuguuuuucaagaauugaguaauagcuuuuaaaaucauuuuaaggcugauaugauuuuacugaccuauaagcaagaauuuuauaaauauauuauuuuuauguuuuuucgucacuuucugccuuauucuuucagaauaccuaugcucaguucauugauuuaccauuaccuuuaguuucuuaacuuuccagaauuuaguuucccacucacaccucaagucuugacagugugggucuucuuuauauguauacuguuuaaagaaaaacuaauaugugaacauccaaaccuuuaaaaauaaaguagaagagaauacuacccaugucuuuauauuacaaguuuuuaaccccauauuuuaaaaaugugauuugugcaaaauuaaaugaauuugcuuaaagugcuguaaugagagagaagagaaaguauuuuacuuaaauauauuguucuucaaacguauguuguuuugcuuuuuaaaaaucauucccuuguagggauuuguuccugggcuguuuggaacaucgcauggugcccuucaguuuauggcauaugaauugcugaaguugaaguacaaccagcauaucaauagauuaccagaagcccaguugguaagauuauucuuguaaaaaugauaucauuuccuuuuauggguauuuaauagguagaaauuuuugucaugcuuacuuuggugguagugcuaugaugaugaguacuggcucugccacugauuuaauuuauaguuaaauauuuauaggcugaagccacacaaaugucaaaaauagaaucccuuaaagauccauuuaaauguuuuuuguauauaauuuuuacuucuguauuuuuaaagaaauccugucuaaagaaaaaacuguuuuguauugccauuuuagagcacaguagaauauauaucuguugcagcacuauccaaaauauuugcugucgcagcaacauacccauaucaagucguaagagcucgucuucaggaucaacacauguuuuacagugguguaauagauguaaucacaaagacauggaggugagagcacgugcuauaucaaaaauugcuuugacaagguaccuugcauaucuuagaccauccuguugauacuaguuuuauagcaaaggccaguuugcuguggugaaaacaugauugguggucccugcuuucccaguuauuacguaugugaccauggccuuaaucucucugagacuuaauuucuucauuuguaaaguaagacuuucuaacuaauagguuguuauaagaaucaaauuaaaugugugaaaauguuuuggaaaauaaaauuuagguguuauaaaauaucugaaugguauugaauauaagaagucauaagacuagcuuaauacauucaagaaggcuccacaccugcuacuggcaccauaacuuuugcaaauacuuguuuccauauaugaaagagauguuuguucuucaguaugagacuaguuaaauuauuauaggcagacaucaccauauuucccuuuaauucuaaaggaacagaggagaacauuuaggauguuuaaauuuaauucaauucaagaaauauuuaaugagcaccuaagugacaaauuucuaggccguauuccauauuauuggcauuaaggaaauaaaguuuuauauuuguaugugcuguauuuaauguuggcuagcauuuauccaagcuaugagguuuuuuaaugccuacauuaggucaauuaaaacuccugcuuguacauacauuuaaaagcauuugaaagauagcuaauugaaagcacuuuuuaguucaguuuugaggugucccuacccucucuuacucaguccauccauaaaaggaauguaaaucccuacagauggcuuauaaacuacauuacuuuaggacauugaaaacaugaacuuaaaucagaguaagguuugacugcugcuugcuccaugccuugugucaguuagaacuuccguguuuucaagcuagcucuauacaaaauuaagcauuaucuauuuuucccucuaaaggaaagaaggcgucgguggauuuuacaagggaauugcuccuaauuugauuagagugacuccagccugcuguauuaccuuugugguauaugaaaacgucucacauuuuuuacuugaccuuagagaaaagagaaaguaagcucaaagaggacaauuccaguauaucugcccaaggcagcaacaagcucuuuuguguuuaaggcauaaaagaagaauucugcauagaaacauggcucauauucgaaauugcucuauagucauuagaagccagagaacugcuaagucuccugcaauguuuuucuugcuuuuugccuuccccauauauauggaacuuggcuaccucugccugaaauggcugccaucaacacaauguuaaaacugacacgaaggauagaguuucacagauuucuacguuuuauugguggaagcugauuugcaacauuugcuaaauggauuagaugaauguacuucuuuuugugagcuuacuugccuggauugcuuuaaaauuaaccuuugugcaauaccaagaaaauagcucuuuaaaagaaugucuuuguaugucucaagguaaauuaaggauuuacugaauaagguguugaccaaauccagaccauuuuauuuuauuuuuuuauuuauuuauuuuuugagauggagucuugcuuugucgcccaggcuggagugcaguggcgugaucucagcucacugcaaccuccaccucccggguucacgccauucuccugccucagccuccugaguagcugggacuacaggcaccugccaccacgccuggcuaacuuuuuuuuauauuuugaguagaaaugggguuucaccauguuagccaggauggucucaaucuccugaccuugugauccgccugccuuggccucccaaagugcugggauuacaggcgugagccacugcgccuggccagaccauuuuagaauugggaaauuuuagugagaaaaaaugcacuguaaauaugcuuuaguuuuaauucaguugggaugcacuaccuagcgaaaauugagaaacuauauacuucucagagaaauaucugacaucuauugucauuccauugcuauuuuuuuuccccagagacuuccauaauuuaaaauaaaauccuagauccaguucuuguuuuuuggcauaaauacuuaaucuauuuuaaauuuauaaaaucugagcuucuaggauccagcugugucaaccuuuauuuagcauauauaacuauaaaucacuuauuacagaugcuaaauagaucaccuuuuacagaugcugaaauguuugggauauguuuguugacaagguaaauggaaaugagaaacuuuauacuucaguuuucagauauauggaucuagaucccaaauaaaugauuaaucuucauugguuucucaaauucagguugaaauacaaauuaauagccuuuauugauuuuacuuuuaugagucauuguagacaucuauaaauauaaaagggccuguacccaaaggaugccagaauacuaguauuuuuauuuaucguaaacauccacgagugcuguugcacuaccaucuauuuguuguaaauaaaaguguuguuuucaaagccaucuuuaaauaguucuuuaaaaauaggucuuuuuuuuauauuuuggaaaaggcauuguuuuuaaaguaaagauaaaaugguaaguaccuaauuguauuuacuguaauaucuuauaacaugcagaugaaugcuuuauaaguuaaauaugauguauuuuuucauacuucuggauuauacuauaauucauaugaaaucuugauauuaguccccacacggaaaaagugaacugcaguugauauuugguguuuaagauagcaccauuguuuaaauaccgccuauguacucccaaaugaauaaaacauaauucuuguccucugagagcauacaagcuugugugauagauaaauaugcauuaaauaauuacagcuauagauuaagaacucguaaggaauaucucacaaagccugguaagaguucugacagaagagaacucaauuucagucauucaacaacaaauagucacucaacuccugcucuuuggcagguacgucaccaagcacugaggauauagcaauaaauaagccagacaauauuccugcccucagggaauuuucaucuugguguaagugacagaaaaggaaauauaugcauaauguaauuucagguauuuaaugcuauaaauaaaacuacagcagaacgggggaauaguguugcuaucuuagguaguaugguuggggucaggaaaggucucugagauaguauuuggaacauuuugaaagaagugaggaagcgagccacagugagaggaaacacauucuaggcagagaggacaggaaguaaaaagggccugagggaggaauuaaguuggcuagaggggaugggugaggagagagaggagguuggagaaguggccacugcaguauggugggaaagagcucaggugggacagccaggcccucuggcuucaaaa

SEQ ID NO: 17764 - RNA, 2166 nt, Homo sapiens
uaaaaaauaauaauaaaugaucagaaauuaagguagaauagagugaacacuaauagcgggaaauagcuaauuugcaggugagguggcugaaaggcuccuacgcuugaaguguuugcuggaugcacaggagaucugggauacaucccgaacucggcaacaggaccagcuccuuuccucaggguuacagaacagccagguuccaguucaggucugggaaucuacccauccagaguuugcgcccuuuucguuuugcaauuuaaaaccggguuggagggggaaggagugaaggcagcaugcggagaaaguaaauuacaguucaggugacaggaacaagaaaaucuccaaggucaggguggggugucaacgaauuaugcaaaacacugcggaaugaggagucacaaacgccuugcaaagaauucugaauuuuagaagcucuuugcagaacccccuucagcccgcuccaagcugccuugggucccuuucuaggcugucagacuucgccuuccuuuccuccuuguuuuucccagcaaccaaagcaucugaagaacauuuuuuuccuccguaaaucugaacaaauuuccuugcagcuuuccuugcagaagcuuuuuuaucgcuuuaacaaaacuuuccucugcuucucuagggagagccuaguauuagagcugcccgacaggcgggaccccgaaaucggggcagcucuggcuuaguccaggcuauucgagugggcgccugaacuggaggcgccgucuccaccgggauggggauccuagugcaggcagacgccuggcaggacucggcgagcugggguccccaccgcgguagccagagcagaaacccgaaccccagccagaggggccgcgcgcggggaggggugcgcgcuaagccagcguggcuuccgcaggagcuauuuuuagcggugcgugccuccccccgcccccggcgugguagccuccggcucgcggcgccccacggcuccucucagucucccccgccgcugccggcucuugguagcuuccacgcgggcagguccggaaacugagcaugucugcaagcgcucagcggcgccggcagcagcggggcuagagcugggcugcgucaggcugagcccauucaccucgcggccacaggagcucagcgccggcgccgcgccgcccagccccgccgagaggggcgcacucgccgccgcggggcccgccgccgcucaccgcagcccccuccuggcgacccgcaaguaaguuugugaggcugcugggcguuagggcgagggcuuggcgcccgggggaguccaggagggauagcgagaggcgcggcuggcgcccgggagagccggcuggccucugcccccugugccuggcgccucuccgagccacuuagccaauuugaaagcggguggccauugggaugcucgagcggggacgacgggcagagcaggagggcagaacuagcuccagcgggggcccagagggcggacuugggaagaaggaaagaccgcgcggcgagggaggagaccgggcggcgagggaggagaccgggcggggaggcuggguuuggggcgcgggagcccggccagggacagccgcagaaggaaagugggggugucgccgggggauagagugggagcagcgugagagcaguguugggggcgcagaguggagggcaagcgugucuugaacagaacggcaggaggauggguggaaaguggggcgcguggaaagcggauuuggacgagagcaaaggacgccgguggaagggacagugggcuccggaggggcgaguggauucggauaauuuggggaaucaguaaaaggcuagggggcacaucaugauggagucagccuggaaucugucucccgcuagaguacccgaggccacauguugggaacuggcuggggaaaggauggauguagaaaguggccuggagggccgacuggaaaaucgcugagggauuugggugaagagggggggagcugugcaguaucgggcggaggaacugggcugcugguagggccugaaagguucaggagaggguuggaggcuuccccgugccgccccuugaauagugauuuaguacuguuaucugagguucacuuucaccccuggcuccuccuccgucuacuacccggcuuggacgcaccucggcucgcuguaggcgagcuuuaggagauu

SEQ ID NO: 17765 - RNA, 863 nt, Homo sapiens
gauauugaacucgaguuggaagaggcgagucuggucucaaaauggagggccaugauccaaaggaaccagagaaguugagaaaacuguuuauugguggucugagcuuugaaacuacagaugauaguuuaagagaacauuuugagaaauggggcacacucacagauugugugguaaugagagacccccaaacaaaacguuccaggggcuuugguuuugugacuuauucuuguguugaagagguggaugcagcaaugugugcuugaccacacaagguugaugggcguguaguggaaccaaagacagcuguuucuagagaggauucuguaaagccuggugcccaucuaacagugaagaaaauuuuuguuggugguauuaaagaagauacagaagaauauaauuugagagacuucuuugaaaaguauggcaaaauugaaaccauagaaguuacggaagacaggcagagugggaaaaagaggauuugcuuuuguaacuuuugaugagcaugauacaguugauaaaauuguuguucagaaauaccacacuauuaaugggcauaauugugaagugaaaaaggcccuuucuaaacaagagaugcagucugcuggaucacagagaggucguggagguggaucuggcaauuuuaugggucgcggaggaaacuuuggaggugguggaggagcuauggugguggaggugguggcagcagagguaguuauggaggaggugaugguggauauaauggauuuggaggugaugguggcaacuauggugugguccugguuauaguaguagagggggcuaugguggugguggaccaggauauggaaaccaaggugguggauaugguggaggugguggaggau

SEQ ID NO: 17766 - RNA, 19099 nt, Homo sapiens
aaauaucccagaaauuuauuugauguuugcuugaauacauuuuauauagaaagauugggauuguuugccuuggaugccccuggcaaaucucgugaggcauugaacuagaaaggggugccaaucuggagacaucagaaauggaaaucacaagcccaauuuuagaacuauucuuaaagauuugucucuagugaaaugaggccacucccuuaaaaaugcucaaaguguuggagcuacugugugacaacagcugacauuuaggagggcauuucauguucugaucuguuagaacauuuaaauacuuagaaauaaaaaauauucagcuuugaaguuuucaauacuggaaaacuuucaagucuaggauuuacagccaggaagcgcugcucuguguuccuuaaauuggacucuguuucccacaaaguuaaucuucagcuuuggcuuccauuucuucugcaucaucaucuccauccacuucggcauuuucucuuucaagccucuccaucugccucgcaaguucagucucaucuguaucugugaccacuuugggcuguggaagcagagguauaauuucaaacugaaguaguaaauacuauacaaauuuaauuucaauacuauuacugccuaauguuuucucucuuuaacacuuuucuaacaacucugucauaucuguucacuuuugagugacuuaucagcaauaaauuccauuacauaaauaagaggugaaacuuaugagaauaguauagaaaaaggauguauguauuaaaauggaaaauuauuuucugucauuuuuauaagcuaaaacugaaaacaugaaauaaccccaauggcuguaucuuucaagaccacaaauagauauccuguuaaaaaaaccugucuuccaggcucaaacuacuacuuacuagcuuacuaguccuuuccauagaaggaaccauaacacacacacacacacacacgcacgcacgcacguacacacacuucuuucuuguuggacaaggaaaagacaggagacaacuuuuuuuuucuccaauucugagaucaaauuuuagacaugccacaugcaaauucaaaccauaaaaaaacuucucauuuauauuguuuauucccuucccccuggcuggggacggggggugacccuaacaccauuagugaucaaaggccugaaugaccauccuacaauaugacauuccaaggccgacagcucuuauuuaccuacaagaacuccuuuuaggaaccuccugagucauuauuaaaaaugaaucuauugaucucaccuccauuugaacauugaacacaccccucuuuuccucaaucuucucuuugauaacagccauagcuugacugaggacagaaaggccuucuguucucuccaggguugucguagucauuacauaccgaggaggagcuauuagauuaaucuaaaagagaaagacaaaaauucauuuaugaauguaccuacagaacccacaacuauuaggaugcuugagauuuuauuaaucugcuguauuaacaaaucaccccaaaacguaauugccaauucuacaggacaguaauuuaggguccuacagaauuggcaauuacguuuuggggugauuuguuaauguagcaaaagcaaaucaacacagggaucuaaugcaauaguauaaacaguucacugcgauacugaauagaaagaauuaucauuuccguguaucuuugguggcuaaacuaacugcaauuaucaucaguauaauggauaauuugucucugaacuaaacugauggaagaauccuucugaguuacagccauccaguuaauuuuaucacuaaugaaagauucugaucaaaccucauaaaacuuguauguguacagauagaagaaaguguuacucuuuuuuaaagugcucucaguauuuugggcacagcaacucuuuauuguaaaggagguuuggcaucgcuggcuuucuaccaauaggaaucuccauccacugugauaguaacaguagaaaccaacaaagccuaaacauaaaucacaaacaucuagaaauauuaccaagaaccacugcucaauuuuaagaguaaaaaacccacuuuuguuaugaaaugugauuaaaaaaaaaaaaagaaacaaagaucaaagauccuauuugguuuaggugagcauuucagcagggagggagacaacucaugacucaccuuaaugggcauguuuucuguagaacaauucaaaccugcucuuagggcuucuuuuacagcaucaaugccuucauaaccauaacaagccacuucaauaucuacaauuacaaaaauucaaaaguugauaaaaaaugcaaaaaauauuuaaaaguuuaaaggaaaucaaacacguggcagauauauuaguauucaaauacuuauacugaauccaaccucucuauacugcaguuccuuauuuauaaaagggaggcaaggaggagugugguaaagauggaauauaacaauaacugcaacuuaucuaaaacgguuuagaaauugcauuacccuuugacucagaaauucuacuuuuaggaauuugucuugaagaacauuuguguaaaugguuaaguauguauaauauaagggugcuaauuuguagcauuuuuuuguaacugugagaaaacuggcacaaccuaaauguucaucaggaggggacggguuuauguuaagguuuaucuguucuaugaaacauuacccagcauaaaaaagaaugagaaagauuccuauguucugcaauggaaggguaccuaugauacacuggguggaaaaggcuaguuggagaaaauuccgcaugguaugucucaucuuuguaaaaauuuggaauauuuuaaaguaugcacuaaaacaaaacaaucaaaccccucuuuuuaaaaaaagggcuaccuuuagguuagcugaacucacaagacuguuucuacuugugucaauauauaaauuuuaugauucagaagccaaaauaauuucuuaagcuuuuguuauaaaaaacaaccauuuagaaaaauuuauagauguugauguagcaacauauucuuugguaagucucauuauuuaauagcuuuuuugaugcaugcaaaauacuguaaaaaucauuuaaaaaaucauuuaccugcucgaauuuugacagccuguggggucaagcgccuauuaauauuauuaaugaguacuucccguucaucuucauucaaaucuaaacuauccaaaauagaugggucucuggucaaaaacauaaauaaauaacaaaaggucaagguuauauuacugauaaaugugaaaccaaacacuauggaacaaugcauauaauaguuaagcauauaauaguuaaugcauauaauaguuaaggcuuuagugucacaauuagaauucaaaucuuagcuuugcacuuacaccccaacugauuauuagugaaaucaaaauuuuagugaucugacuaaaacaagcaauuuaaugccuaacacaucugauauucuacuauaauugauuacuuccaugcaauuagcugucccugccucaaggaguuuauaaucuaucuugaauagaaaaaaaaaacauggaaaaacuuuuaaauguaacaguacaucugugggcaucaggacagaaagguauuacuuccaguuaaugaggucaggaagggcuucaugcaaaaaguagcauuucaucugacccuccuaagugccacaggacagggaccagggucuuauuaacuggcauguuuguugaaugagugagcaaaugaaaauaugaaauaaagacuaaaagaggaguagcacuguaaaaaguaaagguagaacuauuguaaaaaaguuaugauacauaaggcugggcaccagugacucaugccuguaaucccagcacuuugggaggcugaggcagggggaucacuggagaccaggaguucauagaccagucuaggcaacauagcaagaccuccaucucuauuaaaaagaaaaaaagacacuuugggaggccgaggcgggcggaucacgaggucaggagaucgagaccaucccggcuaaaacggugaaaccucgucucuacuaaaaauacaaaaaauuagccgggcguaguggcgggcgccuguagucccagcuauuugggaggcugaggcaggagaauggugugaacccgggaggcggagcuugcagugagccgagaucccgccacugcacuccagccugggcgacagagcgagacuccgucucaaaaaaaaaaaaaaaaaagaaaaagaaaaaaagaaaguuaugucauguaaaaaaggaauagcaugagcaagcaucaggcuuaauaagcaaggggucuuauugggaauaaaaggcaagagaauuuggguggagggaacuuuuacucagcuaacauaaaguaacgagaagacaaccaacauaaauguauaagaaacaagaugauaaacagaaaaugggcaaaugaggugaacagauguuucacagaagaaauacaaaugguuaagaaacaugaaaaacuguugaccucuccaacaaucaggaguaugcaaaucaaaagauacuacugugaauucauuagacuagaaaaaggagaaaaaaucagauauauaccaaauuguggcaaggauuuggugaaaccaagucaguuuaaagauauauaaucaauccuaugacccaacaauuccacuccuaggcauauauauuagaaacucucaaacaacuacauauagagacacauacacuauucaucacagcccuguuugacaaauggcacagaagggaaaauuaccuaaacaacucuuaauagaggaacagauaaagcauauucucacaaugaaauacuauauagagauuaauauggaucaaguauacaucuaucauugugggggaauccugcuuaauaauaggcuuauauguaaaaaugcaagcuacaaaaagauacaauagguuacauuuuaaauaaaaaaugauaauagacacauauguaguaaaacaauaaaaacaaaugauauugauacauaauuucagaauagugguuaucacugauaagugaggaaaauaggucuggaaagguaaaacauuguuuccaacuaugucagaaauuuuauguaauuaaaagaaaaaugcaaagaacuagcauuaguuaaaucuggacagucccuacaugaaugaagcaagaaaagagugcuaaggaaaagggaauaacacacgccaagguuuagugguaacaagggguugcuggaacuagaaguuaaagagguaacuaaagaagccagaugaugacaguugagacaaguuaagaaauguacugaggacugcaggacagaaauauaaaguuguguuuaauggcuaauagugcaaacucuggauggagccagaaugcacgcguuugaauacugccuggcucuaugauuuguuagcugugugaccuugaacaaauuauuuaaucucagcuucaguuucuucaacuguaagaaaaggauaauaauagcauuuauaccacagguuguuguuagaauuauauaaauguuaguuaucauuauuacuauucccaccuuuucuaccacgugauauaccaaaaaaaaaaaaaaaaaaaaaaagucacaugagaauaaacuugaagggauuuggaaccccagaugaguuggcuuucugggggacucuuaauggucuuggguccuacucauucucuuuuuuccccccucuaacucuuaacauuuaggaaggagugggagguaaagagacagcaaguauagagaacugaaagagucuggcuuuuuuuuuuuuuuuaagagacaaggucucacucugucauccagacuagagugcaguggugcaaucacaaaucacagcucacagaaaccucaaaccacuggacucaagugauccuccugccucagccucccaaguugcugggacuacuacaggcaaaugcuaccacaccuggcuacuuuuaauuuuuuuuuuuuuuagagauggcagucuugcuaugcugcccaggauggucuccaacuccuggccucaagcaauccucccaccucagccuuacauagugcugggauuacaggcaugagcuaccacacauagccaaguguggcuguuaaaagcagaggacgcaguguuugcuccaagagaaaguaaaggaaaaguugagaaguggguuuuauaguauaaauggaagaaacuagagauauuuuuaugcugauggaguaaaagcaauaaagggaaaggugacccaagagaaaaaguaacuaauagagaucucugagcagcagcugggcauagguggcaagacuaguuugagagcaauuaggacacaaauuccagugacagcagcauaggaagaaaugacaggugggacagagauauguaaguuuguugagacaguggaaaaguaguucuugugcaaugguuucuauuuucuuuauaaaauaaaauagguagugagcauaccagccaagaggcagggagcagggauagagugguuuucugaggaagaacguggaaaagcucuaaaauagccacuacugaagaacugaccaggagcagagagaauguggaacagcugaggcuggagaccaugaauaugcaguggaccaaccugcaagacugauuuuuccuaguagcacccagcagucuacaaguacagagaaggcaggaacauugauccaaggcuggauggauggaaggaaaaacaaggcaaaagcucacaauaauggcaacaaagucguuaaaaugauguaucauggugugccuauguuggauaagagagaaaaggcaggaaauggcgaaaagacagggagaaaaaagguuuggaaucagauccuaacauacagaauuaagaugacaaauaauaggaccaacugggagcuagaugaauaggaggcaggggcaaaagaacagaaagugugaauuaaagauuuuaguggcagagcaaaucccggugauaguaaggcccaggcuaaggcuacauggaagacuggcuaaaguggugugggcugaaagucaaaggagagucaaaagagguagagaaaacaagagguuauaguuuuuggugagacaugcucuuuagucccauagccacuuaggacaauaacuaggaaaggaaaaugugugagauaaaccauaugguuuaugaaucuacauaacuaugauacauaaaacuacacagacuugaccauauaggauuggcccauuuacuggccaauacaaaauauuuuaaucuaaauuuggcaaguauuuuauacauggaugcuaugcuguuaaauaucaggccaagaguugugauaucaagguagaaggagagucaagaagguauucuuacgagacugcaugcuuaaaugcaucauaggcaccauauccaggucucuuguacuugucaucaaagacccaggcaguccucuggaauaggcuuuccagcugcucauccuugguguauucuaacaccucagcaacaugacgaagaaugcuauaaaccuagaaauaaaaugaaaagcucaacaauucaaagauaagagauuuauaaaaaauguuuuuacauuuuaguaaauaacauaauuuggcuacaauaauuccuuaacaauaaaagaucuccauagggaaauacucacuuuaaguggguauaaaaaguagagauaguauacaauuuaggguccuaagaccuggaucaagucuugacaguaacacaguaucucugaacuuguuuccuccucuggaaaaagaagaaacuagcaucucuccuuacuacagagugcucgcauagaucaaauauauagaaaccacacacuauaaauggaaaacggcuauacaaauacaaguuguuauuauuacucccugaggagagaaucacgauaaaaaaaauuuuuuuucugucaucuuacccaccugccaaacuuuuucuuaccuccuaaaauuaacaggguguagacaaaaaguauuaaggucuucaucauaguuacacauaaaaauugagugagaaaagguacugacacugaauaacucuuccauuuuaacaucucaauaagaucuauuaacacacucauuuuaacaauauccuaaggagacaaaaaaauaugaaauuuucccagaaaagugcuucucaaaaguuaguaggaccugagagucuguauuucuaaaaaaacaggugaugucaaugcugcuaguuuagagacuacauucuaagugguaagguccuagaguuuauuaagaagauauuuuacugacaguguuuucaaauguguaaaccacacugcauaacuguaaauacaucaguaaaacaaaggaaaugauuuggguaacugauggcuuuuagaccuuuauuuucucucuuacugggauuaagcaagauuuuuuaaaaucucuucauugaaacuuuuuuuuuuuuuugauauuuuaucuugaggacagaaacacucauggcagaaaagaacagacaccagagaagggcaaagaaaacagaagcaauacaaacaguaccacuaagaacugaggauaggcugggcacacuggcuuacgccuguaaucucaaacauuccgggaggcagaggcgagaggaucgcuugagcccaggaggaggugguugcaguaaguugagauugcgccacuacacuccagucugggaaagacuuugugacacacacacacacacacacacacacacacacacacacacacacacacacagaacugaggauguagaggaugaaggauaacuuaaacaggaccugagaaaagagaaauacugacagaagaaauuaaauggcuaucuuugcuuugcugcugcuuacuguggaugacaagcaggaaguaauagcaaaaauaagaaugcaaaaagaaauaauccuaacacgcuaguggagggggaaaaaaaccaaaacuaguaacaggccucugccuugcuuuccuggauucacagacauuuuauaaaccccuguucauucuuaacauauaacagcugguugucuccguuacccucaucccagaacaggguugaaaaucaagaacuguauuuuggccaagugcauuggcucacuucuguaaucccagcacuuuggagggcugaggcucaaggaucacuugaagcucagggucugagaccaaccuggacaaaauagaaagaccucauuucuauuuaaacaaacaaaaaaaccccguauuuuaugaggcauuccaacuguaaacaaguuaaagcaguugaagucacccacaguuaauuuaaccuaaaacggcuucaaaacacuucuaguacuaauuugagaauauuagaucauaagcaauacuuuaagguaguagcaguaugaaauuaagauuucaaauuauuuauuaaacacacagauaguggacuaauuugacucaaagaucaacuuacaguuuuggauuuugugaauuugucuucacauuugauugcuuccucuggagaaacucuucuuuuugacaaaucaauauauccuguacaaaaaaauugugaaaaaaucaucucuguccagaugccacuguacuauuguaaccagcuuugaagaccaaauuaaguguuugauuggcauacuuauaauuauuuccuacuaaaauccuaucaacaaaauacugcauaaguauuacaaggcugaguaucccucaucagaaaugcuugggaccaaaaguguuuuggauuucagauuuuggaauauuugcaauguauuuacuaguuagagcaucccgaaucugaaaauccaaaaucugaaaugcuccaaugaacauuuccuuugagugucauguuggugcucaaaaguuucagauuuuggagcauuuuggauuuggggauaagggauacucaaucuguacaagaugagagauucugaauuguuuucagaaauaaauuuuuauuaucagguaauuauauauauuccauuaccuuacuggagagaacuaauaauuuucaauuauccaaaugaaagguagucaaaugccuaucuuuccccuauuucuuccuuuuccuucuccagaauaggaaaauucacuaagauguucauuuaguuuaaggaaagaggcuaucgucacagaagacacacacacacacacacacacacacacacacugaacaaauuaaaacuaucuaaucuacuguaugacuaccauauacaaguaacuauguuaggugcuuaaacaucuucuugaacccucacaacaauccugcaugguagauuaucacucucuuucccacagcgccccccagucuuuuuaaccugaagaaacuaaaacccaugaaagguuaaguaacuugucaacgucaaauagccaaaaauggcugaaaccuacaaaccugugccuggcaaugacuuccaguacaaugcugaguaacaguggugagagugaaugucuuguucucaauacuggaggacagcaugucugugguguuuuucuagacacucuuuaucagauuaggaaauucccuuuuaguucuuguuugcugacuuauuaugaaugggugacaaauuuugucaaaugcccuuucacaucuauuaaauugguuguaguuuuccuccuauauucuguucauauacacugauuuuauuucagauucugagcauucuuuuucauuaaaaauuguaugacuuacauauaguaaaauucaccacuuuuaguguuaaguucuuuguguuuaaaaaaaagaacagucauuuaaccaccaccaaaaucaaguuccaucaccccugaagccacuaaaaacuggacacaaguuucucugugaacauaaauuuuccuagaaauggcacagcuggguuauauauuaaguacauguuaauuuuaucugccaaacuuucccaaagugaauguggcacucugcauucccaugagcaauguggagcaguuagaacugcuccaugucucucaauugauuuuuaaaaagucaaucuauugauugugcaguggcaucucacugugguuuuuauuugcauuuuccuaaugacuaaugauguucaacaucuuuucaugugcauauuugcuauccaauuaucuucucuggcaaagugucuauucaaaacuuucgcuccuuuaaaaauugaugguuuagauacaggguuuuuuuguuuguuuuuuguuuuuuuuuuugagauggagucuugcucugucgccaggcuggagugcaguggggcaaucuccgcucacugcaaccucugccuccuggguucaagugauucuccugccucagccucuugaguagcugggacuacaggcacgcaccacuaugcccgcuaauuuuuuauauuuuaguagagacgggguuucaccauguuggccaggauagucucaaucuccugaccucaugaucugcccaccuuggccucccaaagugcugggauaacaggcgugagccaccgcucccagccuagauacaggauuuuuuagguuguucaagaguuuuuaaaauaugcugguuugucuuuuuauucucuuuauagugucuuuaaagaacauaaguucuuaauuuugauaagguccaauuaaucaauuuuuccuuucauggauaacgcuuuuagugugcuaucuaagaaaucuuugccuaauccaaggucagaaagauuccuguuuucuucuagagguacuuagaaguuuacaucuaugauucauuuuaagcuaacuuuuguauaaggugagguguuugaauugagguucuuuuuugcauauggacauccaguugucccagcaccauuuguuaaaaagauaauuuuuucuuugaucagcugccuuuguacuuuuguuaauuaacugaucauauaaaagcacacauaaauuuuuuaauuuuuuuuuuaaauaaaaagaagugagagauaacaaaagaggugagguccugcuauguugcccaggcuggucucgaacuccugggcucaagugauccccccaccuaggccucccaaagugcugagauuacaggccucagccaccaugcccagccaacauaaaguuaugacuguuaaaccaaacuggcauuccauacacuccacuuggucaugcuuuauuauccuuuuuauacauuguuggauuugaaaaacauauuaauuguuuuaucuaugcuaaucacauauuuggucaguaauuugcuuuuuuacaaaaacaugucuuuguuggguuuucuuaucaggguuaugauggccucauaaaauuagucaugcacugcauaacauuucaguaaacaauagauugcauauauagcagcagugcuguuaagauuauaauacuguauuuuuacuguaucuuuucuguguuuagguacacaaauauuuaccauuguguuacaacuaccuaaucaguauaguaacaugcuguacagguuuguagccuaggaauaauagaguauacuaaacaaccuauguguguauaggcuauaaggucuauguaagcagcacacucuaugaaauuugcaugauaagacauuuuucagaauguaucuuugucauuaagcaccacaugacuguauuucgaaaguguucccgccuccuuaacuuuuuuuuuuuuggugggagacagucuugcucuguugcucaggcuguaauacagcagugugaucacagcucacuacagccucaaacuccugggcucaagccguccucccaccucagccucccaaguagcuggaacuacuuuacagguacacaccaccacacccagcuaauuuuuuaaaauuuuuauagagauggggucucccuauauugccaggcuggucuugaaauccugaccucaagcgauccuccugucucagcauccgaaauugcuggaauuauaagugugagccaccgugccuggccuaccuccuuaacuuucugaaauuuuauuaugacucaucuuauuucugccuuaaaugucugauacaacucaucaauuuaaccaucuggccuagaguuuuccuuuuuuuugagacagggucuuagucacccaggcuggaguguaguggcaugaccucggcuuacugcagacuuguucuccuggccucaagcaauccuccaaccucagcuucucuaguagcuggaacugacuagaggugcacaacaccaugccuggguaauuuuucuacuuucuguagagaugagguuucgucauguuuccaggcuggucuugaacuccugggcucaagcaaucugcccaccucaaccucccaaagugcuggaauuacagacaugaaccacugugcuggucaggaccgaauuuucuugaugaaaagauuuuuuacaauaaauucaauuucucuaacauauaggacacucaaaauuucuauuuuauauuggucaguuucaguaaguaaaauuuugcaaggaauucacuaauuucaccugauuuguugagaugauuggcauaaaauugguaaugauauucccuuauuagccuuuuaaugucuguagcaucugcagugauagccccauucucauuccagauugguaauuuguguuauuuccuuuucuucaucagccuaacuagggguuuaucaauuuugcucuuuuuuaaaaaaacaaaaaacaaguuuuuaacuuugauacuguucucugauuuucugguacucuauuuucaccgauuaucuuauccuuauuauuucuuuucuucuacuuacuuuguguugggagaaagcccccuaaaaucuagccauaaacuggccccaagacuggccauaaacaaaaucucugcagcacugcgacauguccauaaugguccuaacgcccaagcuggaagguuguggguuuacaggaaugagggcaaggaacaccuggcccgcccagggcagaaaacugcuuaaaggcauucuuaagccacaaacaaaagcaugagugaucugugucuuaaggacguguuccugcugcaauuaauucggcccaucccuucauuucccauaagggauacuuuuaguuaauuuaguaucuauagaaacaaugcuaaugacugguuugcuguuaauaaauauguggguaaaucucuguucggggcucucagcucugaaggcugugagaccccugauuucccacuucacaccccuauauuugugugugugugucuuuaauuccucuagcgccucuggguuagggucuccccaacagagcuggucucagcaacuuugaguuuaccuuuccuuucuuuuaucuucuaaaacaaaagccuagauaacuguuuuagaucuuuauucuuuucuaauauaaguaauuaaagcuauaaauuuucccuuaaggcuuuaauauaugaauuauuuggaagggcuuauuuaauacugcaaacucuucccucccaagauaugacacugauuucaaaauuacuuccagugugaucagagaacauauuuguauuccaacccuuagaaauuuauuuagaguuguauuaauauuauagcucaccuuauugucuaucuuggugaaugucaugcacacuugaaaauaauguguauuuugccuuuucugggugcaguguucuagguaucaaacaagucaaggucuucauugaucuaauuguuucuccaauuguucagagcuuguucaaacuuccaacuaugauuauagauuugucuauuucucucuugaauucaauuucugcuuuauauuuugaacucuauuauuaggcacauacacagugaugacuguuguuuuccuucuaacaaauugacccuuuaucauuacaaaaugucccuguuuaaaucugaaaauacuaugucuuuaaaucuacuuuaucuaauauuaauagacacugucuccuuaagguauugucugcauagcauaucuuuuuauauccauuuauuuucaaccaaguauaucucuuguagacaggauuaucgucgagucuugcuuuuuaauucauccuaacaaucucugccuuuuagcuggaauauuuacuugauuuacauuuaauuacugauauaaaugaauucaguuguaucaauaacugaauaauugaauaccuacauuuuagguauuuguuuucuauuuguucuuucugguuuuuguuuuuuucuuuugaguuuucuuuuagguuaauguuuucuagaauuccauuuuaauauaucuuuggcuuuuacaauaguguauuuuguauuuuacuuacuuauuucuagagauaguuucacuauguugcccaggcuggucuugaacuacugaccucaagugacucucccaccucagccucccgaacagcugugacuacaagcacagaccacugcaacuggcuuauuuaaugguuguucuagaauuuacaauauacauccuuaaccuuuuaauuuuacuacugcacauaaaauguaagaaucguuaagaaucauauagaucuauuuaccccacaccuccuggccuuugugauuaaguugucaaguguacuaagccugcuuuaaacaguauucuguuuucuuagcuucuauauuuaacuacuuggcauccauuaaucacagagccaacuguauuaacuauauauuuuauuauuaauauuauuaguaguaacuaaauauuuucuuauuuucuguauucuugaggcucugacauuuguggagagacugccccuccgucagguggggaggagucagcaaagggcuugcuugguagcaugccuuucuuaugcagagcagccaaucuggagcccauaaacucauacaccaagccaaaauucucccugcuguaagucaagggccagguauuagacaagcagggcagucuuuaugccccaaggcccgccaaaagcauucaaacuagccaacugcaagccguuuacgcugcucugccuugcuuuuccugcagaaacuccaacaaaagcucugaccuacuuuuuccccuaguuccuugugacuccugacuaaaacuggugcuuccccauguggcccugcauggcacaucaagcccccuucucucaggcaauauaaguaguaaaaguuuucuuucaagggcauuggacugugucaucacucagucaccucuauagauuacaaucccacaggcacaaaugagacaaauaguuaaauauauuuuuaaagaaacuaagaagggcaaaaauagucuuuuacauuuaccuauauauuuuccaugucaggucaucacaucucuucagcuuaaagaacuuccuucaccucucucuuuuuuuuuuuugagacaaggucugguucuaucacccagguuggagugcagcggugcaaucuuggcucacugcagccuccgccuccugggcucaaaccaucccccuaccucagccgcccgagaagcugggacuacagggugcaccaccacgcccagcuaauuuuuguauuuuuuguagagaugagguuuugccauguugccccagcuggucuugaauuugugaguucacgcaacgugcccaccguguuccauuccaugcaccguauuuaugagaaugcugaccaaguguagaacacuuagcacaaagugaccuggaugggguggggcgugguggcucacgccuguaaucccagcacuuugggaggccaaggcggguggaucacaaggucaggagaucaagaccauucuggccaacauggugaaacccugucucuaccaaaaauacaaaaauuagcugggcaugguggugugugccuguaaucccagcuacucuggaggcugagacaggagaauugcuugaaccagggagucggagguugcagugagccaagaucgugccacugcacuccagccuggcgacagagugagacuccaucccccaaaaaaagagaauauagauuuuuuguuuuagcaggcagucagaaucugaacucaaaacuauaagcucugucuccccagaugguaagcaacugaaaucuguucagauuuuuccccuauuaggcuaccuggaguccacccuguguuucaguaguucagggacaaaccagagauuugggaagaauuuauauagacuuaggggaucucccuuugugccugccgccuccuuucucuaacccucaccacuaucaccaccaguuuccaucuacuaugguugucuacaacucucgccuccaguucuaaagccaauaagaccauaaauuuucugcuagaaccuuagcugccuggcuugaagcugucuucagcauguacuuaggucaaaaaaaaagguguaaaacagaaaacauacccuuucuuauaagugucgacucaccuucaaauuuucaauuuuggccugcuuuuggcugcuucucauugucuuuagguaguuauuuuucauacuuguucaggguuuauggcauuuacguugaaaggcuugucuaggaggacauaauucucuaguaucaaaaugaauccucucuacaggcucuuuugcacuuugcuuuuucucauccuauccuggagaucuuccauaucaaaauauucagaucucauucugcauaaaauugcauugcacgcauuuguacugauuuauuuaaccaguccccauuuuggucauuuccugguuuuaguuaaugccauacaaacaaaugcuauggaaauaucuuuacauguaucuacuguacguaagcaaguaugccauuccauauuuuuucugauugcaacuaaaaacauauuugauuccuccuuuuguguauauuuuauacaauagaaaaagaaggcugagcacaguggcucacaccuguaaucccaguacuuugugaggccaaggcaggagaaucgcuugagcccaguucaagacuagccugggcaacacagcaagaccccaucucuacaaagaaaguuagcugggcaggguggcacaugccuguaguuccagcuacuugggaggacugcuugaggaacacuugaacacaggaguucaaggcugcagcgaccuaugaucauaccacuacacugcagccugggugacagagcaagaccccaauucuuaaaaaaaaaaaaaaaaaguacaagauuagacacuacuuuagguacuacuaggacagugaugugaagacuuaccuaaguuuaacaaauagucucaaaguaguuuaauaauuuugggcggggcuauagcuaagucauagcaaaacauuuaaaacaauccaugugcuaaguagcagucacuaccuaaggcauaagacauccucaaaaucuauguaucaucuaaggcuauaauaaaaaaaauuaaaaugucaguauguauaaaauuaaucacuugcagaagugagaaaguaucaguaaaccagacggcugaggagauucagaaggguaaguugaaucaaggugacugauaugaagccuuucggacaugaugguaacuaaugaccuaaaacuaacaccuaacaaauuauaguaagauggcugaaacuaaaaccuacguaaugguauuguacaccauguuuaaaaaaagaguauucacaaaggugaugauuuacauggggcccagaaaaggcauccaauaaguaaaaaaugaaugcucauccaaaacugucugaaagauaccacgagaucugguagaugcaaacauucuaauuaccagcaagauauacaauguuggauuucagguguguauauacacgcauaguauauugcuuuuucaaagcuuauauaaaagaucccuaaaauccauuugccccauuuucaugcuuacccagugaucucauuacuauuuuagcuuuaaaucaagaaaaaggcauccaacauauucaggccuaccaauguaaaugaacuaguacucugacuuaccugucucuaaguuugguuaccaugagucaauuaucaagauccugauaaacacuagaaauaaaauucaaguuaucugauccauaaaauccuaggauguacuaauuaaacuacuauuaagagaucuugcuuagauagcuaauuggcauccuuuucuaacaacuuuguauguaaaagguuuaaguauaaaaggagcuuuuuuuuuuaagcugcagcuugcaauuuacaaaaaauguauuuuuaaauaaaccauuuuaaaucugaaauuuauauuacagauauuuuucucacuuaccuuuuucuuuguccacccuaaugacaaccacacacucauuccugccaauucggaugaguuuguugauagaacggauacgccuucuggauaauucacuaagaagaaucaugccuucaauguuguuguauuccagcaagcugacauaagcccccauuucagcaauggaucugacauucaccaucacuacaucuuccaccucaggaaauuuguguugauaaaaucuacaacuuagacccggcauucugcaau

SEQ ID NO: 17767 - RNA, 1705 nt, Homo sapiens
ccaugaucaccacccgggggugggaaggguggcgggaggaagccuucaggcuuuggagccuuacacuuguugcucucuguucuccaggcgaaguucugguuuccacaacccggauugggacacugccugucuccagcuuggugcuggacguuuccuccuccagagguguucccucgggaacccugggguccucuuggagggaggccuccucuaucuccuccacggccucccaugugacccaugggucccccaggacuuccugggccuccuggaccuccgcagaguggugguggcaucccucugcccucaugggguggcauaccacccugcauacuguucacuggaggccucuuccgagcaagagagacuuuaaguuugcucccuugaaaaucuuucccaucaaaccauuccacggcagcuuuggcaguaggugagucuucacaggacacuguggcaucaccuuugggcuuucuuguuuccuuguccagguagguguggaucauggguugcucaguucucuuguucaucuuaacaaccccacacugcuuaaagaagucuaccagaucaucuagagucacauugucauuuaauccuuguacauaaauugcacuguugucagagucuucaucuggaucuacaggugggccuagaucaagaucugguccuucauccauggguccaccaggcuuauugaagccaacuugcucuccagcgcugcccauuccaccgcauccuccuccccgcccaccucugcucaugccuccacgaucaaaucccccucuuccccugccccaguuaucagggccacucaugcuccgguucucuccuaguccggaaaauccuccagacuccugcccauaaacacccaugcuacuggggugguccugucagaaugaacucugcugcccguagcugcugcucuguuagcuauacugacuuggagcuuggcuguaggaucaaguuugggguggguaacuagugggaggcagcugcccauagcugcuuuguugaccauagcuacucugcuguccauagcugcucgguuucccauagguguucugcugagaguaacugcucugaucauaacuaguuggcuguguagaggaauagcugguaggaggguaggauggaggugcggugacuggcugcauggaguagcucccagguaccuggggauaacugcaguuacucuguccauauccuaggcugggcugguuguaacccccugugcuagauugagguugacuagucucagugggcuuguuuccauucugcagucuuguaggugcaguggcuacuggcugcugcccauaagcuggauaagcaggcugagugccauaugcagauugagcugcauaggaggccugggugguggugacuguagcaguggugguaucauaagcaccagugccauaccccuggacaggcuggcuguaugccuggggggcaguuggaguaguauaaccagugggaggcuguccauaagaaguugcauaggcggucugcccauagauugcaguggucugagccuggguauagcugacaucaaugggcuguccauagguuccauagcuuuguugcccauaugccuggguggucugugcauauccuugagugggcuggguguuguaagcacuguagcccugcugcgcugcagcuuggcuauagguacuguaauccauggaugccauuuucucuccuuccu
